United States Patent 11,242,544 (MICROBIOMES AND METHODS FOR PRODUCING MEDIUM-CHAIN FATTY ACIDS FROM ORGANIC SUBSTRATES) - sequence listing, part 7

SEQ ID NO: 425 - DNA, 732549 bp, Unknown
  Metagenome-assembled genome
tagcacaaaggccatctttcaaaatagaaccatgtggtctatctattatgcggtattagcatctgtttccaaatgttatcccccacttctgggcaggttacccacggttactcacccgtccgccactcattccgatgttttatcaatcaggtggcaagcaccttcaatcaaaaacgggaatgcgtacacttgcatgtattggcacaccgccagcgttcatcctgagccaggatcaaactcctaatataaaataagaagcttgttagctctttttgatttgttactttaagcgaatgacttcgcaaatgttttgcctttaaccctacgggctaaaggaccctacacatttgatttgtcgaaactttgttcagttttcaaaggtctaccatgttgcttccttttgaatcagcaacgttgttaataataataacagattgataattcagatgcacaactttttcttgatcattttgatcacggtgttgttaacgtcggtgacaacgattaattactatacacggcttttcgtatctcgtcaacactatttttaaactattttgtaaattccattaaaaaagcatccccctttaataacgggaatgccttaatcgaataatatctattaagagttatatactttacgtgaaaacaaacgcatcattttcactaaaaaagatgactctaacaagtcatcttaataaaagcctattcttctggtagttctccagcatcatatacatcagcaacatcatcgtttgactcaagttcatcaatcagatgttgatattgagatgctttgtcagcaggaactgcagtcgtattttgaggaatcattgtcacttcagcagtatccaaatcgtatcccttttcttgtaaggcatcacgaacactagctaagtcacttggaacagtgtaaatttcaaatgctgcctcttcagtgttcatatcttccgcaccagcatccaaggcatccatcaacattgtatcttcatcagtgtccaaatcttcgcgaagaataacaatgtatccacggcgatcaaacatgtacgaaactgatcccgtagcaccaagagagccacctgaatgagtaaatgctgaacgaacagcagctgcggtccggttcttgttatcagtcaatgctgacaccataattgcaataccaccaggaccgtagccttcataggtaatttcgtcgaacttagcgccaccggcaccagttgctttatcaatcgcacgttgaacattgtctttcggcatgttggcagcacgagccttatccattaccaaacgaagttgagggttgtttgctggatcaggatcacctgcttttgcggcttgatacaagtcacgtgaaattttttggaaaattttgccacgtttggcatcttgggcgtttttacgtccttgaatattatgccattttgaatgtcctgacatagtaactcctcttttctatttattttcaaataacacacacgaaaagtctatcaaaatcagcaagtgatttcaagatttaaaaccgtttatctatgatcggtggataactttattaattcccaatagtaaaatcccgataataattgccccgattaggtaaattaagctactgctaaaaatagcattcggtaattgcggactgaatgatgctaaaacttcctgagacgttaaaacactcgtcaggaccatattggcacccttgatgataattagggtgataatcccgccaaataatgcgacgattcccaaccaactaagcacataacgtttgaacaacgcaacaaccaataacaagactaaaacgcctccactgacaatttgcatcacattcactgcttgtttaaccgttgccagttcattactaacggtcgtcagttcggttgtatctaactggtcattaatcaccgatgtcatttttgctcttagttcactcttaaccgtactagataagctaactgagccatagcccaaactagaaactttttgattaattaatcgatcaactcgattatagactggtgtgtagtcaatactaactgtttgatcattgaacacatcactaattgcatcttttatcaattcgttagcaatcttttttgtcatgattttctcagacaatccatactgcgaagcgctctgattaacatccgaaacgatctcatccccaatttgagattcggttatctgattggcaacaaacttttcattaagtaaggtttgattggcaatcatcgttatcataaaaataacgataaatactatccccaaaaatttagaaccaacatggcgtttttgctgcacgggttgttggcccattgaatgacgttcctgtcttgattgcaactaatgatagccacctttctattttgctgaatcgcgttcaacaaatccatgaggtaggataatattgcgttcgtcaacttcttcactattcatcagcttagtcaacaatcgcattgaaacggcaccaatatcatagagtggttgtgtcactgaagacattttgggacgcgtgacttcagcatacttggtgtcatttgacgtaataatttcgaacgcttctggtactttcacgccacgatcagtcaagccatttagtaacccggctgcaagctcatcatcaccaacaaacgccgctgaaatatctgaattttgtagctgttcagccagcttataacccgcatcataagattcattggttccaaacacagatgcgtcatcgaattcaattcccgctgcttcgagtgcctgcttatatccgctcaaacgatacttcccgttgattgcttgatcaatgggaccagtaactaaagcaacatgttggttgccgtggttcaacaagttagttaccgcttctttagttgcggcaacatagtcaatgctgacgctaggaagattatcctcttctcccataaaaccagaaacaacaactgggatctgagcgcgtttaaattcctgcttgatatcatcgccgatcttgttacccataaatacaattccatcaacctgcttcgctagaagtgtattcaccacctgtaactctttactaccattttcatcagagtttgccaggatgatattgtatttgtacatcgatgcgatgtcatcaattccgagcgctaattgcgcaaaaaaggcattcgtaacatcgggaatgataacccccacggttgtcgttttcttacttgcaagaccacgtgccaccgcatttgggcgataatccaatcgttcaataacgtccagcacctttttgcgcgttgctggtttaacattgggattcccatttacaacccgagagacagtggccatcgaaactgctgcttctcttgcgacatcgtaaattgtgactgtttgtttttccatttacattaagccctttcattgttgatttaactagctttcattttctttcataacttagctaatatagcagataattaccaaaagtgcaatctgaaaaccctatttttcgtaaaaatgacatatttagatatggtataatcgtatctgataaataaaaaaggagcgagtttaatgacacaattagaaaaagtacagcaacaagtcgctgatcttcacttagacgttgcgtatctgagcgatccaatgacaatcaattatttaaccgggttcggtagtgaccccatcgaaagaatcctggcattactcgtctttcctgatcacgatcccttcatctttgcccccgcattggaagtggaagcaattaaggataccggctggaagtttccggtatatggctaccttgaccacgaacagcccttccaaatgattgctaaccaaatcaaaaaaagaaatcccaatcccaaagtatggggaattgaacaatcacaattgaccgttagtcgcttaaaatcattgaccactgaatttcccaatgccacctttaataccgacttaacaccaaacatcgaaaaacttcggctcattaaaaccgaaggcgaaattaaaaagcttgatgaagctggtaaatgggccgattttgccttcaaagtgggatttgaagctgttaaggttggacaatccgagcaacaaattgcagcaaccttagaatatgcactcaaacaacacggtatcatgcaaatgagtttcgatacgcttgttcaagctggtgcacacgctgctgaaccacatggtgccacttcaatcaataaggtgcaaaataatgaattagttttgttcgacctaggtaccatctacgaaggctatatcagtgatgcttctagaaccgtgggtgttggcacgttgacagacaaacaaaaagatatttatcaagtttgcttggaagctcagctaacagcccaagcagctgccaaaccaggtatgactgccgcgcaattagataaagtagcccgtgatattattgaccgtgccggctacggcgaatactttattcaccgtctcggtcacggtatgggaatgagcgaacatgaatttccatcaatcatggcgggaaatgacatggaactagaacctggaatgtgcttctcaattgaaccaggaatttatattcccggcgttgcaggtgtccgtattgaggattgcgttcatattaccaaggatggctgtttaccatttactcatacttccaaggacttaacatttgttgactagtgataaaaaagcatgcgacgattgaacactatcaatcgtcgcatgctttttgtctaccgaatatgaattgattagtcttgatcagattccgtatccgttttgtcaattacaatatcttcttctggttgttcgcgtgtcactgacgataactgttcccgaattgaagcagtttgttcgtcaaaattgtcattactgaagtgtgacaaggcttcgtccttctttgtactcaatttatcacttgtgttttgcactttttcctgaaaactttccctataatcatcagcattatcaagaaattcttctgctgtgtcctctgctaataatgcataatcaattgcattttcctttaagtcagtccacgtctgacgagcagtttgtcgcaattgttcttttcgactttcagataatgaccgatatgcaacaaaggctaccgcaccaccgaccactaaaccagctaatccttttttcatgagttttcctcccatttaatcttggctatttttcttgtttcgatgtcgtttccaaatacttgtaaccgccgtcttaccaagcgttgcagctaaacctgttcctgctgtttttttagcgctgcccttgaatcgatccgtcaccttatgcgttgcatcgttcaactcagaaacacttgttcccaaatcggcaactgcttgaaatgccggatcaatcgtcgataccttttgattaacatcttctagcaattcattggcattgcctaaaataacctcaacttctttactaagtgcatcggcatcattcgttaataccgcaacactatttttagtttcttttaacgttgcacttaagcgaactaaaaataggccgataaataagactagaattaaaaatgcgattgctgcaattaaccctgcgatttgtcccaccgtcatccatgttccctccttacagaatagaccacattatatgttcaagcatatcacgttacaaatttcaccgcaacgaaatctacatgaacggttcaaacaacgctagcagttcactaatttttttgctactatatcaatagtctgtcaaattggaggagtttttggtgaatctgactatactcgcgtctatcaacgccaacatttcaaaacaaacaacaagttttacgaattcattaaccaaaattagctggcaatcaattgctgaacatgcgtttagccggctcttaatgattattaccattactgtcgcgtttgcccttattctgtggatcggccgctggctaatcaatcgaacgtttaaacgctacctcgctaaaacgccactggcaccgaaccgaaccaatacgattcgcaccttaacactcaacattttccgatatacatgtttctttttctacctttacgccattctttcgctcatcggtgtacctgtggggacgttaatcgccggtgccggaattttcagtatcgctcttggacttggtgcccaaggctttgttagcgatgttgtgactggtttctttattttaatcgagcaacaaattgatgttggtgatgttattcaaatcggtaccattaaaggtacagtcacctcgcttggaatacgaacaacccaagtgaccagtgctgacggcaccctcaattttatccctaatcgtaatattaccatcgttagtaacttctcccgtaataatatgcacgtccaaattgacattcgcattgactctaacgcaccacttaatcaaattaagatgattgtaacgagtgtcaatgaaaagctgaacgctcaatttgcagaggtgacctccggaccagacatcgtgggacctactttgaacagtaataatttacttgtttttcgaattaccgttacaaccgaaaatggtgcccaagaaaaaattcgtagtgcttacctttccgagtatcttagcgcattacaagagcaacacattacactcatcaagtatacagataaaaaggacctatcttaatcaccgctataataaaaaccttcgaaaaaattttttcgaaggttttttattatgctttaattgtattaaatcgatgttcaaaataccccgtaatcgcatgaattcctgatccgatagccgccgtattaggtgccattttctcactgtgtagtgaataaggactgtcaacgcccaaccaaaacatggttcccggaatctttgaaatcaaataaccgaagtcctctccagtcatcgcaggttttgtctcaatgaagttaacatctgtttgatggctcatataatcaataaaatctgcggtaatggcaggattattttcaacgggtagataaccaccctgatgaagcgttaaatcaacctgacaaccgtacgttaatgcaactccttcagcaatactacggactcgttgctgcattaatcgattattatcctgtgttaatgcccgaattgtgccatcaatatgtgcatggccggcaatcacatttcctgtatcacccgcagttaggtgacctaaagttaccactccaccctgaattggatcaacactccggctaacaaccgattgaatttgcatgacaaacgcactagccgctactaccatatcattggcattatgtgggtaggccgcatgcccacttttaccataaaaatcagcatgaatttcacatgtcccagcaaagagagttccattcaaacagccaatagcaccagcaggtagttgcggattatcatgcaacgcataaatttcatcgggcatccattcatcgagagcgccactttgataaagctgcatccccccgctatgattttcttcagatggttgaaaaataaaaatcaaatcatactgtggttggtgatcggcaaaataactcaaaacacctaacgccaccgtcatgtgaatatcgtgcccacatgcatgactaatcccttcgtgcttcgatttaaacgatagaccagtttcctcagtaacgggtaaagcatctatgtccgtccgatagccaatccgtttactatggtctcgtccagccaccttcacaagtattgcagttggcaattgggtcaccgttttaatcgttaagaaatcctgtggcatctgcccaataacggtgttcagaaagtcatgtgtcttaaattcttccagtccaagctcaggatactgatggagatgacggtaaatttctaacaattgattgtttgataacgtcatattaatttcagcctacagctttctcaattcgtccattaattcagtcttgctcttagttttatcatcaatatctttaatcttacgagcaggaacaccagcaaccaccgtatttggttcaacgtcctttgtgacgaccgcgccagcaccaacgactgagcctgccccaacatgtacgccttccaaaacaacacagtttgcaccgatcagcacatcgtcatccacaatgacaggcgtcgccgaaggtggctctaccacgccagctaacacagttccagcaccaatgtggcaattttttcctacgatcgcacgccccccgagcacggcgcccatgtcaatcatggtcccttcaccgatttcagcaccaatattgatttgtgcccccatcatcacaacggcattatcgccaatgagcactttttcacggataacggcaccgggttcgatccgtgcattaatttctttcatatcaagtaagggtacccctgaattacgacgatcattttcaatctcataatccgcgattgcaccttcattagcagctaagaatggcttaacatccttccagtcaccaaaaataaccccgctttggtcatttacaaatggtctgatcccgtctggaaaggtaacctgtgcgagatcacctcgtaaatatactttaaccggtgtcttcttttcagaattaccaatgtaattaataattgattgtgcatctagctttgccatgtgaaactccccttctctaactacatttgatctttagttataatatcatactcttcatcaatatcatgaacaagatggttaattgctttaaaaagttcacgacgcgttacaatccccgtaaaatcaccattatccgccacaactggtaaaaatggttgatccgttaataagtgcaaatcttgttcaacatcatacggatcgctaattgttggggcatctgtttgcatgacatccgcaactttgattgtttttagtttttcaacattaatcgtttcggtttcaaacatttgttctgtaatcatggccaaggataataatcctttataccgaccatcattatcaagcaccacaattttagcgtatttgattcgggttaaaaccaaaaatgcgtggtataaattattattttctaacacgttggcgacaatgttggcgggaatcaaaaatttttctttgttttccgttaacatatgctcaactgctgagttaatcatcgaaagctctcccttcattagctccattgtagctaactcggtttcaattagatacataaaaaacagatgataataaagttttacactttacacacggttacttcttttcgcgctcaaactcgagacgaagttccggtattgcgttcatcgaacgattgtagtactggaccgtaaatcgagttgactgcacatctacaatggcaaaagtaccgcccaaacgcgcataccgaccgcgtggcaagctaatgctgcctggattcacatacaaggttccctgactatatatcgcacttagttgatgagtatgcccataagcaacgatatcagcatgttgctcctgcgccaaaaacgccaagttgttcatggtaaagttaacattttgcaaatgcccatgagtcaccaacaatcgctgggtgccgacttctaacagttgctgtttggcgaacggctgaccgaaatcattgtttcccaacacactgggcatgctttcaaatagtgggtcattaaccgccatttctgaatcaccacagtgaaccataatgtccaccgaagttttaaacgtggccgcaatggttgtcaatatttcacgatctccgtgattatcactgacaattaaaattttcattcttccgtccaccaactttcaaactgcgtcatcatctggcgcattgctcgtcctcgatggctgacactatttttctgttcgtcagttaattccgccatggcactattcaatttcggcaagaaaaataacggatcataaccgaagccgttttcacctcgccgttgagttaaaattagcccattcacatcgccattggctacaagcttttgtccgttgggtttcagcgccaccaacgtcgtatgaaagtgcgccgttcgttgatccatcgaaacgcccaccaagttcgctaacaatttatcattattggcatcatcatcatgatcccccgcatatcgtgcagaatgaattccaggtgccccgtccaacgcatcgactacaagaccagaatcatcagcgactactggtagttgagtcgcagttacgacagcctgagccttaattaaagcattttcttcaaaagttgtcccattttcttctatttcaatcggtcggtcaaagtccgccaacgtcttcacttcaatttgccatggcgcaaataactcacggtattcacgcgccttattgggatttttagttgctacaacaatttgcttcatactaatctcctagcttaatgtttgaaacatcaatcatcttattttctaaccattgcccagcgacattccgaaattcaattggatcgccggttgtaaaataccaagttcgagctttgggagcatccgataacccgtcaaaggctatcaattggtctttgacaaactgggcagtggccgcccccgcatcaaccaatggaattggcgtcctcagcgcctgctgaatttcagcttgtaacaacggaaaatgggtgcagccgtaaataattgcatccactggatgctcattgaagaactgcattttttcagcaactacttgccgggcatgatcagttttcatcatattcttttcaacaagtgtcacgaattcctggcaagccaatccaatgacctggctattgggatcaagcgtttgaatctgtttggagtatgcttgactttcaatcgtcttttccgtggcaataacaccaattcgttggtgattcggtaatgcaagtgccgcatgactaccaggactgataaccccaaccaccggaatcggtaactgtgctttcagatattccaaggccgcagctgtcgccgtgttacaggcaataatcatcaatttaatatcatattcaagtaaaaagcgagcaatttgaaggcaaaattgttggatctcttcaaccggccggataccatatggtaaccgtgcttgatcaccaacaaatacaattgattcatgtggtagttcccgttgcaataccttggcaactgttaggccaccgatgccagaatccatgatcccgattgggcgtttgtccattattctcgtctcctctcaccaatctctgattcttaattattacgttgtctttagattttttcaaggaaaataacctaattaatcctttaaccgacttaattaacctgtataatagtgattgattaaataaaggagtgcacttatgtctcaacgattatacgaacaactattacatgattcggctggcctacctcaatccgtactacgcgatgtcctcatccccgccgttttagataaagaaaccgatggtattttatactgggccggtaaggatttggctcggcaatttccggttgaaagtacctcatccattgtcgcactatttgatcaactcggttttggccatctgaaattaaaaaagcaaactagcaaacaacaaatctggctattagacggtcaattagtcaccgatcgtcttacactaccacggcctaactttacattggaagccggttttctggcacagcaaattgaactgcaaaccaatgcaacaaccgaagcccaggtcaccgaacaaaagaaaaatatggtcgaaatcttagttcaacataatattaaggattcagctagtgatattgaaccagttgagtttcttcaattggaaacaccacagactgatgacgccgaataaaaaacgcttgccaacaaggcaagcgttttttctgtgatcattgattaaagatattggttcaaaagttgacttaactgttcttttgagtgatagccaacaatcgtatctactacttgaccatcttttttgacaaccaaggttggaatactcatgatgccaaattcttgtggtgtattcgggttttggtcaacatccatcttgttaaatgtgacattcgtcatctcttcggataactgttcaacaacgggtgactgcatccgacaagggccacaccaagttgcccaaaaatctgttaatgtcacaccagttgcggtgtcttttttaaatgtttgatctgttgtttctgcgactgccatttcaaattcccccttaatttatgattatccatagtgtaccaaaagttttttaaaatacaaatttatttgcttacttttaatcagtttaaaattgcttacaaaaagacgatcgtggcaccatcgccacccgcattaggagctgcgtattcgaacgacttcactcgcggattactttgcagatactggtgggttcctttccgtaatgcgccggtgcccttaccgtgaataatggttactgacggtaaattgtttaagatagcatggtcaataaaccgttccacttcttgcattgcttcttcatagcggtgcccccgcaaatcaagtcttgcggacgtctgccgtgtctgttgtgtgtggaccattgcccgtcttggcttcttttctgtttcttgaatattcgtcctatccgtcttttccaagtcgctttcggcaaccttcatcttaagaattcctaattgaacttcccaatcttgtttgcccatcttgcgtgtcagctcgccatactgaccatatgacttcaccaataccgcatcacccaccttcaggttatgcttgcgtttttcacgttgcaggaccttattttgctttaaacgcggatcatcgacatgtaaggcattcagggcgccctttgcatcaatcagctggttttccttaacgtttgtcccttgctgacgttccatctcacgcagatgactaataattttatcagcttgtttccgtgcatcggcaaccaagtgatttgcttcagcccgtgccttttgattcatttgttccttattgttctcaaactgactcagtttttgcttcagctctttttgtagtgcttcagcatcgtgtaactggccctctaaggctgtcgcatgatcatgtgcttgttttcgttgcgccaccaagtcaccaatcatatcattaaggtcctggctgtcatcgtcggttaacgaccgtgcttctgtgataatttgaggatcaattcccaatcgagtggcaatctcaaacgcattagaacgacctggtattcccaataacagccgataagttggttgaagcgtttcctgatcaaattccatgctggcattcatcgtttcaggacgatcatacccgtagactttgagttctggatagtgggtcgtgaccatcacatagctccccttagttccaattgcatccagaatcgccatcgcgagtgccgccccctccttaggatccgttccggctcctaattcgtctagcaaaactaggctgcgatcatccaactgatctaaaattcgtttgacgttttcgatatggcctgaaaaagtactgagattttgttccagtgactgttcatcgccaatatcagcaaaaatattactgaaaacgccgaccgtactctcttcatcagccgtaatgtataatcctgactgcgccatcaactgaagaagtcccattgtttttagcgtaatggtcttcccacccgtattaggtcccgaaataataatcgccttatacgactcaccaataataatatcgttagccaccatcttttgaggatcgatcaatggatggcgtgcctttcgtaacgccacatggttgtctgcactcacaattggcaatgtcgccttcgtcgcatgcgctagcaatgccttggcatttacaaaatccaaatgaccaagaatcccttcattgtgcttaatttcaaatcgataaggaactaataacgctgataattcagccaaaattcgttgttcttcatgacgctcctcgatttgagcctcacgcaacttattatttaactccataactgcctgtggttcaataaatagcgtttgacctgtttgactttggtcatgcaccacgccaccaaagtgactccggtagtttgcctggacgggcaagacataccgctcattacgcatagtcacaatcgcatcacttaaatacttcgcgtctttaccacgcgtatagtcttccatcttttgacgaatcagtgtttcgtttcgtgtgatcttttcacgcaggccgtgtaatttaggcgatgcttcatccgttaaccgaccatcgtcttctagtgcgtcaaccaattgctttgtaatcgttggaatcgtcactaactcgtcaacgtagtgttcaatcgcccgcacatcaatttcttgttgccgtaatttttcaaagaacgttttgaccgtggcacttgcccgcaatacacgactcacctgagcaagttcagtcccattgagggtcgccttaatcttgagtcgcttaagttgtgttgagatatcactcaacgttggaattgggattccccctgccagccgaagaatatcagctccggcggtggtttccgccaacaactgagtcacaattgtcatgtcagcctcgggttgaagctgttccaactcttttttgccggccgcagaaactaagtacggcgacagctgtcccttaattttatcaaacgccattgtttctaatatttttgtgttcatttatctattcctttaatttaacgatttgacagccaggtgataaactgttgtgatatcactggcgtgttatgaatcatccattgtgcaaccacggaagaactgagttggttttgccacccatcattagggaaaacttgaaacactaccagaattgcaaataccgtcacatacaccaaacctaaactaataatcccgccggcaaccgcattggcttggtgaataaccggtaatttagtcaacaagttcaagcgtcggctcacccagtgacagagcccaatcacaatcccaaaaataatcatgaaggcaattccgttatagaaaaacgcattgccgttactcagttgactgctattcgccgtttgtgaagttaaaattgggaaaaagccagcaagccaattgccaatcgcggttgccccggccttagcaaccacgattgcgaccacgtaactaacaatattcagtagcattcgtaacaggccctgacgttttccgtgaaagaatccccaaactagtaagcataaaattataattgtcagtatcatcgagatgcttccttactggtcttgctcgtgaagtcgttcaacttccttttgtttttcaatttgatcagcaaccgcattgaaagcaactaaattagcccgctgcagagccgacaatttaggattaacttccttcaagtattcaatctgctcgtttaccaattgttcagcaaccttcacatgctccgccgatcctggtccggcaatggtgtaggtttcaccatcaatttcaattttatatcttttctttacattttcactcattatgggcctcctaaaaagactatctgtaatattctatcattatcaatttttaattactattggaaagattatgctacactaaattcatcaagtttaaaggatgtcagtcatgcaagaagttcatcaagtttcatcggccgagattactcggttaaaacaatattatacatcgtcgcttacttcaaccccacccggtgcagtatttcgtgctaagaaaaatggaacggttgtcacagcttaccggtcaggtaaagtaatgtttcaaggcccccatattcaatctgagctcgctcggtggcattttaccccacaagctgcggcaaccacatcccataccagcacacatcgtcacgctacgtcccaaccattgcccactggttttgcaacgtggtcggtgcttggctctgacgaagtcggaactggcagcttctttggaccactcactgtagccgcagtattcgtcgatcgcgatcacttggataccgtgaaggcccttggtattcaagattcaaagaagctcaccgatcccgagatcattaaaatggctaagcagctaattacctttctaccgtaccatgttgttaatttaatgcccgataagtataaccaattaatggcacgctatcataatcaaggccagctcaaagcactctgtcacaacctagccctccaaaaggtcttgcaaaaaattcagccaacgactcctgatgcaatcttaattgatcagtttgtcgcccccgctacctactatcgctacttgaaggggcaaccagtcattctcaaggaccacgtctactttcaaatcaagggtgaacaggctcatcttgctgttgcagccgcctcggtactcgcgcgctatgtgtcactacaagtgatggatcagcttacggaacaggctggcattaccctaccaattggtgccggcaatgctgtcgatcaaattgcagccaagctgctgcaccgcggtctttcacttgatcagtttgccaaggtccatttcgctaacacacaaaaagcccaagcaattgccgcacacttaaagtaaaaagcctcgtgagatttttctcacaaggcttttttgattgatctcatatctgactaggcgttaaaatttccatcatcatctaagaatgtatttaatacttcctcgaccatgtcccattcggcgtcatcttcaattggttctaattcgccttcactaccgtcgtcttggttttggtaagcataagcttgaatatcaacctgttcgtcgttttcagcgcttgctgggtacagcaagatatatgacttaccataatcgtctgaatcaaatgtaaagagaactttgtaaagctcttcgtttccttgatcatccaccaacgtaataaaatcatcgttttgtgcttgttcactcatttaaaattcctcacaattcttgcgttagtttaccatgtcggtccaaatagttttgcaaaatcaggctggcggccagtttgtcgataaccttcttacgttttcggcgtgacgtgtccgcctcttctactagcattcgctgtgcttcaacggttgtcagtcgttcatcctgatagtcaattggtaagccaaattccttggttaacaattcaccatagtgctgagcggcgaccacccggggaccttccgtattattcatatttttgggcagtcctaagacaaacccgccaacttgatgttgttgaactagttcagcaacacgttcaatcccgaacacctcgttgtcttcatcaattcgaataatctcaagtgcctgtgcagtccaacctaatggatcactcagtgcgatcccaaccgttttcgacccaacgtccaaacccattaatcgcattaactactcctcgttcgtctttaaatatgatcgtactaattcttcaataatctcatcacgttcatgcttacgaatcaaattacgggcatcgtttaaacgcggaatataggctgggtcaccagataacaagtaccctacaatctgattaatcggattgtatcccttctcttccaaagcttgatacacagtattcaacgtatcgtgaacatccttttgattattatcactaaaatcaaaaaacattgttttatcagttgccaattagtacacccccagtattacaattctatccaacctaattttactagaagcgcgctcaaagtacaatcaatctaaccgtgatgtaattgattcgtaacagtcaaccaagcttaattattggttaaggtagtccaatgctaactgaagcgccttttctatcccagctgggttcttaccacccgcctgagcaagattaggccggccaccaccgccaccaccgattgcgggggcaatcgtcttgatgaggtctccagctttaacgcctgccttcaccttgtcatcgctcaccgcaaccaataagttgaccttatcaccggcagcagttgcaagtaccagtacatctgacaaggctttttgacgccaagaatctgccaactgtcgtaattgttgcattccaggtaccttgacagcggaagcaatcagggctccttgctttgtctcttgaacatgaccaaagacatcgctcgcttgttgtgccgttaatttactctgtagcgcttcattttgctgttccaacgtcttgatttgctctaataacaattcaactttatgtggtacttctttttcttgtggcgctttaagtaagcccgcggtctgtgcaagtaattgctccttaccatgcaacagatcaaaagcatcacttgctgtcacggcttcgatccgccgaacaccggcgcctacaccaccttcggaaacaattttgaagaggccaatttcatttgtattcttgacatgatcaccaccacaaaattcagtgttgaaatcaccaattttaacgactcgaactcgatcaccgtatttttcactgaaaagggcaattgctcccatttccttagctgaattaaggtcggtttccaccgtttcaatttggatttcacgccaaatttgttcgttaaccatctgttcaacctttttaagatcttcgtcggttacagatccaaagtggttaaaatcaaatcgcaagtagtgttgttccaccagtgatcctgcttgctgggtatgcccacccaacacattacggagtgcttgatccagtaaatgagtggccgtgtgattcttttcaatttttaagtgacgcgcacggtctaccactaatttatagcgagcaccctgtttcaatgccttttccaatttaattgagtgtaaattctgaccatttggtgcgtgttggacgtccacaatacgtccaactacttcgccgtgattatcaatcatttcacctgtgtcggcaacttgaccacccatttctgcgtaaaatggcgttcgatcaaagatcacttcggccaactcatcacctggctgggcatcggttgcaattgcggccccctgagccagtgccaataccttagcatcatccaccaccaagttttgatacccaacatactcactatcttctttaaagtcggtccagagatcgctttgaacccccatcgacttcgccgaactacgcgcattacgcgcacgggtttgttgtttcttcatttcagcttggaaaccatcttcatcgactgtgaggccggcatcagccgcatattcacgtgttaattcaacgggaaatccgtaggtatcgtaaagtttaaaggccgttggtccatcaagctgtccgctcttagcttccttagcagtagcaatgacttgatttaataaggctaatccatcattcaaagtggcattaaaccgttcctcttcagacttaatgacagaagcaatatagtccgcattcttgccaacttctggatagtatgacgccataattttacctaccgtcgggaccatttcatataagaaagcatggttaattccaagctttttaccattcacaactgcccgtcgaatgagtcgacgaatgacatagccacgtcccacgttcgacggtaacgcaccatccccaatggcaaatgtgatcgcccggatatgatctgcaattaccttaaacgaaacatcatccgcatcattttgtccatattgtttacgatcactaaaggattcagtttgtttaatcagtggtaagaacagatcagtttcaaagttcgttttggcgtgttgaaaaatcgaaaccattcgttctaatcccatccccgtatcaatgttcttatggggcaacggttcgtaggtatcttctggcgtgtggttaaactgcgagaagacgatgttccaaacttcaaggtaccgttcgttttcaccaccaggataattttctggatcgtctgcgctaatattgttcatctcttgtccacgatcgtaaaaaatttctgaatcgggtcctgaaggtccctgaccgatatcccaaaagttatcttcatcttcgtaaatatggctgtcttgcacacctagtgattcccaaatcttacgtgtctcttgatcctttggataaaccgtaatgtacaatttttcaggatccagaccaaaccactgatcactagtgagtaattcccaagcccacggaataacttctttcttaaagtaatcaccgacagaaaagttccccagcatttcaaacagcgtatggtgccgtgcggtctttccaacgttttcaatatcattagtacggatactcttttgtgaactcgtcagacgggggttctcaggaacgactgacccatcaaaatacttcttcatcgttgccacacccgagttaatccataatagtgtcggatcatcgacggggaccaatgacgcacttggttcaatcttatgaccatgttccgcaaagaaatctaaaaacatctggcgaatttcactacttgttaattctttcatcgttttcccttactttccttaataaagtaataaaatccaccattgctagcaaagacgccttacgacgcggtaccactttgcttgcaacgatggatttcgtttacctcttaatctcgataatgctgagccgcatgtattgatgtgttttttgaacaccttcagggagcattaacctatgagtctcgtttttcacagcgaccaaaacgtttctgaaagtcatcataagtcaacatgtcctgaacaaaccataggtattatagccgaagcccgaaatcaagtcaacggttggtcttcttcttagctcggcgtgcttggcgcatctcgtgtcgttttgctagtttccgatcttggcgttccttttcagaaatcgcgcctttgatcttcttcttgtaacctggtttgaccttcttcttcgtctttttgacgaagcccttcaatgtcggatcaagttctgattgcttttgtttccggtgatcacgtcgattacgatgataagtatcaacgatttcaccatttttaatttcctttggcttgaactcaatccccattttttcaagttgagaaacctgaacatcgttatccggttcgtaaagggtaaccgccgtccccttcatctgatttcgacctgtccgtccaactcggtggataaagaactccaggtctgtaggaatatcatcgttaatgacaacggacacaccctcgatatcaatcccccgggctgctaagtcggtggccactacaaattgaaaatcaagattatgcacctgacgcatgacccgtttgcgttcccgtggcgccattcctccatggatcatcgcaacttttaagttgtgtttttgcaggtaatcgacaatctcttctacccgagttttggtatttgcaaaaactaacgccaagtagggctcacccattgtcaataattgataaattagatgatttttactttttcccttagttgataacaaccagttatcaacattaggactaatcaccgaagttactggaatttcttcgacgactgggttttgcatgtacttcttcaaaaatggccgtagtttttcgggaatcgtcgctgaaaagaccagcatctggacatcactcggcaaactaccggcgattcgatcaacctgatccaagaagcccatatccagcgtcatatcagcctcgtcgaccacgaagtgctgtgctgagtgaacatctagtgcctgttccttgattagatccataatgcgccccggcgtcccaatcacgatactgggttgttgccgttttaattgttcaatttgacgctttttatccgttccgccaacatagttatgcacaataatttgttcaggtgctgtcttcaccaactgtttggttgcctcataaatttggtacgcgagttcccgactaggcgtcgcaatgacgacttgaacatgatgttgttgcggattaatcccattcactaggggtagtaagaaagcatgggttttaccacttcccgtttgagattggccaacaacactctttccttcctgaacaagtggaattattttttcctgcacgggtgttggttcggtaaactgaattgccttcagtgcctccccaataaacggttgaaacttaaaactttcaaaggttgccgtcattcattttctcctttttctgcttgggtcaattgatctagttcttgaataatttgttgaatttccgcttcatccttagccttagccccactcgctaatgggtgcccaccaccatcatggtgcttagcgacttcattaattggcactgttttggaacgtagacgaacacgatacgtcccatcatcttgttgtacaaagatggcccataggtcgacatctttaattcgacctggtagcggtacgacacctgaggttcctgcttccttcaattcaaactgatccaaaacatcctttgtcagttttaaataggccgcaccatggtctaaaatcgtcaaatgttcgtagacatacgcggataaccgggcaaccggcaaactaagctcatcttcatggcggccaatcgcagcaccgtccgctcccaatgccattagcgctgcagcaacgtttagcgtatgtggcgttgttgctgggtacaagtaacggccagtatcaccaataattccggctaataatgcatgtgctgctggttgtggcaacgtcagttgatcttcaaagcgttgataaaaatcataaactaattccgacgaacttgacgcctcaggaaccacccacataatgtcaccatatggttcgtcattgggatgatgatcaattttaatgagtttagcgccctgatcaaaacgacggtcatcaattcgcggtgcattggctgtatccactacaatcacaagtgcatcatcaaactctgcattgtcgatttcatccatggtgccaatccaatcgaatcctggaatatgcttaccaacagcataaatggtcttatatggaaatgacgcttttagaatttctgctaaaccagtttgagagccgatcgcatctggatcaggtcgttggtgccggtgaataataatcttagaatactttttaatctgggtaaaaatttcatctaactcgttcattggtattaagtgtcccttcttcattaaagtagaaccggtactaaatcgttcctaagtatacaggttattcaaaagactttcaaacgttgatctaattggtattatcacgatttatcattacgccaaagaggtaatgtcagattttcaaattccaatgccgctagattagtgaccgtgatgccaagcaatcgaatgggctgctcaccacgattaagttgttcttgaagcgtcaacgcggcttggtacaatacctccggatcgttttcaaagtactccacctgcgttaaccgcttcgtcagagtcgtgaaatcttgataacggaccttcaggaccacagtttgaccatgcttttgatgtttcgtaagcgtctgtgcgaccaatcgtgctaaatacctcaattgctgatcaatttcactatcggcaatcaaaacatgattataggttcgttccttaccaattgactttcgatctcgctgatatgccaccggtcgatcatcaatcccacgaacgcggcgatatagctggtaccccaatttgccaaatgcctgcattaacccattttcactctgatcataaagatcttgtccgttcataatattcaattcatgcattttcggcactgtctttttcccaacgccccgaaatttctcaattggtaaccgcattaaaaaatcgtgaacatcatctggcatcacgattgtaacacccatcggcttgcaataatctgacgctaattttgccagaaacttattgtacgaaattccggtagaacacgttaattgaacctcatcataaatttgggcctgtaattcatgggccaactgcaccgcactactaattccaagtttattatccgtcacatctaggtatgcttcatcgagtgccaccgattcgatcttgtccgtatatcgatgaaaaatcgcgtgaatctgatcggaaacctgacgatagtgagcaaaatccggcgttttaaatacagcattaggggccagtttgagtgcctcctgtgcgctcatcgccgaatggacccctgcttgacgtgcgacataattagctgttgcaaccacaccatgcccaccgttcaaacgcggatcgtgggcaatcactaacggttggcgacgccattgtgggtgatctcgcatttccacggaagcataaaaagcatccatatcgatatgcacaatttgtcgggatgcatccactttcaaagccgattgcataaacgccttcatcttttcacctctatttcaccagaataaaaaacacactgactagtttcttacgaaaccaaccggtgtgtcgttaacaaattattacttagcagcttcttcgctgtcatcagccacttcactagctgctgcttcttgtgaatcagcagtcgttgcgtcactggcaacttctttaggttcagcctttgcttcttcgatgtcttcagtagtagtctcactagttgaagcttccgccttagcatcaggacgaacaactgtcgcgattgctgacaaatcaaatgtcagataaattccttcgcaatcaagaacaacagtccgattgctagtattaacttcatcaaccgtcccatgcaagcgaccaattgtaatcacttcgtcgcccttctttaattggctcaccatatcctggtgttgctttctttgtctttgttgtggtcggatcattaagaagtacataacagcgaccatcgcaacgataatcaaaattcctgaatagttcatttagattgacaccctttcgaatttactatactacaccatatcaaaaaatgacttaaattaccactaacttagaaatttcccgcattttctttgttaaaaccgtacttttcaaataccatttcacgaaattcgagcacttggtcatccaaaatggcttgccgcatatcatgcatcaaatgaatcaagaaatacaagttatggtaactcgtcaaccgaatgccaaacgtttcattcacatgtagtaaatgccgaatgtaagctcgcgtatagttgcggcaaacatagcaattacattcatcatcgagtggtccaaaatcatgggtatattgtgcgtttttcacaacaaggcgtccatgggatgtcatgcaagttccattccgcccaatccgagttggcaaaacgcaatcaaacatatcgattcctcgcatcacaccgtcaatcaatgaatccgcggttccaacccccattagataacgtggcttattttctggtaaaaatggggtcgtcatttctaggacccgattcatttcttccttcgattcaccaaccgataatcctccaacagaatagccgggaaaatccatactaacgaggtcccgagcactttgttgccgtaactttttaaacccagcgccttgcacaattccgaataggccctgccaatcaggattctgatgagccttcaatccccgctcagcccatcggctagttcgctccacagaagccttgatgtagtcgtaagtctcaaaataaggcggacattcatcaaaactcatcataatatctggtccgagtgcattttcgatttgaatggccttttcaggcgacaaaaacatggtttgtccactaactggatccttaaatgtgaccccgttttccttgatgtttcggtgcttagctagcgagaaaacttggaatccaccagagtctgttaagatccccttgtcccaattcataaacttgtgtagcccaccagcctcttcaacaagtttttcaccaggttgaagccagagatgatacgtattagccaaaatgactcccgcacccatctcatctaactcttccggcgcaatacttttaacggtggcttgcgtgccgaccggcataaacatgggtgtcttaaacgtgccatgaggcgtaattaattcgccggctcgcgcccccgtatgcttgtcctttttaatcagccgatacttaattgctggttccatatcttcctacccttcgctttacttaataaacattgcatctccgaaactaaagaaacgatacttttcttcaatcgcatgttggtacgcattcaaaatcgtatcacggccggtaaacgaagcaaccagcatcaccagcgttgattttggtaaatggaagtttgtaataaacgcgtccacgaccttccaatcataacctggcttaataaagatatcggtccaaccagaatcaggtttaatttcaccgtcaaactttgagccaattgtctctagtgtccggattgaggtcgtcccagtcgcaataatccgacccccatttgctcgaacatcgttaagcgtttgagccgactgcgcatctagccgataaaattcactatgcattttatgatcttcgatgtttttttcgtcgaccggacgaaaagtcccaagtccgacatgcaaggttaaatataccaacttaacgcccttttcttcgaccttctgaagtagttccttggtccaatgaaggccggctgttggcgcagctgccgatccattttctttcgcatatacggtttggtaacgttctggatcatcaagtttttccttaatgtagggtggcaatggtgtttctcctaatttctctaacacttctagaaaaataccgtcataatgaaattcgatcatgcgtccaccgtgttccagttcttcagtcacggtagcagtcagctcaccgtcgccaaacttgatttccgtccccggcttaattcgcttagccggtttaaccagtgtttcccacacatcaccttcagtgttattcagcaacaacacttcaacatgaccacccgtatcaggctttacgccgtacaagcgggccgggagaacccgagaattattcattacaactgcatccccagcatgtaactgatccaaaatatcatagaaatgctgatcctgcatctcaccagttttatgatccaaaacaagtaaacgagaagcatcacgtttctttatgggggtctgcgcaattaattcatgtggtaaatcgtaatcaaagtcatcaacagttaattcagtcatcatttttctcctctgagttcataatagtctaatccaaggtgttcatatgcagcgggtgtcgcaactcgcccccgtggtgtccgatttaaaaaaccaatctgcagcaggtagggttcatacatttcagcgatcgtattcgcctcttcaccaatattggccgccaatgtattaagtcccaccggacctccctgataaaaattgataatggtcattaataacttattatcgacttcatctaggccgcgactatccacccgtagcaggtctaacgcggaagccacaattgcttgatcaatggcctcgtgaccgccaacctgggcaaaatcacgtacacgcttcaataatcgattggcaattcgaggtgttccccgtgaccggagtgccagctcatgggcgcccgccggctcaattgccgcgttaaatatccgcgatgaacgcttaacaatttgctctaattccgttgtttgataatagtccatatgctctacaattccaaaacgatcgcgtaacggcgccgataacacgcccgcacgagtcgttgcaccgatcaaggtaaacggcggtaatgggaaatgaatgggatgggctgtgggcccctgaccgaccacaatatctacaaaaaagtcttccattgctgaatagagcatttcttcgacaatttttggtaagcggtgaatttcatcaataaacagcacgtccccgggttccaactcgttcaataatgcaaccaaatcacctggcttttcaatcgccggtccactagtcgttttaatatgaacatgcatttcgttggcaatcaccatcgctaacgtcgtctttcccaatcctggcggcccatacagtaacacatgatccagtgcttcttgtcgttcaccagcagccttaatatacacagacaattcatgcttaattttttgctgaccaatgtattcactcagtaaatggggccgtagtgacagctcaagcgacgcttcttgctcgtcacttgcccgtgatgacatcacttgatcatcatccatgtgaccgcctcctctcaattattttgtgagtaatgtcaatccatgccgaagatactcgtcggtagtggttgtcggtaactcccgtaactttttggcaatcttttcaacttctttactccgataccccaacgcctctaaagcagcaagggcatcttgcaaggccggctgatcagtcgtttgcgttgctttggtttcatggaataaatctggttgactcaactgcccaattttatccttcaaatccaatataatttggccggctgttttcttgccaatgcctgggaacttcgtcaaataagcaacgtcatccccggcaattgcgtcaaccaaaccactgtgatcggtattcgctaaaatagcaagggcactcttcggaccaattccagaaacattaatcaatttttcaaatagtgctttttcttcttggtcgtaaaaaccatacagtgccatatcattatctcgaactgcttggtacacaaaaatgcgcacctttttttgatcatcttcttggtaacgatatggattagccgtcattaacttatacccaacaccgtgcacatctagtacaacaaatgctggtgtcacaatcgttacgaagccttcaaaatactcaaacatggtttttcctaccttttttcaatatccgtacaattgtatcatatctcgttccgactgacccgttcgaccaccggtttcgctaattaaaattcgtgttcatcaaattcagccgcatagggatcgtggctatcttgaatccgtttaaacattttttctagttccgtattatcaaaatgaatcagcactggccgaccatgaggacaattaaagggattttcgcactctggcagccgttttaacaaagctttagcctgttgatcgtccagatggtgattcgccttaatagcacgcttacaactcatcataatggccgtcttctcccgaaattgtgccactgtcagccgcccatccttaataatccagtcaatcatctctcgaattgtcgcttcttcttgcccctgcttaatccaagtggggtgcgaatgaaccacaaaactattttgtccaaaggactctaagtacaggccaacctgttttaaggtatctaaatgatcactaatcgttaggacatctaccgtcgaataatccaatacaagtggaataagtaagttttgctgatcatcactcacttcaccaatcttttggcggtaatattcgtaattaatacgttcttgtgctgcatgttgatcaacaatgtataggccatcactagcttgcgccaacaagaatgttccatgcatctgccccaaatattgcaactgtggaaaccgttctttttcagacgtgctagtcggttcgagttctaattcagtattagtgcccgctgaagcttcgttaacttgagccgggctggctactacttcttgtgggtaacgagccgtaaaagcctgcattgccggaccgttcagttcagcacggtgtttaatcacaatcggcgtgacttcagcaactgcctcatctcccacggacgccgacactggtgcttgttcatcactattgacgtgttctgacggcgccccatcattaaccggataggtaatagaagcttcgtttaaattcttttgtagcgcactaaaatcaatggccggtgcttgatgaaagtcttcaaggacatctggaatgagattttgttttgccatctgttgttggatggccatcgtaatgagcccctccaactggttttccttactgattcggacttcctttttcgctgggtgcacgttgacatcaatcaacaccgggtctaattcaatcagcagtacactcattggaaaccgaccaatcatcagctttgagccatatccctgaataattgccttagtaagttggaaattacgaatatagcgttggttaataatgatcgaaatatattgccgagaggaacgggtcacctcgggtagcgatgtgaagccgcgaacagaaaagtccggatcctgcgtttcaattggtatcatcttttgtgcattcgtattgccataaattgcagcaatcacctgttggaggttaccattccccaccgttcgaagtaattcacgctcattatggatcaacgaaaatgcgacctcagcgtgagctaatgccaagcgatcgacaatatcggtaatttgagttaactccgtctgtggtgattttaaatattttaaccgtgccggagtattaaaaaataagtcggtgacggtaatatcagttcccggccgggccgttgcgggcttcatcgtgatggtttcaccgccgcgaatatgaatttccgttccctgctcactgccggttgccgttgtcataatcacgtctgcaacggacgcgatacttggcaaagcttcaccccgaaatccgagcgttttaatgcgaaagaggtccttgggactttgtattttactggtcgcgtgccgtttaaatgcaattgccacatctgcctgatcaattccgtcgccgtcgtcaataatccggatttgacctaaacctgcttcggtaacaatgatatcgatttgtcgactatgggcatccaacgcgttttcaaccaattctttgacgattgaagctggccgctcaatcacttcaccagcggcaatttgatccgcgagtacatcacttagttcatggatttgactcactgtgtcctccctcctagcacttgactactgtagtttctgttgccattcatacattttattcataacatccattggggtcatagccatcaaattcaaatgttttaactgctctaacaccttgttagtcttcggatcaacatcgactgggtcaaataaagccagttgatcgacttcgtgggcatctacctcgtagtcttgggcgggttcctcagaagattctggttgctgcccaactactggttgtgcagcaacggttgttggcttttcttgtggcagtgtaaccgccttttcctctagcccctgcaaaatatcgttagcacgcgtcaaaagactggcaggcataccagcaagtttagccacatgaattccgtatgattgatctgccggtccgtcttcaactttgtgtaaaaataccagttctccgtttttctccacggcgcccacatgaacattctttaatgccggtaatgtctgatctaaatccgttaattcgtggtaatgggttgagaaaagtgttttggcatgtactttctcgtggacaaactcaataattgcttgtgccaaagccattccatcatatgtggctgtcccccgaccaatttcatcaaataaaatcaggctattttcactcgcatgactcagcgcgttattcgcttcctgcatttcaaccataaacgtactttgaccagaaattagatcatcggcggccccaattcgcgtgaaaatctgatcaaaaattggtaattgtgccttcttggcaggtacaaagcatcccatctgtgccatcaccaccgttaatgctaattgccgcatataggtgctcttaccagacatgttgggaccggtgatcagtaaaatcgtggtttgatcgttcatgacaacatcattaggaacataagtttgatgacccataaatttttcgacaactgggtgtcgtccctcttcgatttccaaatcgtgaccacgggtgaaactaggtcgcacaaaatgataggtttcacttactactgcaaagctttgtaaaacgtctaactgtgccacctgcttggctaattgttgtaggcgttcaatcgaggccttcacctgttctcgaatctgggtaaacagcgaatattcaagagccgtagacttatcctgtgcctcaagaattaacgattccttttcctttaattccggtgttgaaaaccgttccgcattcgttaacgtctgtttacgttcataacggtcatcggggagtttacctaagttcgccttggtaacctcgatataatagccaaacacatggttaaacccgatttttaggttgttgatcccagtagtctgccgctcttgagcctccaactgggcaatccattgcttcccattcttcatcgcatcacggtactcatctagttgcgtattataatgatccttaatcacaccaccatcggtgaccgaaatgggggactcttcgtcaattgaccgatctaataagtctacaatatcatctaatggatccaacgttgtcaataactggtcaaacactggtgaatcaagcgactcgaggacgtaccgaattttggggatctgttgtaacgaagtttttaactggatcagatcacgaccattcacacttccgtaagcgacacgaccggctaaccgttcaagatcgtatactttcgtcaattcatcttgtaggttactccgttcaaagtaatgatccaataagacctgaaccttatcttggcgttgctcaatttcagtttcattcagtaacggtcgatccagccattgtttgagtagccgacttcccattgcggttttagtctcatcgagcaaccaaacgagggttccctgcttcttaccactacgaatattggtcgttaattctagattatacttagaataatgatccatcttcaaaaagtatgatggttcatatgccactgcccgttgaagatgagccagcgttcgcttttgggtggtcgtcaaatacgacactaatgatcccacaacctgtttttccagttgactggttaaatcttgtgacaaatagctaacttctgcggattcaacaatctcgttttgatgtgatacaagaattgactgggcagcaaatcgatccgtcaattgtgccgccacagaatcgtcgactacaatttccttggttcgtaaattaatcatttcgttgagcaacgaatcacttgtgtcaagcacgctcgtttttaattcaccggtcgataaatccgcatacgcaaatccatactgggtcccttgctgaattaacgctgtcaaataattgttatctcgtgcttgatcaccggataagtccatctgagttccaggggtcactaagcgcgtcacttcacgcttaaccatccccttcgccaacttggggtcttccatctgttcacagatagcaactttatacccctgatcaattaaaatatcaacgtagttttgaaccgcatgatggggcaccccgcacatcggaatgggatgaacagaatttttgtttcgttgtgtgagcgtcaactctagtaattgtgatcccttaatcgcatcatcgttaaataactcataaaaatcacctaatcgataaaataaaaatgcgtccggatactgatctttaaccgcctgatattgtttcatcattggcgtttcacttgtctttgttgacactgatttcacctcattaaattaatagtataattctaccacgtttcattgctttttatcgtcgattctatctgcagatcaacaacaaataaggattgaaggaagtcatcaactccctccaatccttatttagcgtaatctactgaacgaacttctcgaataacagttaccttgatatggcccggatattccaagtctttttcaatttcctgtttaatatcatgtgagagctccgttgcctgcaagtctgaaatcatctttggcttaacgatcacacggacttctcgtccagcctgaatggcataactatgatccacaccacgatgcttgttcgcaatactctccaattgctttaatcgttgaatatagttctcaagtgattcacttctggcacctggacgggcacccgaaatagcatccgacgttgcaacaaggacagcaattacagattccggttcaacatccccatgatgagacgcgattgtattaatcacaaccggattttctttatacttcgtagtcagttcaacacctaattcaacgtgtgaaccttccacttcatgatcaactgctttaccgatatcgtgtaataatcccgcgcgctttgctaatgtaacatcctcaccaagttcagcagccaagattcctgctaacttggcaacttcaatcgaatgatccaacacattttgcccgtaactcgtccgatacttcatccgtccgataattttaatcaaatctggatgaatcgaatggattcctagatcaaagacagtttgctccccagtttcccgtaattgttgatccatttccttttgtgctttttcaacggcttcttcaatccgtgccggatgaatccgaccatcttgaatcaacttttcaagcgcaattttggcaatttcacgacgaacaggatcaaagccgctaagtactactgcttcaggggtatcatcaataatcaaatcaatcccagtcaacgtttcaagcgttcgaatatttcggccttcccgaccgataatccgacccttcatatcatcattgggcaaagttaccaccgatacagttgtttcagaaaccatatccgcggcacttcgctgaattgcactgacaattaagttcttagcctttttatccgctactgcagcagcttcttgttcactatcccgaatcatgatttcgcgttcgtgtttcaactgtttcttcattgcatcaagaatttcagttcgcgcgtcctcttgagacatctccgccactctttcaagttcagcctggcgttggtcaatcaattctgttacttgttgttgatctttttgaatctgctcttcttgcttgcctaacttattttctcgcgcgctcagaacattttcgcgtttttcaagggcattatctttgcgatcaagtgtcgtttcacgttgtaataatcggtcttcttgcttttgaacttccgcacgtcgaccctttagctcttcttcaacgctttcacgatactgatgactttcttctttggcttctaaaacagcctctttttttgcggtctcagcttcctttttcgcatcagagataattccttcggcactattgtgggcctgatcaagttggcgttcataagacgttttcttggccatgtatcccacaatgactccgacaacaatagcgatcgcggcgagaattatgcttagtgcattcattttttcacctccgcatcaactattaaattgctgttggtcaaataatctatttaatttaacgtgttaattgattatttacactgtgttaattctaatattgcacggtaaacatgtcaactaattgtcaagtttatgcgtacaaaaaagatggcatttcaaatgcatgccatcttttcaaaattaattactcttgagaatcatctaaatttaattcactgggatcagtattctctgtatcaacactatcgtcagcttccattccatacgcaactcgaactttgtgcataagctcttccatcttgtcgggatgatcagctaagtattgtttggcattttctcgtccctgtccaatccggtcatcaccatatgaataccaggcaccactcttattaaccaagtctttctcaacggccatatcaagtaattcaccagttttggaaattccttgcccgtacatgatatcaagttcagcacgccggaacggtggcgcaaccttattcttgacgactttaatctttgtccggttaccaatcacattggtcccatccttaatctgttcagcacgtcgaatttccaaccgaattgttgagtagaatttaagggcccgtccaccaggtgttgtttcgggattaccaaacatgacaccgactttttcacggatttggttaataaaaatagcaattgtcttcgttttattaattgagccagacaacttccgtaaggcttgtgacatcaaacgggcttgcaatccaacatgcgcatcacccatttcgccttcaatttcagcgcggggcactaaggccgccactgaatcgattaccacgatgtcaaccgcaccactggaaatcaaggcatcagcaatttccaatccctcttcaccagtatccggttgcgataatagcagcgcgtcgatattaacccctagcgcttccgcatactgtggatcaagcgcattttcggcatcgatataggccgcggtgccaccttgtttctgaacttcagcaacggcatgaagtgcaaccgttgttttaccagaactttcaggaccatacatttcaacgattcgtccccgtggataaccacccacgcccagtgcatcatcaagtgcaattgacccactagaaacagtagcaattttcatatcggcttgatcgcccattcgcatgattgatcccttaccgaagtttttttcaatttttcttagggcagcatctaaggctgcctgtcttgcatcagccaattgtgttcctccttaaaatggaaactcattcttaattaataatatcagttctatcccaaaaagcaagcaaaaaaacgaacaaaagttcgctttattttagtcgtcgatacaattcataaaacatctgccaaacacttttttctcgcactgtttgtcgatcagcgttggagacgtgcagttcgaatgcttgtgttgcttgtccggtttgagcaatcgccatccacactgttcctggcaattgaccttctagtgaatccggacctgctactcctgtaaatgacaccccaatgtccgctttcataagcgcacggcttttttccgccatttgtcgcgcaactggttcgctcactaccccatattgtgcaatgacgtgatgctcaatccccagcagttgttccttaacctcatcggcatatgtcacaaaacccccatgaaatacacttgaggcaccactgatattacataacgttgactgaaacaagccggctgtcaaactttcagcagctgtaatcattagatgctgctgctttaaccgggtcacaacctgctggacgatagattgttcagctcggttacccaagtaatactcactaagtgtggtttgaattttgttttccagttttgtaagctgcgctacaattgctggactatccgtcgatgcagtcagccgtaccttaatggcatggtcctgagcatatgatgcaattgaaagccgtgtatcaggcactaccattgccgtaattcggttcatcaactccgactcagaaattccataaaaaaacatatcgtgattaaccaaatgctgatcaagcgcatacttctttattagtagtggccggagggactgttcgaacatggccgtcatttcatgaggcggtcctggtaaaataaccaccgccgcttcaggcgacgcttggtaaaaatcaccgattgccaagccattgatgtttgcaagaatttctcctccctgaagatactcagcttgtttttcattaccagctaccatccgtttttgccgcgcttgaaaatatgttgtaattcgttgcatctgagctggatcaattactaacttcgttccgagtgcctgagcaacagcctgcttcgtttgatcatccgccgtcggccccacaccaccgcaaacaatcacgagttcgtttcggtgaaccgccgtattaaccgctgcttcaattcggggcatgtagtcgcctatcgtcgtttgataatgggactcaataccaagctgcgcaagttgttgcgctaagtaggtagcattggtattttgaatttgtccgagtaaaatctccgttccgaccgtaataatttccgcctgcattttcatcctcctacatactaagtacgcatttactattcattttaacgcttaaaaataaaaaaagttgaaagtatattcgactttcaacttaactatggtttattttaatccgtcagaaaatactgatcgacctttaacaaaataatcaattcctgaatataccgtaaagaacaagcatacatacagcataatttgcccgaacggaacatggatcaattcaaagaaaacattattcaacaataagaagatgatcgcaataaattgactcaccgttttaatcttaccgggcattttggctgccattacttcaccgttagtttcaacaattaataaccgcaatccagtaacggccaactcacgccaaataataataacggaaacccaagctggcacaacatgcatcgatgttagaacgataaatgcggtcattaccagaattttgtccgccaacggatcggcaaacttaccaaaattggtaactaaatgattcttacgtgcaataataccatccaaattatcagtaatgcaggctgccacaaaaatgatcgccgcaatcagttgggtaacaggaattgttacaccaccaaacgcaacggccccccaatgcagtggcaagaccagtagtaacagaaagaatggtacaatcactaaccttaaagcagtcagtttatttggtaaattcacgaaaaaagccccctaaaaatttttaacactagttggacgaagcactagatgatgatgccgtcgatgatccatttaagtttaaagttaccttacgtacatttggatactgaccattctttgtcacatcaatcttcttgccgttcaatgtaattgttgtatactttgcatttcctaatgaaatgacaactttttttgcggaacccgcaacattgacagtctgcgcactattagcagttaatgtctgactaaattgactcgtgccatccgttgtcaccgaaatccatgaccgttgcgttggatcaagtttcaactttaacttacctgattgactggcagtcgtcacatcgaacactgcagcactagaactttgtgttgtcgcagtgaccttgagtttactgctcttcttagtcgttgttttagaagaagacgatgcactagtcttcttactactgctcttttgacttgattcacctgaaacggatactgaactactgtcgatatcgttattattagagctcgatttatgaccgtgcagagccgtcatccaaatagcacctaaaataacaataataatcacagcaattacaactgttggcaaatactgacggacccgatccagtgaatcaacgctctttttctgtccagcccgtgtttcgatcgcctgtgacatgtgttcagaatattcgctggacttactctgaggcaataaatcattatattccttcagtaactcatcgccgttcagtccaaccgtatcagcgtactgcttaataaacgcccgcacataaaaatccccaggtagttcatcaaacttttcatcttcaatcgcaattaaataccgtctctggatcttggttgcctgttgcaaatcatcaagcgtgtaacccattgaaacccgtgcatcgcgcaattttttccctatttcaactcgtgtattttcttctgacatgaacactttttctccaatacttttgatcttgtgtacgacgtcgatagtatagcatatttcagcgctaaattacttaaactttacttaattcgaatgtcgtggaacaatctgataaacagaaatgccctgcgactggataaactcacgagcaatgacgtataaatcttcaatcgtaattgattccagtactgtaatttcatccaataaattagtggccccaaatagtttgccagcataccggttcgcaattgcttctggtgaatccaacaacgcaatcatgcgtcccaatacagcacgtttaatattattaaactgagacgcggccgcttcaatttgttgctgagcactctctaaaattccaataatttcatcagcaaatcgttcaatgtggtcagtatcactactaaagtaggcaaagtggaatccccgctgcatttcaaaattatagctaaatgaatcatcaataatgccgttattatacaatctcaggtaattatcaaccgtatcatcaaacaaaatatccagcaataattcaacaccgaggcggtacttaagccccgcttgaccagccgaaattggttctaatccccggacacccaccattaccttcggccgggtcacatccatttctaacgtccggaatggaataacgtcctgaccagtttcgtcgtttagttcaaattgaacctctggtatcgtcacttgattaaaatgtttctgcttctgattatcagcaatccactccatggtctcagcaggatcaacatttccaacaataaaaaggttcatgttggctggttgataaaagctatcataggtcgaatatagtgtgtccgcagtaatttggtcaattgattccaccgttcccgcaatatcaatgtgcattggatcgtgtggataaagatttcccagcattccaaagtagaggcgccaattaggatcatcatcgtacatcttaatttcttgtccgataatccccttttctttttgaaccgtttgtgatgaaaaatagggttgctccacaaaatccagcagcacatccaagctttcatgcacgtgctgggtcgttgaaaataaatagctcgtttgggtaaagctggtgaaagcatttgagtcagctcccaattcaccgaacaaatcaaaagcgtcgtgatcaattttttcaaacattttgtgttcaagaaaatgagcgacaccgtcgggaacagtgattagctcctgcccattcacgggtgtaaacgtccgatcgattgagccaaaatcaacggttaaaatcgcatatgttttatggaaattacgtttaggtaatacctgcactagcagaccattatctaatttttgatcataaattgtttcatcatactttgcataatgatgctcgttcatttcgttaaatctccatttaaatagtaaattgcctgtaactcaagcagtgatgccacatgcatcacttgagttgccgtaacgtcctcaattttttgaacaacatcgtcagctgggcgatctaataacgctgaaattagttggcgctcagcaatattgcccgcaacatccaagctggcttgaaattgattgatcaggctatctttcacttctctaagtaattccgcagtgaattctcccgctttaacagcttcaacctgttgtccaatcaacacccgggcacgctcataattagtattttgaataccggtctgaattgataacatgccactgaaactatggtaccgacttgacgcatagtacgctaagctttctttttcacgcacatttacaaataattttgatagcggcgtgccacccaaaatcccattcataacaactgctgcatagtaatctggctcgttaaaataaactggcaactgataagctaaattcaacttggactggttgattgcctgaatttcatccttttgagtcacgtccggtcgtgcgtcttgatgatacatcatatcatgatccgccactggtcgcggtgtgaagttgaactccttaaaccgatccacaacatggcgctcatctacatcccctaaaactacaatattaatgcgatctgaggtaatcatttggcgatagactggcactaaattttcagcattcaattgatccaaatcagctaaacggccgaagcttggaatctgcattatcgaatcatcatcaaagtataattttcgaagctgagtttcagcatagtactgtttatcatcatcaagcgactgaatcgcgcttcttaaattagctcgctgaagattaaacgtgggttcatcgaacgattcattatcaatcaatggattaaatagcatctcatgaattaaatcaatgacgttatccagtaacccatcgtatgaatagcgatcattaataaatcgtgccttcaatcgaacggaatgcaacgttcctatacgtccaactccagttccaacgtcggcaccgtacaattgtgataattgtcgggcaagcgccgtttgcgtgggatacttatgcgtgctggtttctagtaagtctcccagtaaacttctcgccgtcgtatttgcagatgtttgtggggtcccaaaattcaccacgatttgattactcttaaactgtgacgttttaataatgtgtagttcaacaccatctgttagttgaaaatacaaagcaaatcctccatctacccttaaagtcatttatgctatcccgtctgtgggaacggatgttacaccaccgaaaactcataatataagtccccagtggctatttgaaccgaagtatcacatgttaaataatgatacgttaaatcaataaaaaatacaaacctaatttaaaaaatgaaagtttgattaaaaaaatagcctgttctgaattgtaactacgtcggggttttgctatcatgttagttaacaaaaaggagagaataattgtgaaggttatcaaattcggtggcagctcattagcaagtagccaacagttaagaaaagtgattgaaatcgttgaagacgatcccactcgtcggtgtgttgtagtatcagcgcctggtaaacgtaatccggctgataccaaggtcaccgacctcttgattcgctatgccgatcaagtgatcgcgggaagtgactatactaacgttcaacaagaaattattgcacgttatcaagaaattgcactgggttttaatctaacccccgaggaatttgcgccaattaaacgggccattttaaacctcccacttaaaaagtatcagaataatacatatctaatggccgcattcaaagcacacggtgaacgattaaatgcccagctaattgcccgggttttcaatatcgtgggaattgccgcccagtatttagatcctaaggatgctggaatggtggtcacagatgtgcctgatgatgcgcaaattttgcaggaaagctatgccaacatgcgtaaatggcaaaataatgcgcaggtactggttgtgccaggattctttgcctacaacgccaacggtgaaatttgcaccttctcgcgcggtggttcggacattactggtgccgtgatggcacggggcctcaacgccgacttatacgaaaactttaccgacgttgatgcaatctactcggttaacccgaatatcgttgcccacccacatgcgatcgctcatatgacgtttcgagaaatgcgtgaactatcatacgccggcttttcagtatttcatgatgaagctctcatccccgcaattcaaggcgatatcgccgttaatgtgcgaaacacaaatcatcctcaggcaccgggaaccatcatttcagcccgcattaaaccaaataaagactacccagtccggggaattacagcatcgaaacgtttttgtggtctttacatcagtaaatacttgctgaacaaagaggttggtttcactcgcaaagtgcttgatgtcctctataaattcaatatcagttatgagcacatgccttccggaattgatgatattaccattatcatgtcggaagataacctgacacccgagttggaacaatcattaatggccgaaatgcaaactgccattcaaccggatgagatgcacatgatccatgattacgcaatcgtgatggtcgttggtgaaggcatgcatgatacaattggcatcatggcaaaggcaactaaggccctcgctcaagctggaattcgactccaaatgatcaaccaaggtgcctctgaaatttctattatgtttggagtggcgcaagatgaagcaaatcaagccgttgccgctttatacaacgaattctttcaacacgattaactaataatccagttcgacatcaaaaggacgcctcggtgaggcgtcctttttttgatctcataaaattggtgcaagtaaccgcgatagtgtttgcttaattttaaccagatgggtttgctgttgaaaatactccgatgtcaaaaagcgtgatttttgctgatcatgtaaaaaaatcaattcggtcgcatgtgcaaattcacgatcatacaaaaacgcattcgcctcaaagttcaacttaaacgagcgaatatccatattagcagatcctattgaaaccatcttgccgtcaatgaccaccatcttagaatgcataaatccattttcatacgtgtacacttttccaccggcattcatcaactctcgcgaataatactcggttgcccgataaacaaacgggtgatccggccgatcaggaataatgagccgcacatcaattccggccgtcgccgcaattgacaaagcttctaagacgctgacatctggtacaaaatagggagattcgatataaattgactttgtcgcaatcgaaatcatcttcacgtatccctgcttaattttctcccggtcatcgtctgggccactagagacaatttgcatactcgtcgatccattcgaattcgtacgaggaaaatagcgctgatcaaatttaacatggtcacgtttagtagtcgcattccaatctaaaaagaatctactttggatagacaacactgcgtcaccaaccactctcaaatgcgtatcacgccaatatccaaaccgttccttgcgactcaaatactgatcaccgacgttaaacccaccgatataacccgttttaccatcaataatgaccaattttcggtgatcccgaaaattaagccgcagtgtaaacggcaaaaatttagaagttaaaaacggctccacttgaccgcccagctctaccaaatgcttaaacagcttctgttttgaaccatgggatcctaaagtatcgtaaattactcgtacatgaaccccatgacgggccttcttttctagaattcgaacaaattcctgcccaattcgatcgttataccacgtaaaaaattcgatattaatatgatgtttcgcccgccgaacatcttcaaaaatactctcaaatagcttttcaccatccgtataaatccgaaccgcattccgtttcgttaaaacggcattgtcagtctccaggaacaaccgaaccaactcacgggccgaattagtcacctgatttgctggtaacagttcattatcgtcatcctttaatttttgattagcaacgatctgatcaattcccaagggttcttgtgctttcaaatcaaagatgcggcgatgtgagagcttgcgtcccgcaaatagatacaacaaaaagcctagtactggtaatgctaacaataccagtaaccaggcccatgtggcggaaatatcgcgtttttctcgaaacacaataacaaaggatgtaatcgtgttaataatgaccacaaaatcaattaaaatccacaaatcaagcatcttagttgccgcccccatcaattaatagattcagcataacaatagttgcctagtttgtcacggttttatggcttgccaagataattacttgcctcaccaaaccacttttcattaatctgctttagctgcccattcttttgcattttgccaagagcagtgtcaatcttctttttcagtgttacatcacccttacgcattccgaccgcaaagtcttcggctggaatctgtttgctgatgtacgtggaataagcggaactatcactttgatgtttaatatagtactgagcatataccttatccatcaagatcccctggattcggttagcatttaaatcaataaacgcttcggggaatgtatcatacagcactgctttatgccccttaatataatccttcaacattttcggatttttatcaagcacatcggtccccgttgatccattttggacccccagtgtcttacccttcatatcggcaaaattagtgatatgactctgctttttagtaactaaaatttgttgattttgtgcatagggacgactaaacaacaccgtctttttccgtgcatccgtaatcgtgtagccgttccaaatcaaatcaatggtcccattatttaattcagtttctttcatcgaccagtcaatggtttgaaaatcaaccttaataccatactgtttaaatacggcccgggccaagtcaatatcatatcccacaagtttaccatttttttgccggaatcccattggcacaaaactatcatccagaccaactgtgaccttacctcgtcgttcaatcttgctccacgtatccgttgtgtgggcacgcttcgtaacactttcacaaccagaaagtagtaccgttggcacgaggatcacaattaagagaagccatgtttgccattttttgatcattttctctcctcctaattgtgtttacttttggttcaacttatccagcgaactaacctctaagatatcatccgcaatatttttagcaaattccatatcatgcgtcacaacaagctgtgtcatgccatcttgttttaatcctaagattaatttttcaacttcccgacgtaaatttggatcaagcgccgaggttggttcatcgtagcacagaatcttcggatgcattgccaacgcccgtgcaatcgcgacacgttgtttttgtccaccagacaattggaagggatagagatcgccttttcccttgagtccgagttcagccagcaaattctcagcttccgccttggcttcattcttgtccttttttaaaaccatagttggtgccaacgtaatgttatcaaatacagataagtgcggaaaaagattaaaatcttgaaacacaacaccgataacactgtctgacgtatccgttccttgtgggttgaatgcttgaccatcaattaaaaattctcctgaatctgccttttctaatccagtaatgcatcgtagcaaggttgtttttccagcccctgaaggcccaacaatactcaaaacttcgcgatccttaaccgtcacgttcatgttgtccaagattactcggccgctgaaactcttttttaaattcttaatctctaacatattcggatcctccgtttatttatagtatgaatatcgttgttcgaccttgtgtaatagatacgtgcagattccgaccaaaatcagataaattattccgactagtagtagtggaaccaacgtcacatcacgagaagtagccacattaccagctcgtaacaggtcacctaacccaatgacgtagaccaacgatgaatccttaacaaggttgataacttcatttcccactgatggcaacacaatcttaaccacttgaggaatcacaattttacgtatcgtttgccaatagcttaaccgtaatacgcgagcactttcgtactggccgttatcaattgactgtaacccaccacggaaaatttccgcgaagtaagcaccatagttcaaaataaatgcaaataccgccgcatcataacgctggaacacaacaccgataattggtaatccgtagaaaacaaaaatcaattggagcaatagtggtgtgccacgcatcaaccaaacataaaaatctaacacccaacgaattggtttaatattcgaagtcagtcctaaactgacgacaatccctaatggcaacgatccaattaatgtccagaaaaatagctgaagtgttaaactagcgccctgaaataatgagggtaaaatttcggatatataacttaatgacatgagttaacctcccagttaatgaattagtctaattaatagcaaacaaaaagcgtccttgagttattcactcaagaggacgcattatcgtggttccacctctgtttgtccctacttcacagcaaagacctcattgagtttattaataaaaaacgcccccacaaccactagggctgtgagggcgacatccgcggttccacctcaacgttgttaagttctcgcgaacttaaccttaataagtttattaacaaactcaacgtggtaacgggactccccggattctcctactaatttcagaaaatcaactcacagatgtgattccaatagcaaccgtgctttcttctcagcatcgaaaactctctttaaccgtctgactatcgtactattctgttcaccgtttttttattatcgggtactatcgtaatacagcataaattaattgtcaatcactaatattaaaatttcatgagcgtggctcaacattgtagtgggcatatagcaatgaaatggggaaatataacacaacgaagtacactaaattcagtgccaacgttggtgctagtgtgtacaacagaaaactgctgaaactggcatgtgcaattccaataatcatataagccaaataattcgcaaattcaaaaaccgctaaatcaataaaataaatcataatcgcggttaaaaacgtaggtgagaaatatttgccaattgcccgagtcaatccaatgattaatggaaataaaaccatgaacagacccaaaataccggaatagtataaatcaaacgcaattcccgtcaccacagcaaatccagtcagtggaatttgaacctcattttcaaagaaatatcccagtaccagccataacagcaccaaatgactgaccatcgaatatgggtagctaaaaaacgcaccactaaacacgttgctcaatgccccatccaagaaaaaggtgatcaataaaccaattggaaaaacatatttcaattttgataatctatacattcaaattacctctatgaatcaagttcagcaaccgtcacaatattaatattgttaaagttggtggctggtttaatataaatctttttagctaagccgtagtcatcttcactaaccttagcgacctttccaacgtaaagtcccttcggcgttacaccgcccattccgctagtaatgactttggtgcccttagtaaccttcacttttgaagtcacatgacccatcaagagtaatccagttgatttttgatacccggtaataataccattcaccgttttaccactcttatttgaaatctgaattgcaaaccggtttgaagcctcattactgtcactcaacaattcaactttactattggtcttattaacttcggagattcggccaactaaaccagagccagataacactggcatgttcttagtcacaccagatgtttcccctttattgataatcagttggttttgccaagatgatggcgtccgtgtcataaccgaagctgtcactgttgtgtaatcagttaatgaatggttcagctttaattctttcttcaactgcttattttcttcagttaaagtctggttacgtaccttaacttgagcgagttccgttacctgtttctttaataatctgttttcttgataagcattcgtcaattccgacaaagaattgactcctgattgaaaggcgttcactggataagcgacaaccgtgctggtaaacccaacaatatcgttaccaaactgttgaatcaatggcggtgtagaccgtcgattccgcaacgcgacggaaccacccatcagtccaaaacacagtaccaagattacaacaatcatcactaaacgctgattcgaaaaaaacttgcgcattattatcctccaatgaaattgtggattaaatcaacggggttggacaaaacattagttttgtgaccaaccccgtccctgaaaactcatttaaatgtgagccttacggctaatatccacccggaattactttttcttcattacgtcgatactcttcaacgactcaccagtcccgattgcaacacaatccaatggttctgaagcaatgaatactggcactttggtttcgtcggcaatgacttctggcagatgcttcaataaagcaccaccacccgtaagcacgataccgtgatcaatcacatcagcggcgatttctggtgaagtctcctccaaagtttccttgatggcggtaataatttctgagacaacatcttgtaaggcagttgacacatcgacggccgaaacttcaacagtctttggtaacccagttaccaaatcccgtccccgaatttcagtactgcccatatcgtcagcttcatcaattgaagcagaacctgcatcccacttcaatttttcagcagttctttcaccgatcatcaaattcatgtgttggcgaacgtatgacatgatcgcttcgtccatcttgtcaccagccatacgaattgaacgactcgaaacaatcccaccaagtgaaattgtagcgacatcagttgtaccaccaccaatatcaacaaccatactaccggttggatccatcactggcagccccgcaccaattgcagcagcaaatggttcttcaatcacatacgcatcacgggcacccgcaacgcgagtagcatcaatgacagcacgcttttcaacttcggtaaccccactcgggacacaaaccatcacgtatggcttaccactgtttttaccaagcgctttttcgatatagtatttcatcattgcaaccgttgtatcatagtcggcaatgacaccgtctttcatcggtcgaattgcgacaatgcttgatggcgtacggccgatcatttcacgcgcagcttccccaaccgagatgacctctccagttttcgtatttttggcaacaactgacggttcgcgtaaaacaattcccttaccatcaatgtacacaatcgtattggcagttcctaaatcgatgccaatgtttttagttccgattccaagcacgttgtttcttcccttcatcatttcaatctgttaaattctcacaataatattagtattataacatagtgtcaccacgctgcgatatacctttcttacacacaatacagcaaatgaaactttttcaaaatgattgtcacgtaacttaatgaattatttacatttaatccattaattgtgcttctcgcatgctcaaataatcgttctgcccaatcacaaaactatccagtaatgtaacccccaacagctggccgcactgattcagccgtttggtaaacgcaatatcattttcagagggttccgtcacaccgctgggatgattgtgcgccacgacaattgattccgcatgacagtcaatggcaatcgaaaagatctcccgtggatgcacgggacaagttgttagggttccacgaaaaaccacctgttgacgcaagatacgatgtttcacatccaaacaaattaaacataaattttcttgaaaatcgtcctgaaattcatcaatcagaatctgcccaatttgacgactagaaaaaatttttcccagcactggtcgggaactacgggcaactcgccggccgagttcaattccaatcagcatcaactgtaattcttcaacacccgaattaactagatctagacgctgctgttgactagcccctttgaattcactcaatgatggaaaagccgttcgaaattgatgactaagttccagtgcctgttttggatttaatttttgaaaaaaagatgtgattagttcctgatcactcaatgcggtgcctacttgctcattattattcatcgtttatcctcccatacacaattaaaatacgggaaaaacgaagttaatccttaaaataatgtcgtacatccgaaataaaatacaacgatcccgtaataatcaggacatcatccccggataactggtgcgctaattgcgtcaccccatcttgccaagtcggtgccgtttgaatttgccgtttatctggccgatcagcaattaattgttcaatcgatgcaccaggtcgttgttttttgggaccggcaaatgttgtcaataccagatgaatccttggtattgcacgaagctcatcgatcatttcatgcgtctgcttatcggccaacatcgctaccaataaatagacatccctttggctaaagttgtgctcaatagtggcccgtaacgccttcattgccggtaaattatgggcaccatctaaaataatagccggcgtttcgttgaccaattccatccgaccaggccagcgcgtcgtctttaccccccgtcgaatggcactccagtccactggaattgactgacggttccaaaatgcaatgacagtcgctacggcgacgcctgcattttggacctgataatcgccaaacaaactaatttgaagcttttctcggccaacctgcgcatcactaaatacgagctgggtcattagtccctgatgctcaagtaaggttacttgataatcgacctcgggttgaataagtgtggcatttttgtgttgagcatccgcagtgataacggttagtgcctcattgggcaattggccgatcacaaccggtacattaggcttgataataccggccttttgggtcgcaatctctgtcaaagtgttacccagaatattcatatgatcataacccactgttgtaatggctgacaccgcaggaacaatgatattggttgaatcatacaaaccaccaattcccacttcaacaatgaccacgtcgggatgaacatctcgaaagtataaaaacataattgcggtcacaatttcaaactcagttgggccgccttccggtaaaacttgatccaaatgatccacgaccgttttgacccgctgcgtatatgtcaccaagttttgatcatcgatcggctggttgtccaaactaatccgttcattaaatctggtaatgaatggtgacgtaaacgtgcccacatgattaccggccgccatcagtattgatcgtaaaaaggccacggtggagcccttcccattcgtaccagtaacatgaatcatggtcagtgtcttttgggggtcccccagttcctgcatcaatcggcgcattcttttcaatgtcggaatttttttaaattgtgtgcgcccgtgaataaattgcagcgcttgttcgtaattttgaatctccatatgtgctcttcaaatcctctcaattcagcaaaaggacggaaccgaaccctcaccagagaattttgttccgtcctttaacactgacgctactttatgcgttttgaatcgaatcaagtcgttcttgggtggcactcaatttctgttcccattcggcttgttttgcgcgttctgcagcaaccacttcttcaggagcattggccacaaagcgttcgtttccaagcttcttggttgagcgttgcacttcttgtttcaatttgtcaatttctttagccaacttagctttttcttcgtccaaatcaactaattcagccattggaatatagacctcggcgcccgtaataattcctgttaaggctaattttggtgccgtaatttccgttccaatcgtcaattcttgtggatgacagaaccgatcgatatattccttgttatcactaaacatggtcccgagcgcttcattatcaactttaatcaacatatccaccggcgttgccattggtgccccagcttcattgcggatatttcgtaccgccttaatgagttcgattaaatgtcccatttgttccgatgcactggcatcttctaattcagaatgagcaaccggatatggtgcggtcacgagtgattccccatcgtgcggcatacttaaccatagtttttcggtaacaaatggcatgattggatgcatcaatttcaaggtctgatcaagaacataagccaaaatattacgagtatcgctttgttgttgcgcgtcaccactattcagcttttccttcgacatttcgatataccagtcacagaaatcattccaaataaagttatatagcgcacgaccagcttcaccgaactcaaatttctcgaataagcgcgtaacttccttcaccgtattatttaattggttaaggatatagcgatccgccaaatcccacttactttgatctggtaactcaggtttttccatttcacccaagttcatgattacgtaacgacttgcgttccaaatcttattaatgaaattccaagccgcatccattttggtgtaactaaagcgcacatcttgtccaggtgttgaaccagtggccaggaaccaacgcaatgcatcagcaccatatttttgaatcacatccattgggtcaattccgttccctaatgacttgctcatcttccgaccctgctcatcacgaattaaaccatgaatcaatacattcttaaatggtcgccgtcccgtaaattcggtactttggaacatcatccgggcaacccagaagaagataatatcataaccagttactaaggtatccgttgggaaatagcgttgaaaatcagcactatccgtgtccggccaacccatcgttgaaaatggccatagtgcacttgagaaccaagtatcaagaacatcactatcctgttcccaattttcagcgtcttcaggggcttccatgccaacatagatttcaccagtttctttgtgataccacgctggaatttggtgtccccaccagagttgtcgtgaaataacccaatcatggatattttccatccaagacgtaaaggtattttcaaaacgtggcggcacaaagtcaactcgatcatcagaatcttggtttttaagtgatgcttctgccaacggcttcatcttcacaaaccactgggtcgacaaacgggcttcaacttgaaccccagtccgttccgaatgaccaaccgaatgcacgattggttcaatttttagcatgtacccttcttcttgtagatcatgaacaatggcttcacgtgcttcaaaccggtccataccttcgtatttaccagcattggcattcatggtggcgtcttcgttcatcgtgttaatacgcttcaaattatgccgattaccgactttaaagtcattaggatcatgagcaggggtaattttaaccattccggttccaaaatctggtgtaacgtattcgtcagcgataatttccgcttcacggttaactaacggcaccatgactttcttaccaactaacgccttgtagcgttcgtcacttgggtgcacagcaattgccacatccccaaacatcgtttcaggacgagtagtcgcgatttcaatatagtccttgccattgtatgtggtcccatcggtgaaaggatacttaacatggtaaaaggcacctttatcgtcttcatgaataacttcaatatcagacaacgcagtccgtgcctgtgggtcccagttaatgatatactcaccgcgataaatgagtcctttattatatagatcaacgaacaccttccgtacagccttatttaggccttcatcaagggtaaagcgttcccgatcgtagtccaatgataatccgagcttagcccattgctggtggataatatctgcatattcatccttccaatcccatacctgttgaacaaacttctcacgaccaagatcgtagcgcgaaattccttgatcacggagccgtgcttcaactttagcctgggtggcaatcccagcatgatccattccgggcaaccagagcgtatcaaatccttgcatccgcttttggcgaataatcatgtcttgcaaggtcgtatcccaagcatgtcctaaatggagttttccagtaacattcggtggcggaatcacgattgaatacttatgtgctttcttatcaccatttggtttaaatagtccttgatcaagccattcttggtaacgacctgattcaacggcttgtggatcatatttggtcgacatgtctgtttcttttgccatggaaccactccttttcgctgaatatttaatgtgcatcaatacaaaataaaaaacccatcctaattgaataggacgagtttctcgcggtaccacctaaattgggaattatccccacttaaatcacgttaacggatgttatccgggccactcaacactgctaagtgaccagctcgcaagctaccttcaatgcatgtcagccaaggatctttcactaacgtcctctctctggagactgccacacacctactctcttgttcgatgcttattgacgtatatcatagacaataattgaatgcgagtcaagcactcaaattaattttttcaatgcattaatggcggctaaatagttaggttcatcagtttgttcttcaacgatttgccgataaacaatttggccctgtgcgtttacaagaaaaatcgaccgtgcaaggacgccagcattggggctgagtagcttcatttcgtagccaaacgactcctcgctgtcagacatcatttccatcttttcgacatcttcagctgcgcaccatgctgcttgctctttgattgtattggttgaaacggtaataaaacgaacattcggatactgatccaccgttttattaaatttcttagtttgaatgctgcaaacccgggtattaatatctggtacaacactaattaatagcggttgaccaatcaactcccgcgttttcaccttctgatcttcggcattaaacaacttaaaatgtggtaaatcctgacccacttctggcggattaccgactaatgtttcaacttgaccctggcgtgttatttccacagtcacgcactccttcctaacgcttttgcccataaaatatctggggttgtaataaaactacaacactttgttaacctttgcaagccgttagactacgaattgataattgatcacttagagtaattcggcaaaggcatccgcttcctggttcaaaaactcttcccctgcgtgaacttcgacaattttaacgccgtcgagggcccgttgcatcaacccctcaacatctaaccgagattcatacacacgtgcccgttcaaggttgggctttgttttaggactaggtggcgcaaaaattgtacagcagtcttcaaaaggtaaaattgataattggtacgtatcaatatcttcggcaattttaataatttctgtcttatctagtgaaaccaccggccgtaaaatcggcagtgtggtaacatcattaatcgccaacatgctttccatcgtttgtgacgcaacttgtccgagggattccccattaaaaattgcgagaccatgccgttttaatgccaaggccgccgtcaatcgtaacatcatgcgccgttgaaccgtcatcaagtagccttcaggaaccttctccttaacagtttcttgaatctccgtaaatggtacctgtaagaatcgaatcgtaccactataccgggctaacttacccgtcaactcttgcgctttagctaacgcctgttcgcttgtgtatggtggactaaagaaatggaccatttccatggaaacgccccgtttcatccccaaataaccagcaacaggagaatcaatccccccagaaagcattagcatgcccttgccagaagttccgactggtaacccaccggctccttgaatcgtttgactagaaagaaaaataccattcgcccgaatttcaacacgcacaaccaaatctggctgatgaacatcgacacttagttcaggaaatgcctcaagtaaatattcaccaaggcgcgtattcatttcgttagtatcaatcggaaactgatgatctgatcttcgagtattcaccttaaaagttttcgtagttccgagttgttccttaaccatttgagccgccatttcggctgttgcttcaaacgttcgatccaccttgacggatggcgagaagttttggataccaaataccaacttcagccgggcaacaacttgatcgctatcagccccgtttaagctcacatggagtcggtcacgattggcttgaatcttaacctctggtaaatcatgtaataccttccgaacgtttgatcctaaacgatcaataaaagattttcgattctttcccttagtcgataactcaccgtaccgcaccataatttcactatattgcatagtagcctcccttctaattacataatcttcttaaattcttgataaagtgtatcaaacacaccgttaaattcagcagcttcttcaagcgtattctgatcaccaaggctcacccgaactgcgctagtagaaacagtttcgggcactcccattgccgtaagggtgcttgacgccaagtgtttttttgacgaacatgcactggtggtggaaatataaatgccatgctgctcaaaggcgtggacaatcgtttctccacgtaccccttcgattgcaaaacatagaatatggggggcaaacaaggcactatcctttgaaaagattgtgacgttttcaaactgttcgatatggtgtaaaatcgtttgtttgatttgccgttccactttaatactttgcgcttctttatctagcaagacccgcagtgctttagccattgccgcgatagcgggtaagttttcagtcccgcttcttaggtttcgttcttgcccaccaccagttaacagcggtgcaatctttcgaccttgttttttataaataaatcccatcccgcgtggtgcgtggaacttgtgaccagaaaacgtcacaaaatcgacccggccattaaaaatcagcgactgaattcccttgccaattccctgtacagcatcgatatggtagtgaacctttggataatccttcagtacctctgcaacttcttttagaggttgaatcgtcccaatttcattatttaccgccatgacggacaccagaatcgtgtcagaccggagcgccgctttgagatcctcgaccgagatacgcccattttcgtcaacaggtaagtatgtcacatcaaatcccagctgtgccagttgttccattgaattatgaattgctggatgctccacggcggtcgttatgaggtgtttgccaaacgaccgtttttcgatcgcggttcccttgaccacccagttatcaccctcagtaccgccactagtgaatagaatttcactaggaagtaccccaagtaaacttgcaatttgtgcccgcgattgctccaacaagtgccaagccgattcaccaaaattatgcaagcttgacgggttaccccaaatcttctcgctgacggtttggtacgtctgtagcacctcgggtagcacctgtgttgtggcactattatcaaaataaatcacaattatccctctttaatatggcatattccccacagatgagtggttcccatgcaagatagtgttgccagtgcggatagcggcactagcaacgagttcgactcaatttaaacagctccctattataacagacagggtactgtgtgaacagtatttgcattacaaaaaaggtggacaccaaagtgcccacctttttgaacagataaatcgcgatattacaacttgttgtagtattcaacgataagtgattcatcaatttctgcatccatatcttcacgttctggaatacgtaccaatgaaccttcaagcttgtcagcgtcgaattcaacgtatgaaggacgaccaacaacagcttcaacagcgttcttgatgattaccaagtcttttgacttttcacggacgccaattacttgaccaacagtaacttcgtatgaaggaatatccacacgcttaccatcgacagtaatgtgaccatggttaaccaattgacgagcttgacgacgagtagtagccaaacctaaacggtaaaccatgttatccaaacgacgttcgagcaaagccataaagttagtaccatgagtaccttctttaatcttgccggcacgaatgaacaagttggcaaattgacgttctgtcatgccgtatgtcatacggagcttttgcttttcttgtaattgcaaaccgtattctgacaatttgctacgacgatcgcgaccatggtcaccaggagcgtatggacgacgagccaattctttaccagtacctgaaagtgaaacgccaagacgacgtgataaacgccagcttggtcctgtataacgagacatatatagttcctccaaaaaattaatatggagtaaaataatccgattgtaagcttggtattcgtgcaggtcaatttgcaacgttcgcctttgcagcctcggttactagttgaaccaaatggcatctccctgttgacgagcttacccacttaccgctgcattattttacacaaagagtagtataacgcgttttatgaagctacgtcaaggtgcgccatcaaaacggtcgcgaattcttttaactcttgttcgtccttagctgaaaaacgatcatagttagttgagtcaatatcaagtacaccaattttctgaccagttgcagtaattagtggaacgacgatttcagcattggactcactatcacaggcgatatgtcctggaaagtcatgaacattagcaattcgttgcacctgccctgtttgaagtgccgtaccgcaaaccccacttccgtttttgatgtgcatgcacgcaactttcccctggaaaggtcccaagacaagctcatcatttgagtcgttatataaataaaagcccgcccaactgatcttatcccagctttgcatcaagagtgccgccgcatttgataaattagcgacgtcatttgattcattgaataacaaagcatccaattgttgtcccattagtgatgtcatcttaaaagctccttaattaccaaccgatttaacgtgttgccatgattggtctatgttataattttgaataagatgattttatatttaatgtagctaaattgcaattgtaaagtttggtacataagggtgggatttcgaaatgttgcaggttttaatcggtattgttgtcattgcgttagtggttgctggtggtctttatctttttcagcgacgggcaattaatcgtgtgaatgagcttcaggcacaaaaacaggcactagtggctaagcacatcgaaggaaaaattagtgatggtgaccagttgagtctcactggtgattcattagaacagtttgaaaaattaaaacacgattttgagcaggttcagcagcagctgttccccaaaatcgacgcactgatcgaagcgattcggagcgatgcacggggcatcaattttattctaacgaaccaaaagcttgctgaactcaccgacctcgttcagcaagcaactgatcagattcacactgatcaacaatcattgcaggaactccaaaagattgatcaaacacatcgtcacgctgtttctgaattagaaaaaaaatatcaacaaattcgtaaaaaactgctctctgaaaactttcgcttcggaaatagtattgatcagttagaggaccgcctttctaaattagaggacgcttttgatcaatttagccaactcacaattgagggtgatcactctaatgcacatgacgttttacttgaattacgcgcgcaaacttcagaacttgataaaatcatcgctgctgtaccagatctatatcaaaaactggatctcacatacccggagcaactaaaagaactcgcaaggggctatcaaaaattagcccagcaagactaccaatttgtggatgccgacattgcaatggaaatcgacaacattaacaagcaacgtaaagaaacgcttggtaaactggcgcagcttgaaattgatgccgttcaaaaggccaataccagcattgaacgccaagttgatcatctgtacgatgtcatgcaaaaggaaattgatgcccgccccgaagtcaccaaactcatgccggaaatttctaagtttattatccatgctcagaatcaaaaccatgaactgctgattgaacttgatcgcctcagccaaaactatacattggatcacgcggagcttgaaactacacggggattgggcgaacaaatcaaggccatcgagaaggattatcaagatgatatgagcgccattcataaacacaccgccatcgacagtcaaatcttggaacgtcaaaaagcggccaatgaaaaactggttcagattgaactgcaacagaccgaagtcaacgacagtgttgccgggttacaagaagacgaacaaaaagcgaaggaaaccttagcccactttgcaactgaaattcacgctatcaagcgacaggttgaactccttaatcttcccggtctccccaaagaatacctagactatttcttcgttgtcagtgatgaaatcaccaagttagatgaagatattaaccgaatcaagattaatatggaagaaatcaccaagcagctattaatcgttcaagctgatcttgaaactttgcaggaaaaaacagatgacattcgtgacagttctcaactcaccgaacggctattacaatatgcaaaccgattccgtgaaaaccatcctgacgtcgatgaagccgcacaaaaatcacagcagctatttgatcaagattttgactattccgcgagccttgagacaattgcgactgtcctcgataaagtcgaaccaggctcatacaaacggcttgaatcgagttattatgatagtatcgaacaaaataagtaattcttggttctccgctcacagtagtggagaactttttttacaaccaatctcgatatatcggcattaccgcatcaaccgttgcttcaatagccgctagctgttgattggcgtccaatgccattaattccgcctgtgaccatatccgtccgaccaaaaattcacttttaggatgttgttcaaattgcgttaacgtcaccgctaaatgctcggtgtcgttgaccacgtgatctgcggtagtgtgatcgttgctcaactgcaattggggccttctttgaatctccgactggctccgtacaacacggctgatcagtgtctcatcgttttgcttaccttcttgcaacacaactagccagacaaacaatgcgtgtggccacagtccaatttcgaggtgtgggtcctttttatatccccgtttttgtggtccaaatgcgatccatgtatcaactggtgggttaactgttcgtcgcatgtgtttggcaacgtgcggatacaacattacctgctgccgttcaaatattggttctaggcgtgtggccagggacaagaatttaggatcaataatggtcttaattttggtcattcgcccggccaacgtgtcatctttaaagacttcaaagtccgcatctgtaaacactgtaaaacaacccctttactcaatttaacttcgtataaatgttataatatcgtcagtgaaaaagaaaggactactaccaatgtctgcaaattctaaaattcctgaagacaagcatcttcaaagtgcactatatggcaccccgaaagttaatcctgacgagcaacgccgctacttaggaaccttccgggagcgtgtttgtctcactgtcagcatcgaagagctaacgcaagacgaatggacgcaaggctttgccaaggaaattgctactgaacaagctgaaattatcttcttcaatggcaatatcgatcaaagtaaattaagaccctatattctaacagccaccaaatcgggggttaattttacgattaaaactaatccagagtatcgtaccaatccggacaacctggccatcgtcgttgcttccaaaaaagccatctatgtccaaacggtagatatcgctaaaaagcaccaaccagatcaagctggcgatcaatcggcagcgcctaaaaaaaagtcattttggtctcgtctttttaaatcataagtcattcaaaggagtcttcacatgcaacaacctttagcctatagaatgcggcctaccaaacttgaagacatcgttggccaacagcatctcgttggtcctggaaaaatcatttcccggatggtgaccgctaaaatgttatcttccatgattctttacgggccaccaggaaccgggaaaaccagcattgccagtgccattgctggctcaaccaagtatgcctttcgcatgctaaacgccgccaccgactccaaaaaggaccttcaaatcgtggcggaagaagccaagatgagtggaaccgtaatcctacttctagatgaaattcaccgactcgataaaaccaaacaggattttttgttgccccatctcgaaagcggccgaattgtcctaattggtgccacaactgaaaatccatacatctcaattaatcccgccattcgtagtcgaacccaaatctttcaagtatatccccttaccgaagctgaaatgaccgctgccgtgcaacgagcactcaaagattccaaaaatggcttgggtaaattggatatcgatttaaaacccgaagcactgttacaacttgtccgagcaaccaacggcgatcttcgaagtgcgttgaatggtctagaattagccgcaaaatctacaccgcaaaacgaagccggtcagatcgtgctcacgctccccatcatcgaggaaagtgttcaacataaagctctttccgcagacaaggacggggatgcccattacgatgttatctccgctttccaaaaatcaattcgaggtagcgatgtagatgctgcacttcactacctcgcacgactcgtggaagctggtgatttaccgattattgcgcgccgactaatggtaattgcgtacgaagatatcggtttagctaatatgcccgccgccaaccgcgctgtcacagccgtcatggccgctgaaaaattaggtttcccagaggcccgtattccattggcagatgccgttatcgaattatgtctctcgccaaaatcagattctggcatttcggccgtggatgccgcaattgctcgcatcaaaaaaggtaactttggcgatgttcctgcccacctcaaggacgctcactacaaaggggccgagaagctcggacatggcgtcgactaccagttcccacataattttgaaaatgactgggtccaacaacaatatttaccagacaaaattaagcatgaccagtactaccggcccaaaacgaatggtcgatttgaagcggcactggccaaccaataccaacaattgcttaacgcgcaggggattaaaaagaaaaagtagttaaattgattgcgctatcataaacaacatgctaacatgtatatagaaactctaaagtgtacgcgttgttcatactacagttttgccttacagtcttacgacatcgggactagtgttcgttatatggataacatgccttatcgcttggtagttagagatataacaaccgtgacccacctgtttttaacacaggtcaacactgacgaacgattaacggcaccgttgagtttcttttaatagaatattagcttaagttacgacttaattgtcgtaacttatttttttgcactcaaaaagcgtatctgtatacgcagatacgcccttaatgtctaattatttacgattttttacattcttgacaaagtggttgtccaagtccgtccgaacaactaacacgtcacaaactgcagttctagtaacatactctgtaatcgaaccaattaatagtcgttctactgcgtttaacccagtagcaccgatcatgattaaatcagctttcatttccttaggtacgtcatgagcaataattgtctttggtgcaccatattcgatcgtgtagctgacattcgtcacaccttcggccttggcatcatcaatgtacttatccagcgttttcttggccgtctccgtaacttgttcaaccattgaggtatcaaaactagagatattttgaaatgcccgggtatccacaacatggagtaaccgtaattctgtttcagaaccgttacgcttagccaccgcaatggcctttttaaaagctaactccgcttccttggatccatcaactggaacgaggatatgttgatattgttgtaacataaatattacccccctactttgtttgtatcttcattttacgttatttatgaacaaaacacaaagcaaatccctaataaaggcaacattgttttcgctttcatcacttatgatttaaaaaccatacaaaagtgaacgaaagaaacgtcccagaaaaacaaccgacactcaagattgccacggtgaagcccgtcgaacccacaaatgcggccgtgagtgccaacgcaccaaccaccaacatttcaattccccaaatcaataccgcccactgaaatttaacgctttttcgcggatcaaaaatcaaaaatggtttgtgcctgtgggtaaccaggtagtacccaatataaagtgcaattattgcaaataaagtcgttaaagcttgaattgccattcatttttcctcttgttcttatgagtttcacttaacagctgtcaattataacaaatttttcccagcaacaaaactctcacactcatgatagtttgagctgttgttgtcgaataacacttagcagcttgggatgttgacatacaattcctaagctttcagcgattcgaagcgtttgttgtccggcagttacatcccccatggttaattgagtcaccgccaattgataaaaagcctgatcgatgccaaatagcgtttcaaagtgccgacaaagtgctaccgctttttttccgtgttgcagactcaccgccaattgatccaattgccgattcagctgagtcaatttcaaatttaacgcaattaactgccgtgcggttgcccctactaattgtcccgcagtcatctttgttgctttttgggctagctgttccgcggttgacgtatccccattttttaaatatgcgatgccggccgcaaccgttgccattacttgatagatatcagtttcgttggcagcgaactgctttaaagcgagattaaaattaaatagcgcctctgtcggatcactttgttgcatgagttgaagcattcccaaaaagtaatagtaacgttgcttatcgtgaccggtccgcaactgtttaattcgaattgtgttcaataagttagccgtgagttgtgcgtcatccgccaaaacggcattatcgatccgctcaaaaatgtcggtcaaaccattattagtggtttccaacacatccgcaacgtcaacgccgagccgctcacagatttgaaataagatgggcatgcttggcaattgattattcttttcaattaagctgaccgttgcttgcgtacagattccctgggccaactcggtttgtgataatccgagttttttccgtaataacctaacttgctcgccgcgaattttcaagttttatcgcctcgcctcttaaatgatttgccacaaaaaattctccgcctgatacatgatgccattggtaacgtgcgccaagtgggttttaaccagactagtatcatcggtaataattccatcaacccccgcggccaccatccttttagcggctaccggccgatccaccgtccaagcgtaaactttaacatgatgatcatgcaaataattcacgtacgcccgattaacggcacggtagtcaatcgagtaaaaatcaaccccggtcgtttttaaacggctaataataaatggtcgaatcagtcccagttgttggtgctttacatgctgtccgagctcttcaataattgaatcatccacagaatgtacggcgaactgatctgtctgccatgcgtgtcgataacgccgcacaaactcccgggccgattgacgagaatcgacccccgcttgcggcttaatctcaacaatcagttttacatgcagatgccgtgcagcttttaaataggcatcaaacgacgtcaattttgtttcttgtccatgttccctaacgtgcacctgcattagccgagacaatcggtgatcttttactaggatattacggtgcgccagatgtgctaagttggggtcatgcagacaaacaaatcggtgatccttagtctcttgaatatccatttccattcgctttgcgcggttgcttgttttttttaaactttgcagtgtattctgcaccccattatgaccatcaactccccgatgagcgatcaaaggaatcgtcgacgaacgtgggaagctaggctgaacgaccatccagcaaatggtacatcctaaacaaatcgccgccagacttccggtaaaacagggtttaagagtacctacctgatcaatccttaaatagcggactaacagccaactggtcgtatttgccgcaaacagtgttccagcagcaactaagatcaccgcaccactacgattattgagaaaaattcctccagttgcaattaaccccaagcctagactttccatcagccagatactaaatgaacgccgacgagaaagactggcgcgtgccaatttagtcggctgaagccagtgcaaggtcaccggttggacactccaccaacttcctagtagaaccagatacgttaatactgcaattatacctagcaataagcgatgcagataaataaactgcaatcccatatcaggaactggcagggccatcaataaatagctcgtaagccctaaaccgcccaatggtaagatcaatatccaattgatgataattaacacgatcaattttacaaccgattgtcgtgttcgtaattccagccgccgtgctaaccaccacgtgaccaccccaagacagcctccgagccagagccatttaactaacagacttaaatcggtcgtccaaagccagttgtttgtcataatggcgagccataaaattaccgttaattcatgccttttcactaaaatcacccgttgtatcaaaaaggcacctgccttatctagcacgtgccttttgcattagttggtttgattatacttcttttcaccaacatgttcagtacctaattcttcaaaatcatatttaatttgctgattacgcttgtactcggcaaatccatactgaataatttcgtcaatcaaatccgagtaactgatgcctgaaacttcccacatctgcggatataaactaatgttggtaaagcctggtaatgtattgggttcgctcagatatggtacaccatcctgatcaactaaaaagtcaattcgtgatagtcccttcattccgagcgcaacgtaggctcgtaacgccatatcagtaatttctttggttaattcatccgataggacaaccggtaattcaaacaccacaccgctcgcatcaacaaacttattttgatagtcgtaaaatgcatccgattcgggtacccgtacggccccgagcttcgatgcccgtggtgcttcgttccctaaaattgagatttcaatttcttgtggtttcacaaccgcctgctcaactaaaatcttaaaatcatagttaaaggcatctgctagccctgattcatatgaagccgcatccgttgccttatgaataccaactgaagaaccttggttagctggtttaatgaagacggtgtcgcccaattccgcactaatcttagcccacgtcatctcgtccttgttttcaggcgtgactaggagatacttcgtgttgcgaacccccgcctgattgaggatgcgtttcgtcatatccttatcaaacgatgctgcagacgctaaaattcctgatccgatatatggctttttaagtagcttgaaaagtccttgaaccgtgccatcttcacccaagttaccatgaatgactgggtaaaaaatatcaacatcctgaatttctcccaaggccatgattggtgccaatgggttgctcatgtcaatctttggatattcatcggcaaccacttggtcctcatcttcaccattaaaaattcgttgtgatgcttgatgacctaacaaaataccatctttggtaaacatgaatagactaacatcatatttcgtcttatccatggcgtcataaatattatgtgctgaacgctttgacacatcgtgttcagaagagttgcctccaaacagcaatgcaacatgaatcttcttttcttgcattttatctcacacctattctccgatttatagaaccctaagtatagcatgtcagtaagatgtttgaaaatgctttacttagaaaattcattattttctaatttataaaattctggccaccagcgatgtacttaataatttcatcatcaaacccaccactaattaggatcgcttgcatcagccgcatatgattaaatacgacagtccactgtccttccgtttgaggctgataatcgctcatgatttgagatcgccaagcttttagttgcaacagaaaataactgctataaagatggttcttcttggttaatcgtgataaatacgccgttaatcgctgagattcaccaaaaattaatggcgtttcaagccgcttatatcgttcaatcaagaccgtcatcaaaaaaatcttatctgagcgcgcaagatcgtctcgttgtgataactcgtcgagtacgttaccaatgtgggtatacgcatgggcccagccattacgcttgacaaagccacgggtatccgtttctagcacaatataaacagccatttgatcgactaaccggtttaacatctcactattcaggaaaaaatagcccgctcgatcaccgtacaaaagtgtcgagagtaataaaacagcaaaagagcgttgaaaaataccattatttttccgctcttcaatatgatcaaacataatctcatccgatagtaaataattaaacgtctgggtcatttgatccttggtcagaatttgatcctctaacaagtcgttgaacaagaagtaaaccccttgatcccggaccgctgaattagtggatccaatatgacttagcaattcaaacaactgttggtttgtaattgcggtcaattcatttttattcagttgttcgcgtaactcctgcagtaactctaaaacgtcactttcatctgctggttgctcaattttcgttgaacgctggcgtttcacggggtcgatgatcttaccaacttcatcgcctagtgactggaagatctccccttgattcaccttagagcgtaactctgaaagttgctgtcttaattgttgaatttgcgtcattcggattccttccttactctattaattaatagctcaatcttatcacaaccggatacaattgaggatcgaaagaatctcgttttaccaaattaatctcgccgtaatttcattttgctactaaagaaaaatgacaacaacagcatcacaaccagccagactaacacgaagagactaatgttaagtggattcatcatccccgttttgtctgaataaccgataatagctttcaatacattagcgaccgcttcttgattcttcagcattgctttgaccagttgcacgaggagaatgagccccacaatcggaacaccaatgattacagttgcttttccacgcttgctaagaagcgcaaggccgtatccaaccgccaacgctgtggcaaataagctcaacatattcatgaaatcaaaggccaacgcagcgccccattctgctcccttaggcgtgccgaataagccagcatataataaagacccatgatccaccaacgcatcaattccttgaacaatgactatgggcaaagacagtaacaaaattcccttcacgcgtgccaaccaagcagttcttcgcgatattccattttggatggtcaatttaaaattattgtaattgaagaacaaacagtccgcaatggtgtagaagatggcgaccgccagcaactcactgacaaaattactccacgtcattccagacagattactgctgacaatgagcgagatgagcgttggcacaatcacgacaatggcaaaaaaccagatataggtagtccctaaatgaaacagtgaatttttaaaattataaatggctaatcgattactcttagtgttcattttgctgatgcctcccgttcgtcaggtatacaaatagtttttgtaagtctaaatgttcaatcgttactgaatctggaataattcttgtatcatcgagggtaccaaatacatagttggttgtaatttggccaagactctcttccccaaccacattgagtccttcagtgtaggctaacacagccggccgtggcccagtgatcgcatacgatcgagcgataagttcctcgacgtcttcatctgccaaaagttggccgtcgtcgatcatgaaaacatgttccactaaattagcaatttcttcgatcaaatgtgtcgaaatcacaaatgtacgtggccgtttttcatatgctgccaataattcttgataaaatagctcccgatgatttgcatctaatccgagtaccggttcgtccaagaaaatataatctgcaggaacacacaacgcaataatgagtttaacaatggaatggtatccagttgataaccggccaaatcgttcctctaagttaacctgaaacttacccgctaattcatgcgcaagtggccaatcaaattgaccatagctcatctgtaccaagtcaaaaatctttcgaaccttcagtcgttcagcatataaattcgcctcactcatcaagtacatttttgagagacaatcatcattttcaaaaacttctgtattatcaagcatgacatccccgctgcttgggaatattcgattagtaattatatttagtagtgtacttttaccagcaccgttacgccccagcaatccataaatcttttgtggttccaacgtcatcgtcacgtcttttaaaacctgatgtttgccaaaatgctgtgaaatatgattaacgtgtagtgtcgtcattttgatacccccgtgaaatcagttgttccaatttatcctgcgttaagcccaacttctgagcttcttgaaccaggttcaacacataatcagaataaaaactttctcgtctttgatgcataattttatccttcgctccttgtttaacaaacattcccagcccacgctttttctcaatcaaatccttagccaccagtaaattcataccctttaataccgtggcaggattaatatgaaactgctttgaaatttccgttgtcgaagggacctgatcatcctcattaaaaccgcccgtaaaaattgcctcttctaattgcgcggcaacttgttggtaaatcggttcagtactatcaaaattaaactgcatcctctcacccccgcttcgtgtctttcaaaaccagttgtcgataaataacgaccgttacaacgtagtacacggcgtagcaaccaacaaacataaggctggccataccaaaggtacgatatggactaagcatcaatttggtaaacatccgcaagcccaatgcaacataacttactccaaggacggcaggaataataaacaaggttccaatttcagtcaccagtgcccagtttaattgccgctgactagccccaatattattcaacacgtgatagcgtcgttggtcagcgcgggtccctgataatactttaaacatcaagcaactggcaagcattgtcaaaaaggcaagccccaagaaaaggcccataaattctagcccaccaaacatggaattagcgactaaatacatgttgtatccgttactcgtctccatcccactttgctgtgccgctgtttgatacttcgctagtttcttcagaactggcaagctggcatgcaaatctttaactcggattaacgtcagggctgcacgcttacccgtttgtgctttaaatttagcgggtgtcaaaataatgatttctttattccgaacactcggatcttgcagctccttaaacatcgcctgttcagtgccggattgaatcaacttttcgttgggaatgtttcggtaagttggtgccgaaacactggtcgtatctttgatagttcgaaccatctgaaacggctgttgcttcaattctgcctgattgtaataaacatactttcctgcactaatttgatggtacacaaccttcttttgaacgttcaactctttgatcaacttttgtgccttcgcacttggattcgttaagttcatcgtatacgcactggcacgttcactgacaaccgggatctgttggtaatagcccgttccgacggtaatggctcccaatgcaagtgagaagagaatcgtcaccatggttaaaattcgtgtataacttccaattcgaaattccagttgacccatcgtgaacttgcgtaaatttttggatgaaaaactggtcttgcgcagtagtcgaataattagagtgaacagtgagccgataagcaagtaactaccgaaacagattgtcactaatgcaataacaatggccatcaaccgcagctgctcaatgcgatccattgcaataaatccgactgctaataacacgataccgacgattacaccagcaaataacttatttgtcgtcaccattcgttggttagcttgttgctgcgcatgaataatttgggtcagtggttttcgatggatcgaaataatcgacgtaatagcgcaaaatagcgctaaaataaagaaaatcactaacgtcgttacaacggaagtcacggaccccacattcaaccccgtcaatttaaaatcaatcatcttagctaatgcaccacttgcaaactgggtcaaaactgcacccacaataatgccgataatcgttgacccaaactgaatgacaaaggtttcgatcataattaactgatcaatcttggagcgccgtgcaccgaacgtcagtagcatcccataatcctgtagccgcatctgtaacagaaacgactgcgcgtaccaaacgtacacaatcgcaatcaccgtcaacaagacaatgccaaagtagaaaacctgcgtcaccagtgagatactaatattttgtttcaaaaaatgctcgttagtcgcaattgacataaaaaggtaaaaaatggctgagctaatgatcaagccggaaaataaaatgagatagtccgccaagcgacgacgaattccggtaagtcctaattttaataacattgattgttctccttatctataggtgcccagatcagataggattgactgatagaaatcatggcgcggttgaccatctctttcgatcgtctgaccaatttgaccatccttaatcattaaaatccgttcgcaatatgaagctgagaatggatcgtgggtcaccatcaaaacggaaacatgatcttcctggttgatttgtgttaataactccatcaaatcacgcgcgttgtctgaatccaacgccccagtcggttcgtccgctaaaattaaccgtggttcatttaccaatgctcgagccgcggctacccgctgcttttgaccaccagataattgcgccggatattggtcaataaacttttcaatcgatagtcggcgactgattttttctacctgtgctcgcgattgctgcttgtttaccccttgaagatctaatggcaatgcaatattttcagccgcggtcagattttccaataagctaaaatcttgaaaaataaagcctaactgttggccccgaaactcgcttaactgtcgatccgcaatttggcttagatcctgatcattaattttaatcacaccacttgtgggacgatcaagggttgccagtaggttcaatagcgtggttttacccgaaccagaagcacccatcaccccaacaaattcaccagccatgacctgaaaattaatgccctttagagcctcataactagttgtttgttgactaccatatactttatgaacatctcgtacttcaataactgacgcggtttgctttttcataataccctccatagataactggttaattacttatgtaaccaactatatatggttaatgcttatttgtcaaacaaaaattccaactcccgttatcgcggttgttggaatttttgttttttatggtcggttcaatccatcaaatttttgcttaataaactcagcagagctctttaactgtccgtcttccagttccgaaagctttaggaaaaccaatgattcgatcccatttttaccaacaattgctggttgccccacataggtcccgagtccaggatggtaagtagataccggagctgctaaatgggcatcggcaagtactgcgcgggccaatttaactgcacacgttgcaatggcatagcatgtataccccttaccattgaaaatataccatcccccacggcgtgaatctgtttcaagctcctcgtagttaatccggtagtccgcttcaatttctccaaccggacgaccgttaaccgtgaccgttgaccaagctacaaattgtgattcaccgtgttcaccatacacatagccaccaatgtttttcggatcgacccctaatttattgcccaatgctcgttgcattctcgcggtatcgagaaacgtgccggtcccaaaaacttggttgcggggtaatcctgtcaactcttgataataggctgttaccacatcacacggattaccaatgttaatcaagaccccattaaatccagatgctttaatcttaggggcaatctcttggaccgcggcttcgttgaattttaactcaccaaaacgatcaccatcttgttgaatcacattaatattccccattgcagaaatgatgacatcggtatctttcaatgccgcataatcctgcactacgatcttggtcgatgtatctaatctcgcaatggcatccattaaatcatactgttcggcaacgaccttatccgaattcgtatcaatcaacacgagttcatccgcaattccctttgtcaccaatgtgtatgcaactgtggcgccaacatgtcccaatccaatcactgctatcttgcgcattccatcaccctttttctttaataccttgattatattacaaaaggagccgtcccactatcgtggaatcgactccttttttggtgatgctagttttttccgtttggataaacaggaacaacagcacccttataatgcttagaaatccattgttgagtgctcttagattgcagtgccttcatcaactttttaattgctggtttattcttgtcacccttacgtacagcaacaatgttggcatatggtgatgagttcttttcaagggcaatcgcgtccttggttggatttaacttcgcctgttcagcatagttagcgttaatgacaactgcatcgccttcacccttttgatagaattgtggcatcaatttgggctcgagatccgtcttaaacttgatattacgcttgttgtcttggatatcactaaacttggcagtcgtaatatccgttcccttcttcaaagtgattaatccggcatccttgaaaagggttagcacacggccatagtcagaaacgttgttacttaccaatacagttgcaccatttggtaagtccttcaaactcttgtatttcttagagtaaataccgattggttccaaatgaacttttccggcactaaccagtgttccgttattttctttattccagttgttaaggaatggtgtatgttggaaatagttggcatccaagttcttattcgccaaatctttattcggtaacacgtagtcttggaataccttaattttcaggttgattccttcttttttcagttgtggctgaacatgcttcaaaatctgtgcgtgtggaatatttgatgctcccactgtcaaagttgtttcctttgttgatgatgacttcccacagccaaccaacaacagtgccacagctgcaacacttgctaaacctgcaatccattttttcttcattataattccctccataacataatttgactaacgcttatcaattcgcttgacagcaaagtctcccaaatattgaaatacaaacacaatcagcacaataatcacagttgccattagtgtaactgcgttattggatgcttggaaaccatccaagtaagctaaattacccaagccaccagcaccaatcgcaccggccattgccgtatacccaattaatgaaattgcagtgacggtaatgcccgaaactaacgctggcatgctttccggtagcagaaccttcaaaataatctgccacttggttgctcccatcgcttcagctgcttcgataaccccgtgatcaatttcatgaaatgcaatttcaaccaagcgagcgtaaaacggcgctgccgaaatgatcaacgacggtaatgcagcttgtggtccaataatcgtccccataatcaactgcgtcgttggtagtaacaagacaatcaggataataaatggaatcgatcgaaaaatatttacaaatgctgctacaatccaattcaagattttaatcaaaattgaactactaccattggtctcaaacaaaaccaatcctaacaaaatgccaagaatcgtgacgacaataattgaaacgaccgtcatccaaatggtttcccacgttgcttgtcccatgttcgcccagttcacattactaaactgaaaataggacgcaaatccgttactgttcacgcttaatcacctctgtttcaacacgcatggtattaaagtactctagcgctccttggagactatcatgatgctcgctcaacaactggatataaagtgagcccaaggcaccttcttgcgtttgatgaatattaccctcgataatactaaggtcgacatccggaaattgtcttaacatttccgaaacgattggcaattttgcttggtcaccatggaaagtcagtcgaacaatcaatccatttggatacttctccaacaattcgctgacgaccaccgttgtgtcatccaaacttgcactcgaggtttcttgattaacaaaccgtttcgtaatcgcctgttgtggattcttgaagacatccaataccgggccttgttccacgatcttaccagcatccagaacggcaacatgatcacaaattttacgaatcacatgcatttcgtgtgtaatcacaaccaccgttaaattcagcttcttgttaatatcaatcagcagatctaacacttcatccgtcgtttgtggatccaatgcactcgtcgcttcatcagaaagtaaaatttctggatcattagctaacgcccgagcaatcccgacccgttgtttttgtccaccagataattcagaaggatatgcattttcacggccttctagtccaaccagcgcaacgagtttttgtgctttttgccgccgttcttctttagcaacttttgcaatttctaacggaaactcgatgttttcaagtaccgtccgtgaccatagtaggttgaagtgttggaaaaccattccaatcttaaggcgctgttcccgcagctctttgccctttaaactactgatttcactaccgttaattgtcacggaaccggtggttggaaattccaacccgtttaacattcgaataatggtacttttaccggcaccagagtaccccacaattccataaattttaccatctgaaattgttagattcacatctttaacagcgtgaacggtgccttctttggcagtgaatgttttggaaacattcttaaattcaatcaccgctgaatccctcctttaaatcaaaaaagctttccatcctgaatcggcctaaaaaccgattcgggacgaaaagctttgctttgcgtggtaccacccaactttttagtaatcttataattactaactcaacgagtctactgactcccgcgcgataatgggcacgaccattgcaaattcataactcccttgagttacttatttacaagttaacgacctcaagaccatattcggcaccgtaacctattccctttcaccaaccggaaactctctaccagattactagaacctactcatcctgattaacttatacaacttaaatgatgctgaacatgattatactaattccaaaaatgaatgtcaagttcagggtcatcattcaaaatcacatttcagcctagctttgaaccgttaaaatccaacgactgctctccacgtcaccatttaaatcatcagtcgagtcaaccaaattaggatttacagccaccacttcaccggtcaccggactaggaatatccgtaaccgccttttcggcttcgacagaaataaactcaccatcttgcgttaactgcgtacccacatccggtaaatcaataaaattaacctgtccgagctcactcacaccattgttattaagtccgatctttacttgaccatctgcaacgggggttacccaaaaataacgaccttcttgtgccataatgactgcctcctaatcacctaaactgttctttattactaaacatatacgaacgttgatggaacctcatcgacatgatcatgccaattcccaacatgttcccgattaatgatgacccaccagcactgataaatggcaatggaatcccagttaacggtaacaacccaatgttcatgccaatattttcaaagacgtggaacaagatcatcatgattacgccggtcgaaatataagcataaaattcgtttttcgtatcaaaagtaacacgaaccatttggtagatcaatagcaaatacagcagtaccagtaatgcaccaccaacgaacccaaagttttcaccaatgacggagaaaatcatatcagattctcgcacgggtacgtagacattggaattattgaatccagtaccaacaattccaccagatccaaccgccttgatactttgccaaagttgatacccattattcgacgtatcctgcgacggatgcaaccacgtatcaacccgcgcaaactgataggcttggaatcctaaatgctccaagattgaacggccccaacttgtcgtaacaaaggcaagtgcagtccccccaatcacagcaactgcggtcacacccggtacaattatccgccaactaattccggaaaccagcaacattcccgcaaagatcgcagcaaacactaacgtcgtcccaaagtcattttgaaaatgcagagaaatgacgattggtaataaccagccaatcattttcccaatcaacgcaaaatcagattctaatgtatgattaggatattgcgtattgtgatttgttatgacccgccccatcatcagaatatacgcgggtttcatcacttcagacggctgaaaggtaatcggaccaaccgcaaaccaacttttagcaccggtactaacataataggatcgactgtaaaatactaagattgcgaacatcaaaaatattcccaaccaatatgcaatcggtgcaaccttccataactgttcggaatcaaattgcatcacgataatgatggcaaccgtcccaatcacgtaccacattaactgagaaataacggccttcatcacactggtacttgatttatcatggttagcggcaacatatattgaagctaggccaattaacgctaataacagtacacaaaaaatgataccgtaatcaattctcgaattttcttcttttacgtgtgcacttcgctgcattacaaactccttttaactctaccgattaaattttgtcatccatgactagttgtgtaagttatactgacgcaacactaattcgataccatcatcgacggactgcgctctaaatggctcttcgttaattaccgcttgaaacttgccttgatcgtcaatcacctgaccaaccacatttttaccaactaggacttcggttatgttttttgcaccatcttgaacgtcacgaattgagacttcaattgttttattttttttagacacgacttcaccttaaaatttattttgttgatttcgtagtaacgtgaaatgatccggtaccggatcatagccccccttaacaaggggatggcaccttaaaacgcgggcaatgcccatcaaaattcctcgatatccaaatcgttcaattgcctgcagcgtgtatgttgaacagcttgggacataacgacaaacgggtggccgtttggcggacacccctcgttgataccagacaattaagattttgatcaatttaagcacgtttattttctctttttacctgttttttgcatccgttcaagtaattcaccggcgcctttagcaacattatccagtggatcttgagaaacaacaacgggaaccttcaaatgttcactaaacaactggtcgatgccggctaataatgccgtccctccagttaacattacaccacgatcgataatgtcagatgctaattcaggcggtactgtttctaagacgttcatggcagcattaatgatctgttgtagcgtctcatgaagcgcactttccacttcattggcatcaatttcaattgagcggggcattccactaactgcatcgcgaccacgaacttccattttcttagggtcatcaacacggagtgcagttccaatttccatcttgatattttcggctgagtgttcaccaataattagaccatgttgtcccttgatgtaacccacaatatcgctgttcatcttatcgccagcaattcgtaatgattggctggaaacaatatcacctaatgataaaatggcgatatcacttgtaccaccacccatatcaatgaccatgtttccactaggcttgaaaatatctaagccagcaccaattgcagccaccttaggctcgtattcaagatatactttgccgccaccagattgttcggccgcttgcataatcgctttacgctcaatttcagtaatgtttgtcggtgcgcaaatcataatacttggcttagacatgaatcctttaacgtttaatttgttaataaagtacgtgagcatttcttgcgtcacatcgaaatcggaaatcacaccatccttaagtggacggatagcacgaatattgctaggagtccgtccaaccatccggtaagcctctgatccaacggccaagaccttgtccgtttttgtgtctacagccaccacagatggttcgttcaagacgaccccttttccttgaacgtagattaaaacgttcgcagttcctaaatcaattccaatatcccttgccattatgtttctcccttcaaatttttcgttcgtattatatcatataatgatcaactagtttgtgtttctagctggattattcatcgtgaacgttgtcgtatcgtcaacatcaccacggtaaatgtcggccccgaggcgactaagcttcccggtaaaatcatagtagccacgatcgaggtattttaaattcgttacttgggtatagccatgtgcaaccagaccagctaaaaccaaggcggctgcggcccttaaatccgttgcggcaacttgagcgccgttaaaatcggttggcccttgaagcatagcggctgagccttcgattctgaagttggcattcattcgccgcagttcgttgagatgcataaaccgattttcaaacacggtttcttccaacactgaagtcccgtgcgcacacaactgtaaaatcgaaatctgtggctgcatatccgttggaaatccgggatgcggcattgttttaacatttgccggcaagacgaccgacgttccaatcacacgcacgccatcatcctgaccaattactgtaacgcccatttcacgcagtttcgaaattagcggtttattatgctcaggaatggcatccgcaataaccacatcaccattcgtcacggctgcggcaaccataaacgtcccggcttcaattcgatcctgaaccacgctgtgttcacagccatgaaggaaggtaaccccttgaatccgaatcgtttctgttccagcaccgtgaacgcgagcccccattttgttcaagacattcgctaaatcaacaatttctggttcacgggccgcattctcaatcgttgtaatcccattagccagtgttgccgccatcatgatgttttgagtagccccgacacttggaaaatcgagataaatattattcgcttttaattgatcagcaaaggcctcgatgtagccatcgtgctgttcaattgttgcgccaagggcttcgagtccctttaggtgtaaatcaatcggccgtgagccaattgcacagccacccggtaacgccaccttggcatgaccacaacgcgccaacaatggccccatcacaaccatggatgctcgcatcttcgaaacatattcaaatggtgcttccgacgaaatcttctcagaagcatctaaaatcaagtcattggtggcctgattaaacttcacgttaatattgagaaacttgagtacactgttcattgtaaaaacgtccgatagtatcggcacattatgtaattggacaatcccagtcgaagctaagatactggccgcttgaatcggtaaaacagcattcttagcgccctcaattttgacgcgtccttcaagtcgtttgccgcccttaacaataattttatccatgaatatttcctccgcggttccaaagttacttgagtaaatagcttaagttttgtaatgaactgaaaaagctcatgaagaagctcgcacagccatagccaattgcgatcgacaaaagaactttcatcagtggtaatacctttggtacctgacgaaatagtctctcaaagtgaagttcttggagacctttgaatgtcacccaaataaaccccagttgaacaacaatcgttataattgcatcgattccaatctgtttcatgtcaaaaactcctttgcagtcatcatccataataccatattcatactgcgaatgtcgccgccctttaacaaactttaatagtccttacaacacaaaaaagaccagattatttttcaataatctagtcttttaaagtcatcacagcgactatttttcagttaaactcaatcggttcaaggcacgtcttaaagcaacctctgcccgagctaattcatccttatcggatacttccttagcatgggcaatatgttcttcggcacgttccttggcactttgagcacgttggacatcaatatcttcaggcaattccgcactatcggcaacaattgtggcaagattatttgaaaattcaacgaatcccccgttgacggcaacttgatcttcaccatcttcgaatttgactttaacagcatcgatcttaagaccagcaaccacgggaacgtgattagccataaccccgatgtcaccaccggtagtcttcaaaacgatcatcgttgcgtcttttttgtcgtacacacttccatcaggagtaacaatggtgacgtctaatgtatgatcagccatttttatgccccctagttagtctgttgcatttgttcagcttttttctgtgcgtcttcaacagttccgaccagacggaatgcttcttcgggaagatcatcatacttaccttcaagaatttccttgaagtcttgaatggttgtcttcaaaggtacataggcgcctggtaaaccagtgaattgttcggcaacactaaagctttgcgacaggaagttttgaatgcgacgagcacgaccaacgatcgtttgctcttcgtcagacaattcatccataccaagaattgagataatatcttgtaattcacggtaccgttgcaaaacgtgttgtacgccagtagcaacttcataatgttcttgaccaacaatttctggcgtcaaggctgttgacgttgaggcaagtggatcaacggccggatagatcccgatttgagtcagggcacgatccaagttagtcgttgcgtccaaatgcgcgaaagtggtagcaggagcagggtcggtataatcatcggcaggaacataaacggcttgaattgaggtaattgaccccttcttcgttgacgtaatccgttcttgcaactgacccatttcagtagccaacgttggttggtaaccaacggcggatggaatccgacctaacagagctgaaacttctgaaccagcttgagtaaagcggaaaatgttgtcaataaacagcaacacatcttgacccttaacatcacggaagtattcagcaatggttagcccagttaaggccacccgcatacgtgcgccaggcggctcgttcatttgaccatagaccatggccgttttttcgagaacccccgatgccttcatttcaaaatacatatcatttccttcacgagtacgttcaccgacacccgtaaagacagagataccattgtgtccctgtgcgatgttatgaatcagttcttggatcagaacagtcttaccaacaccggcaccaccgaacagaccaactttaccaccacgaacgtatggagctagtagatcaataactttgatcccagtttccaaaacttccgtactgttgttaagttcgtcataggctggtgcgtcacggtggattggcttacgttcagcatctgcgccgaattcagctccaccgtcaattggttcacctaagacattgaacacccgacctagagtatcgtcacccacgggaaccgtgattgatgattcagtgttttcaacatccataccacgttgaagaccatcagtaccatccatggcaatggtccgaacgacaccgtcacccaattcaagggcaacttcgacagtcagactattgctatcagataacttaatcttcaaagcagtgttgatatcaggtaatttactgtctaaggggaactcaacgtcgacgactggtccgataacttgtacaactttaccagaactcatttagttgtttcctcctcttcctgtagatttagtagatttattcaagggcagcttgaccaccagtgatttcagtaatctcagtggtgatggcagcttgccgagcacggttatattgcaactcaagagctgcaattaaatcgtcagcattatctgaggccgaccgcatcgcatttgtacttgaagcgtgttcagatgttttggcatctagaatcgcgccataaaccaagctttcagcgtattgtggcaagacaacggataaaatatctgtttctgaaggttcaaattcatattctggccccacttgcttatcttctgctgattcctcatcagaaacatcttcaagcgattcttcagaaataggtaacatcttataagtctgaacgcgtgatgaaatccggttcagaaaatggctgtacgaaagataaagttcatcaaaaacctcattcccatacatctctgttaccgttttgacgatttcacgaacttccacaaacttcggcacatcgctgacaccgctatactggtacgcaatgttcatgccacgtttagtaaagaagtccgttcctgtgttcccgaccgtcaaaaataccgtgttatccttgtttaggttgtgctcacgcatgaaatcaagcgtttgcttaatgatgttactattgtaactaccaaccaacccacgatcagaagtgatcacaagaatcccagtctttttaactggtcgctggacagcaagttgagaaatcgacgaattttcaccagcagaaacgagactgaaaatgtgagcttgtgctagatgtgcaacaacgctttcaaccttcgatgcatatacacgatacgtctgcgtgtgcttttgaatctggttcaacttagaagatgaaaccatctgcatggcactcgtaatttgacgtgtactcttagtagacgcaatcttatgtttaacagctgctaatgatgctggcacttaatctcaccgtcctttcctaccggtcaaactatttatttgaatctttagaagcagccttcttgtcggcactaccttggaatccagcagtaaattccttcactgcgttatctaagctatcaccttcaggaagctttttggtcttcttaatttcgtcaaagacatcctgatggttggcagcgatgaaatcaagtaattcactttcgaatcgttgaatatcatccacttcgatactgtcaaggtatccatgagtcaaagcgaacaaaatagcaacttgttgttctgcggcctctggttggtgaagtccttgtttcaaaacttcaaccgttcgacgaccacggttcaacttagcttgcgttgcttcgtccaagtcagaaccgaattgagcaaatgattccaattcacggaatgaagcgagatccaaacgaagggtcccggcaactttcttcatggctttgatttgggcatccccaccaacacgagaaactgaagtaccggcatcaatggctggacgagttccggcgtagaataagtcagaatccaagaagatttgaccatcagtgatggagataacgttcgttgggatataagcagaaacgtccccagcttgtgtttgaataattggtagggcagtcattgaaccaccacccaattcatcagacaatttagccgcacgttccaacaaacgtgagtgggtatagaagatatcaccaggataagcttcacgaccaggaggacgacgaagaatcaatgacagttcacggtaagcatccgcttgtttagtcaaatcatcgtaaacaatcaaaacatgcttgccattgaacataaattcttcacccattgcagcaccggcataaggcgcgatgtaaagcaatggagctggatcagaaggacccgcatcaacgacgatagtgtagtctaaggcaccataacgacgtaatgtttcaacttgatttctcacagttgattccttttgtccaattgcaacgtaaatacagatcatatcttgatctttttggttaataatcgtatccatggcaattgaagtcttaccagttttacggtcaccaataattaattcacgttgtccacgaccaattggaaccaaggcatcaatcaccttaataccagtttgaagtggttcgaagacacttttacgttgcataacgcccggtgccttccgttcgataggacgtgtcttatcagtattgatttcacctaaaccatccaatggacgacctagtggatcaacaacacgtcctaacagtgcatcgcctacgggaacttccatgatccgaccagtacgtttgacgctatcgccttcacgaatactagtaaaatcaccaagaataacgataccaacatcgttactttcgaggttttggaccattccgtagacaccattattaaattcgagcaactcaccagccatagcattgtctagaccgtgcgcacgagcgacaccatcaccaacatacgtaactgtcccagtttcttcaactgacagttgatcttggtagtttgctaattgttgcttgatgagtgaactgatttcctcagccttaatgctcataaatgtctcacctctttataagatattcattatttaacaagtaaacgacgtatctgttcaatctttgagctaagactaccatcccacgtttcattattagcgtgaatgattaccccgcctaaaatcgagggatcaacttgttcagataacataatttcattggcatcaatttttttagccaatgtttgtgacagttgatctttttgtgtcgcatcaagcttaaccgctgtgacaacgtcggcatgaactcgttttttctttgaatcatatcgccgttcaaactcatcaataattgcgaccatatcatccatccggccgtaatcaaaaaccatcataattaagttcttaactactggtgttgcaccatcagtcaagatcttaaggattgattgcttttcttgaagtgataattcaacacttgttaacaagtaagctaaattatcgttggtttgaaaaacatcacgtaattgtttcagttcttcaaacgttgagtcaagctgatcttgttcaacgactaattcaaacaatgccttagcatagcggtttgcaattgtcattttatcaagactcatcttttcccaacccttcaatataagaatcaatcaaggctttttgatcattggcatttaattctttgtgaatgatcttggaagcaatctcaatagacaagtttgcaacatcgttttgagcactattcaaagcgtcttgacgcgcctgcttagcatcttgctgagcattttccttaagtgcttgcgcatcattttgcgccgatgcaataatttgagtacgttgcttctcaccgctttgcttagcgttgctaatgatcgttgcagcttcctgacgtgagttctgcaattcgacctgacgctttgacgctaaatcacttgcttcgttgcgtgattgctcagcactatcaatatcattagcgattttttctgcacggtcatgcatcatcttgacaacaggtttccaggcaaatttcttcactaataacatcaagatgatgaatgaaattatgtagaagaccatgtcacctacgtacaaactgtttgattcagctagaacactttgtgcaaacatctatcggcacctccctataaatgaatttattaaaagctttgattacttgttcattacaaggaaagcaataacaattgaaataataggcatagcttcaacaagaccaacacctaagaacatggtcccacgaagtgagccacctaattcaggttgacgagccgtaccttcaattgtacttccaataacaacaccgttaccaatcccagcaccgatagcggcaccagcagcggcgattcctgcagcaattgctcccattataaaatcctccttaatgtgtgttattcctccgtcgagaccttcgaagaaatataaaccgtcgttaatgttacaaagacataagcttggaccccaccaatgaagaacgagaacccttgccaaacaacttcaagcggcaggctcacgatcattgtcggtataccatgtgaaaaggccatctgagcaagcagcttcaatagcaattcaccggcatagatattcccaaacagccgcaaacctaacgttaggaagttactgaactcttcaaataagttaatcggtaacatcgcggtatatggtgtgcagtatgttttaagatatccgacaaaaccatgtcgggcaaccccagcaaaatgtgtcaatgtcataataaccaacgcaagcgtcattgtgatgattgggtcagctgttggacttctgagtaattcgtgaccgccccaaccgaattggaaaattaaaccaaattcgttggcaatcagaatgaatacgaataacacaaacgccataaagttgtaatgtggggcttcgttagcgggcatttgaccacgaacgattccgttcgtgaagtcaatcatccactccattagattttgggcacctttgggcttcatttgaagctttcgagacaacccatataatagacaaaaaacaagtacaaagattactaatcctgaaatcaagttcgtccagttaaacatgaggcccaaaaacttaaatgtataagcgtcaccacccatgtatattccacctcttttctttataacaattaatttggttgcgttgtacaccgaaatgtctaaaaatacgtaacagtatccacgacactccaaaatacatagcaaaatgataccaccaattcaaacaaatatcaaaaaaatttcaaaaaaaaaagtattgttagtaacgctaacaaaccgcgttatagcaatacttcccgtattattttactgttcactatgggcatttttcggtaaaattaaatttaaaaggatgcctaataccgtggcaacagcgagtcctgaaaattgatactgaccaatttgtaaatatgcattcccaattccgatcactaaaattgtagatgcaatcattaaattccgtttttgatcaaaatcaactttcttttcaatcatcactctcagcccactggaagcaatcaccccaaacagaagaaacgaaatccccccaataactggactaggaattgattcgatcaaggcgctcaactttccaacaaaactgaataaaatcgcaaagaaggctgccccgcccaggacatagacactatgaacccgggtgatcgcaagaaccccaatgttttcgccgtagctagtcactggcgggccaccgacaaagccagcaataattgaagctgaaccatcccccgccagggtatgacgtagtccaggatccttgaagaaattacgtccagttaactgattgagcaccataatatggcctaagtgctctgtcatcgtgacaaacgcaatgggggccatacttaaaatcgcgccccagtacagatgtggatgataactcacaaatggaatttgaaaggccggtaaactaaaccaagcagcctgttcaaccggcttaaaatcaacgatcccaactgccacggctaccaagtaccccacaacaattccaagtagaattggaattaatcctaaaaagccacgtaaatacatgttgaaaaagatcgtaaccagcaatgtaatcaaggccacagcaaaatatttaatttcgtaagttcctgccgcgttaagcgtggcatcctttgctgccgttccagcgagcgaaagaccaatcaccatgacaatcggtccaacgatgacaggcggtaaaacacggtcgatccaatccgagccaaacaaactcacaattagggccacaattaagtaaaccaccccaacagcaatcgttccctgtgcgattgccggataaccaatcgtcttcatcatggccatcatgggcacgataaatgaaaagctcgaacccatataagcgggaattttggccttggtaattaaaatatagagtaacgtccccaccccagaactaaataatgcaattccaggattcaatccgactaagattggaaccaacaccgttgagccaaacatcgaaaacatatgttgaattgataatccaacccattgcgcaaactttggtcgttcaccaatgtccaatacgacatgtctttgtgccatttacatattcctccaaaaatgaagccttaaactaggggtccagttcaaggcttcataaaaagagttcggataatgcttatccgctatttaactcccttgaggcctcactggaccaacttaaaaggacttccaattcaattgatagtagtttaatcgtttttcgatgaactgtcaacgaccactttatctttacgtcgcgccattaccaaggacgtaatcgggactgtgataatcacacccacaaacgaaaccaacaccataattaattctgatacaaaaattttgttattaataatcgaactaaaggaatatcctaacccaacgaaccagataaacaaggctaagaaaccaccaaagaagccaaaaaacagcgtattaaacgtcgtaccaataatattttcaccgattgacagaccgctatggaagagctgctttccagtagattgcgggtgattttgtaagacctctgccaggccagccgaaatggccatcgctgcttcggcaatggcccccagcgtactgagaaccgtcgtcgtcaccgtcacctttaaaaagttaatgccaattaaaatcgacataccttccaaatcctcggtgtcttcctcaccaaatccttggaccattgcccagtgttctactggaataatcagaagaattaatacagctaatacgattaaagacgcgtaaaatgccgtctgcgtagtcaataaatcatcctcacccataaaaatcgtaatcgctaggatcaccacgccggtaaaaatggtgacggcaaggggcggcagatggaacgcaattaaaatcacagcaaagaagagaaacccaaaatttaaaatgatactcaaaaacgatttccaaccctgctttccaccaactaataccattaaaaccaacaacactaatcctaatccggtaattgtactcatctatgcacgcctctttcccaataatagtcccgcaaaggcactcgcaacggggattgccagcacgataccaatcccactgatcaagctttgaaccgttcctaatcccatattcatcgcaaacgtatagccccacgaattaccattcttaatatatagcaggcttgaggtgaacgtgtctgccataaaaatcataaataagacgttaattagtggtcccatgattgactgtcccacgcgtcgaccggataaaaacaaacttttagcactaatgtcgggattgagggtcttgagttcgaaaagtgtggagacgatatccgtggactcgtccatcacggccccgagagaaccaagtagggtttcagctaaaaataagggtcttgcaacctgagtaacatactgcatggattcatagtacattccacgctcatgggtccacgaaaagactagtaggctgatcaccattgataatacggtaccaatcgttgttgcgcccagcgttgccatcatctgtttggttggtccttgcacgattagcaatgtaaccaccgcaaagacaaaggccaggctcccaaagatccacatcacatgattcccctgaaagtttaaatcaagttgaatcgaaataaagaaaatgactgcatttaataggacacttaagaacgccagagcccccttaaacttcataattaagagcagcaaacagacaacaagccaaacaagaaagaccagtacccggtctcgtttatatccttgaatggttgctgataaagccccgtgtccaccgcgttgaatacttaaaaagacctgatccccaacccgatatcgctgatccatcgcatgggaatcggtaaattcattcgttaccttgatgtgttgttccttgtacttcccgttaacgacacgcacggtaacaacctgagatgtcgtgtggtcaacgttatcaaacgtatctttttgtttctgtggtttgccattcttaaccgctacgacttgcccaatcggttcacgataaaacgcctgattgtggttcacaaagtacatcgcaattaatcccgttacggctaccagtaaaaacatggtcaatgttcgccaattaatgatctttttcattctcatgtttccctctccaaattatttccatccatcattttaatccaatcagcgctcatcgacgctgatgatttaaattctttaacagattataacttgaaataaaaaaagaagatcacttttttgtgatcccctcattaattcagttctatttggtaccaaatagccggtcaccagcatcaccgagccctggaacaatgtagccatcttcattcagcttttcgtccaaagcagcggtgtagatatcaatatcagggtgagcttcttgcaaagctttaaccccttccggtgccgcaacaaggcacacaaacttgatattagtagcgccacgtttcttaagcgcatcgattgccatgatcgctgacccaccagttgcaagcatcggatcaacgacaaataattgacgttgatcaatatctgaaggcaacttcacgaaatattcgtggggcttgagcgtttcttcatcgcgatacattccgatatgacccaccttagcagcaggaatcagttcaagaatgccatctaccatgcccagaccggcacgtaaaatgggaataatcgctacttttttaccagccaactgtttcttgacagtcgtttgaattggtgtttcaacctcaacatcttcaagcggcatatcacgcgaaacttcatatcccatcagggttgaaatttcattaacagtttcccggaaaaacttagtaccgacgttcttatcacgaattaacgttaacttatgttggatcagtggatgatcaagtacttcaaacttgcccatggcaaataaacactcctttaagtttcttaactattgtaccaaatatcacgaactaatacccatttctaattaaaaattaatcaactttatgagcgttggtcaattcatgcactttgttggcaacagcctgcataacggcatcatcatcactatgatgaataacctgtaaaattagccgtgcgacttcggctgcttcggcttgcttaaatccccgactggtaatggcgggcgtcccaattcttaatccactcgttacaaagggactaagtggttcatttggaattgattccttgttagccgtgatcattacgctatccagcaagttttgtagttgcttgccatttaagtctgtcttagaaatatcaatcgtcattaaatgattatccgtcccgccagacacgacatgaacctgttcgtcagcgttaaacaccgccgccattgcctgtgcgttagttacaacctgattgatataggtcgtaaagtcaggttgcaacgcttcataaaaggcttgggccttcccagcaattacgtgctctaatgggccgccctgtgaaccggggaagacagctgaatttaacttcttggcaaatttttcctggctcaggatcatccccccacgtggaccgcggagtgtcttgtgggtcgtcgttgtgacaacatctgcaattccaattgggctcggatgtgcaccagtagccactagccccgcaatatgggccatatccaccattaagtaggcgcccactgcgtccgcaatttcacggaatttttgccagtcaataatccggctgtaagcagaggccccggcaacaattagttgtgggtgaacttcttgtgcctgctttaaaatcgcatcgtagtctagacgctccgtttccggatcaagaccatacccatacgaccgataaaatttaccactgaagttaacagcggcaccgtgagtgaggtgaccaccagagtctagtcccatcccaagaatggtatcgcctggttttagtaatgcttggtagaccgcggcattagcttgtgagcctgaatggggttgcacatttacgtattcagccccaaataatgctttcgcatggtcaattgctaattgttccacttcatcaatatactggcatcccccatagtaacgcttttggggatagccctccgcgtacttgttggtaagcaccgttccctgagcttcacggaccgcgtcagaaacaatattttcagatgcaatcaactcgatggtgtcttcttgtcgttggacctctttttggatcgactgccataggacaggatctttaccttgataattcacgtgcctcactcctttgctttaaaactattgtaaatgaattcagttaattaacaaaccttttcgactacattttgtcattaaagtgggccccaccggccgacttatctaaccggttcatgtaagctattccgagtccttgttgactaaatccctgggcaaagatgacggttacttcggggtgttcatcagcaccacgtaatcccgcaaaaagatgggcacttgcttgttgaacccctgtgcccagcgaatactgcaccacattattcggccagttaatggctgttaaaatagcttcttctgctaaaaccgccgccggttgcgaatgatttgtcagccaccgtgccacttgctgccaatccgacgtgtgatcgacaatgtaaacttgggcacgtggtgcgtagtgcttgtacttcattccgggagccttgggtgtctcatccttgcctacatggtgatggttgatatttatcgtaccgattaccgcttcaatttgctcttgcgtgaccgcgccaggtcgcagaatcaccggattgtccgttgacatatcaaggaccgttgattcaacccccactgtggtcggaccatcatctaagatgccagcaatttttccttgtaaatcatgataaacatgctgtgctgtcgtcggactcggcttaccagaagtatttgccgatggtcccacaatcggacatcctgcctttttaataagggacaatgtcgcttgattgttaggaaaccgaaaagcagccgtttgtaaaccacccgtcaccgttttagatagtacacccggctttagtttaaaaatcatcgtcagcgatcccggccaaaaatgcgccattaattgacgcgcggccggagaaatggttgccgcatacttttctaccgttgccacatcagccacatgcacaattagcggattatcactgggacgccccttggcagcatatacctgtgaaaccgccgcttcattagtggcatcagcgcccagtccgtaaactgtctccgttggaaatgcaactaactgaccagcagctaactgcgcggcggccgcatcaatttgtgccaccgtataaattttcgtatccaattcactcactccatttctttctgatttaatcgcacccgaaccattctcattaggccattaatatcatgtttagtatccactgttgctgtgggaagagattggcgaaacagtgtttgaatcgctttttcttgttgaaacccggtttcaccaaatagcatcccgttatgcgccaatcgattctcgaggtgcaatgcaatttgttcatagattgccaatccttcatgatcagcaaatagcgccattgccggttcgtatttgagcactgccgtatccattagatcacgttccgcatccgctatatatggtgggttagtcacaatcacatcaaatgtcgcatcaggaggtaactgatcgaaaacatcactttgatacaacgtgacctgagcccccaattgtgctgcattctgccgagccaccattaatgccgttggtgacaaatcgctcatggtaacctgccattgaggccgttccagtttcagggtaatgccaatcacgccactgcccgtaccaagatctaaaatacggaccggctgttgagcgggaagcgtttcgagcacccattcgataagctcttctgtttcactttcaggaaccagcacttgatcattcacggtaaacgagcggccataaaacggggccttgccaacgatgtattgtgctggttcatgcgccaaaatacggggcaccgcctcctgcaaaaaagcgaattgctctgctggaatgcggtggcgccggttcagtaaccaatcagtcgtggaccaatcatttagcatcgtaatgataaactgtggtgcattctgatctacattttttccctcaatacaagaagaagcccaactaagggcttcctggtaagtcattgtgttattcattacggagttgctccattttttcagcttgatccgcaatgacgagtgcatcaataatttcatctaactcgccattcataattcgatccaatttattcagcgttaagccaattcgatgatcggttacccggttttggggataattataggtccgaattcgttccgaacgatcccccgtaccaacagcagatttccgttgttcatcgtaggcactttgttctttttgctgatagtaatcataaacccgcgcctttagaatttgcattgctttggcccggttttgttgttgtgaccgttgatcttgcatcgccaccacaattccagttggtaaatgcgtcattcgtacagcagatgacgtcttgttgatatgttgaccaccggccccagatgaccgataaacgtcagtccgaatatcctttggatccaaatcaatatcaacatcttcagcctcgggcataaccccaacagtcgcggttgacgtatgaacccgtcccgccgattcagtcactggcacccgttgaacccggtgtgcaccgttctcgtacttcagcttcgagtagacactgttaccagtaatcatcaggacaatttccttgaatccaccaacttcggtttcgtttttatcaaccacctcagttgtccacccctgcttttcggcatatcgggtatacatttcaaataagtcaccagcaaacaggctcgcttcatccccaccagcggccccatgaatttccataataatgttcttatcatcatttgggtccttagggagtaataacacccgtaacgcctgttcaagttcttcctgttgggctttagattctgctaattcctccttcgtcaactcttccatttctggatctagtttttcgcggaggagttcctcatcatcgctcacctgctgcgtaatttttttgtactcgttatacttttcaacggtttcccgtaagctgccttcttcttttgacaacttcataaatttttgcgtatccgcaataatatctggatcactaattaattcgtttaattcgtcgtaacggtcagcaaccgactgtaacttatcaaagatttcgtccatcataatctcctttattgcttagtctaacttgggatgaaaatagtgctttcggcataccgggtagtaggattcattgccaccaatcatgacctgttgtccttcatagacgggcttaccctccaacacacgcaaattcataatcgcctttttcgtgcagaaccaacaaatggtcttcatctcttctattttatcagcgtaaatcaacaggtatttagaaccttcgaacaactgattgcgaaaatcgttctttaatccaaacgtcatgactggaatattaaggtcatcgacaatctgggtcaattggataatgtgggccttcgttaaaaactgcgcttcatcaatcagcacacaagcagcctgcgtgttagttgtcttcacgtaatcgtacacgttggtatcttgcatcaccggtactgcagcacgttgcatgccaattcggctggcaatcttgcccacacccgcacgatcgtcgacaccactagtcaaaataatgaccgacttaccctgctcttcataattatgagccacttttaagatctcaattgattttcctgaattcattgcaccgtatttaaaaaatagctgggccacttgtgttcacctttttctttgcagattcttttatagtataacaaatttagttctccgaacaaatattgttttctaattgatttcgcttacttcccaataattatctgttttgacaatggttatcccataatttaaacaatttttagcttatttctaaaataaaatatgatagattatgtagtggtaacctaccgaagtcatgtaatatttgtgattttggtgaattaacgctaaaataaggcgttaaaatagtttttttacattaaatacgactcaaccattggaggaaaatgtcacatgtcagttagaagtactttggccactgccgccggcaagtcaagttactggttcttgcatacttttttacacggtggaagctccctacccgggaaaatcactaccgccattgatcctaatattttaaaagcgttcggcaaaaaatatgatgtggtcatcatcaccggtaccaatggcaaaacattgaccacagctctgagcgttcgcgtcttgaaacaaaagtatgacaacgttctgaccaaccccactggttctaacatggaacagggcatcgtaacaacgttcatcacggctcaaaaatcaaaacggggtaagaccctagccatccttgaagttgacgaagctaacgttgtgaaggtcactaaatatatcacccccatcgcctttgtctttaccaacctctttcgggatcaaatggatcggtatggtgaaatttacacgacttatgataaaatcttggccggtgtgaagctcgcacctgaagctaccattattgccaatggtgacgaacaaattttcaactcgcgagaactaccaaacccaatcatctattacggctttaaccatcaactagctggtgatatcaaagcgccggctaacacagatgggttgctttgccccaagtgtaaccatatcttgcacttcgggtttatcacttacgctaacttgggcgattacttctgtccccactgtggctttagacggcccacccttaactaccaagtcaacaaactgaccgaattaacccccactagttcgacgtttgaaattgaccatcacgaatataaggtcatgattggtggtatgtacaacatttataacgcactcgctgcctacgccctcggtcgatttttagacgtttcccaagatcaaattcaaactgcctttgaagccgataagaaggttttcggacggcaagaggtgattaacgtcgacggtaaacaggtcaccttgatcctggttaaaaatcccgttggcttaaaccaagtgctagatatgattctgacggataatgatcctttttcgtttgtaggcctcctcaatgccaactacgccgacggaattgataccagctggatttgggacggtaacttcgaaaaactgaagaagcatgcaattcccgcatttatgaccggtggcgaacgttataaggacatcacctttagactcaaagttgccggtgttgacgatccaatcatcgaacccgatctggctaaagtggtcgataagctcaaaacactgcccacgaaaaaggtttatattttggcaacctacacagctgtgttacaattgcgcaaacaactagccgaacaaggctacatcaaggaaggaatggaagcataatggcaacatattcattacacttagcccatttatatggcgaccttctcaacacctatggtgacgttggtaacattctagcactccgctactatgccaatttaatggacaccgatttaactaccgaagtcatcagtattgaacaatcatttgatcctgatcagtttgatcttgcctttttcggtggtggtcaagactacgagcaaatgatcgtgtcgaaagatatccaaacaaaaaaagatggcattgttaagtttattaatgatgacaaaccaatgcttgcaatctgtggtggatatcaacttttaggccactactacattggcgcagatggcgaaaagattcagggaattggtgccctcgatcactataccttgagtcaggaccatcatcgttttattggggatatcaccataaaaaatgaacaaactggtgaaacataccatggcttcgaaaaccataatggcaaaacctacactggtaaaagtgaacaacccctcggcgttgtcgttgacggccatggtaacaacggtgaggatcatcaggaaggtgccatttataagcaaacttattgctcatacttccacggccccattctgacccgtaacggtgaactcgctaaacgaatgctgcttaaagcactccacaacaagtatcccgatgctgatttcagcgcacaagaagcactagaaattaaaccgactttttaaaattggaaaacgctagcgcaacttaaacgaactcagtaacagccgcgcttcgcggccctgaccattacaatttatagtcatgaaaaagactggacaaaactcacgttttgtccagcctttttgcttatttttcttgtagatatgtttgaaccaattgatggcgacgctcaataaactcgggattattagcgctcgggtgtacccgattagaaagcataataaagccctgtttagtttgtcgatctagtatcatccaggttcctgtgtacccagtgtgataaataaccatgtgcggctgattgtcacacgtcggtaatacacgccaaccaaacgaacgaccgtgataaccaggcatcggtgtttgatcgacaaacagatgatccatcgtttcgttcgtcaatattccggctaaattatcagtgaccattgcctgaccaaaacgggttagatcgctcaatgacgaaaacagtcccgcacacccgcagtgttctcctaaaatataaccttttggatcatgagtacttccgcgaatcaatccccgctgtgattgaatctccgtcggtacgcactgtgccgcgatcggttgaaaggtactctgatccattcctaagggcgttaatactgcctcctgaattacctgttgaacgggacggtgataaaaatgttcaataatccaccccaagtaaataaatccgatatcggcatacttcacccgttggttaaaatcttcaccaacatgtaacccaagaagggcctgtgttaattgatcggggcgtaactgattccggttcggaatatatcccgtaattccagatgtgtgggtcattaaatgacgaattgtaacccgttcatcaccaaatgttggtaaataacggcaaatttcatcgtcaacggacaatttgccgtcttgcaccaattgcatcataaccgtggtcgtacctacaactttggtcaaagatgcaacatcgtacaaggccccctgccatagtggctgagtcgtcggctgtagttgactagcgccaaaaacttcctcagtcttttcttcaccgtcaaaaatagtatatgaaacacctggaacaacctgatcatctaccagtgcgtgcaaccgagcaattgttttttggtaacgcacaaccatgcctcctaaatttcattgcctaaaaattgactattgtaaagatccgcatagaacccatcttgagccatcagctcttcatgattaccggtttcaacaatctgcccatgatccattacaataattttttcggcatttcgaatggtagagagccggtgtgccaccacaaagctggttcggttacgttgtagatgactcatcgctgactgaatcaaggactccgttcgtgtatcaaccgagcttgtcgcttcatctaaaattaaaatctcaggatccgcaacaaatgcccgtgcaattgtcagcaattgccgttgcccctgcgaaatattagacgcagattcatcgagaacagtctgatacccatctggcagctgtcgaataaagctgtcagcatgcgcatcccgagctgcctgacacacttcttcctctgtcgcattttctcttccgtacttgatgttatcgtaaattgttccggtaaacaaccacgtatcctgcaataccatcgcaaaatgctgtcgaaccgcctctcgactcatattccgcgtttcttgaccatcgaggtagatatgtccgccttgaatatcataaaatcgttccaacagattaataatggttgtcttaccagcccccgtcggcccgacaattgccaccatatgattttgctgggcgttcagactaaagtctttaattaatggcgtttcatcgtaactaaaagccacctggtcaaagacaatcttattttcctgaacagcttgctgttcgaattgttgcgtaccatcaatcatctccggttcgtctaacacactaaaaatccgttcggccgatgcgatcgtcgcctgaatggtattagtaaggttggcaatctgggtgattggctgagaaaactgattcgtatattgcaagaaagcctgaacgttcccgagcgtgatttgtccatgcgccacctgaattgttccgaggacggccaccaacaagtaaccgatatttttaataaaattcatcatcggaaaaatcagggttgaaaagaactgggccttccaagaggcttggtagtaaaccgcattttgttgttcaaattcatcaaccgcatcttgttcatggttaaacgtccgaacaacggtatggccggcataggtctcttcaacctgatcattaatctttcccaacgttgcctgttgccgagcaaagagcttttgggaatgcggtgcaatgacccccaccactaacaaactcagcggaataatgactaatgaaaccaatgttaacttccaactgatcgtcagcataatatacagcacaccgaaaaacgttaacaaactcgtcacaatttgaatcaaactttgttgcaacgtccccgcaatgttatccatatcgttaacggcacgactcatgatatcaccgttagaatgcgtgtcataatagctgaccggaacccgctgcattttcgccttaaagtccttccgtaactgataaacaactcgttgtgaaatacgagtcatcacgacctgctgcaccacgctgaacagcgcggaaaatccatacagtaacgccacaacgatcataatatgaatgattttatcaaagtcaatcggtaacttggagacatgcatccccatcttcatttcccggtagcccttcatcaccccgctaaaaatttcagtcgttgccttcccaagaatcttaggtgcattgatcgacaaaataaccgaaacgcccgccaagataatggacaatacaattcctggaatccatttattcatataacgaaagagacgagcagtcgttttccaaaagttatgtggcgtatcaacgacaccctttggtccatgattatgcatgtgcgccatctccttcctgaatttgtgattcaataatttgccgatatgtggcattggttgctttcaactctttgtgggtaccttggccgaccacttgaccatcttccagaaccaaaattaaatcagcatctgcgaccgttgaaacccgctgtgcaacaatcacggtcacagcctgctgtacctgctgatcttgtttcaatgccaaccgtaattgggcatccgtcttaaaatcaagtgcagaaaatgaatcatcgaaaacataaatactagcaggcttgatgatcgttcgtgcgattgctagacgctggcgctgaccaccagagaagttctcgccattttgctcaacaaccgcgtctagtccaccactttcctcgacaaacgttttggcctgtgcaatttcaagtgcttgccacatcacctcatccgttgcctgttcatacccgtactgcaaatttgatctaatggttcctttaaacagcaccgctttttgctgcgtaattgaaatcaggtcgtgcaaatcatgctgtgcgacttggtcaatcgatcgaccattgactaaaatctctccttgatcatgattaaacagtcgcggaattaaattaactaatgttgatttaccagatccggttccgccgatgatcgctaccgtttgtccagcatgtgctgcaaaattaactgccgttagtgcatttttctcggcgccacggtacttgaaggcgacatccttaaaagttagtgatgccggctgcgttgcgtcaaactgctgttgctgttcaaccggaacatcgctcaccgagcttgggcgagtcaaaacttcattaatccgtgctgcagaagcagacgcccgcgggacaaacacgaagaccatcgaaagcatcataaagctcatcaaaatttgggtggcatacgtcatgaaagcaaccaaattaccaacctgcatttgcatatcggcaattaagtgcccgcctagccaaataatgccaatgttcgtaccacttaaaatcagggtcatcactggaaacataaatgaaaccagcgtataggccttcatcgccgttttcgtataatcttggttagcaccatcgaagcgatcctgttcaaattgatcctgattgaaggcgcggattacccggacccccgttaacccttcacgaaacaccaagttaattcgatcggttttcttctgaatactcttaaagagtggcaccgcgaaatacataatcacaatcacacaaattgccagaattggcagtgaaattaagaagacctttgtcaaccgtgcttcccggttaaatgccagtacaccagccgcaatcagcataatcggagattggagcatcatccgtaaaatagtaaccatcacattttgaatttggacaatatcgttggtcgttcgagtaattagcgatgcatcgccaaaatcagtgaactcacgactagcaaagttaactaccttgctaaacatttgtgaacgtagcttttggcccaccttcatcgcctgagtcgatgcaaaatagacgtttccgccagccgcaactaacccaatgaccgacaccagcatcatcttaattccttgctgccaaatataggcggtgtcatttttggcaattcccttatcaattagatctgacgtaattgttgggagatataaatcacagctcacctggaccaacagaaaagcgacggctaaggtcaccgcccaccagactagatttttgcgtgcaatttttatcattgaccatcgcctgctttcttaatttgttgctgtaacgattgagacattttttgcaagatcgccgtcatcgtttggatctcgcttcccgacaagctcccaaacatcgttgcttcaatctctcggcgaacctgaatattttgccgtacgatttgttgccccttctcagtaatcgatacccgtaccacccgccgatcattttgatctcgggaccgaacgatcaactgatcacgttccaatttttcaagtagatccgttaacgaagctgggcggatgttgagccattgggcgagttctttttgcgcaacatcgttatgcttcattaacatgcctaaaacatgcccttgaccatgatgaatcccatgttgagacttcattttaacgaggctcattcgcctcatcgtttgcatcagatgaaacatctcctgcgataaatcactatattcatcgttcataattgactcctttacataaacacttaggtacctaacggtttcttaacttacacttttacttacaaaaagtcaatcatataaaaaagcgtgcatcttgaggaagatacacgctttgagccgagtgcaatttacttggctatttaactttataaatccagccttcgggagcttcaatgtcaccaaattggatcccggtaagttcattgtataatttttgagtaattggaccgacctcagtctcactgtaaaagacatgcaagtcatccttgtactcaatgccaccaattggtgcaattacggctgcggttcccatcgcaccagcttccttgaaccgatcaagatcatcgataaagacatcgccttcttctgtttccagacccagtcgatcttttgcaagaaacagtaacgaccgctttgtgacacttggtaaaatagaatctgattttggtgttacaaatttatcatccttagtaatgccaaagaagtttgcagaaccggcttcttcaatcttagtatgggttgccggatcgagataaaccacatcagagtaacccgctttatgtgcttcatcaccaggaagcaagctactcccgtagttaccacccactttgctttgccccgtaccatgaggcgcagcacggtcataatatgaagtcgtaaagtttgtcggcttaacgccacccttgtagtaggccccaactggcattgcaaagatcgtaaagatatattcaggtgcagcatgaaccccaatggtaccaccaacaccaatcatgagtggtcggagataaagcgtgccaccagtaccgtaaggtggtacaaagtcttcatttgctttaaccacttgcattgctgcatcaataaaacgatcagctggcatcgttggcattaacagccgcttacaactgttttgcatccgttgggcgttttgatcgggccggaacaattgaatttcgttattctttgtccggtaagccttcaatccttcaaaatctgcttgcccatagtggagtgccgtcgcaccttcactaatatgtagtgttgagtcttctgtcagctcgccttcatcccactggccgtctttccaatgagctaagtagcgaaatggtaagtccatgtattcaaaacctaagttcttccaatcaatcgttgacggttctggtgcttttgtcataaatgatgcctccaaagaaatatgtattgaactctcataattctaacgagaatttaataaaagtctagtcacattaggagaagatgtcaagtaagttttcaaaaaaatggacatgatactaatggtgctatttcaagtccgttgtataatttaaattttacatatttcgcttaatatcttctcattttttgaagactttcccaacagcttactttttaatcaggcttagcattctattgtcaacatctttgatttcttttcaattagggcgacttagtcgtaatctgaggcctagctcgccattgatataatctgtcaacatggaccaatgccttgctatatcaagccttaaaggataaaaaaagagctaccagaaaacatctggtagcttgaatatcacccgcacggggatcgaacccgtaactccgccttgagagggcgacgtcttaaccaatttgaccagcgggcaaaaatacaataaatagtatatcgataatagaagacagtgtcaagaattattcgaaagataattcaactaagtaacgtcccttagcgaccaagtgcgacgttgtcacccacacatcatgatagttaggaatctcctgctttgtcatgtcataaaagaaatccaataactccccattttttgcgacaaaatcaacactcaagcggttaaccattaacttttgatcgggaaaatagatatccgcgtccgcgaccttaaatgtatctggaacacttagtgtaatgacattaccataccggagaggttcagccgtaaatagctcaggttgggattgcatatgcgtcagtagatagtaaattgaatcagaattacttgccattttgtacttcctccttaattctctccctgtcattgtaccaaattagacttattttggataatttattattttttcaaaaagaatggttgaatctggtcgaatgattttgtataattattatcgttcgttagcgatagcgaagaaaatcattgggcattcgccaaattggtaaggcagcggactctgaatccgtaatttactggttcgagcccagtatgcccaattgtaagttgatctcggagccttttggctagcgatcaactttttttattcagtcgttatatatattttaagaatgttttacttgtaattttataattattggtatagcatctcttacaataatcataactgctttctcccagtttggttatgttaattgagtttgttttaagccatcttgccaatgatattttatatttttggaatattgtttaagaagtactatcctatacccctaatagcgaaaaaacgatccccattcaactgaggatcgttttttagtatcatccaattgtaagtaaagcaccctcgtgtagtaacgagaccagcgactgagtactgctgagttcgaggtgtagtgacagcataaccggcaccgagacaatgggaatgatgatcaatgtcatcagggaaaaccagcccagtcggttttcggcagcctcttgcggaccgatcgttctatcgaaggtcggcaccatcaactgcggtaaagcaacgattccacgctcaattgcgttgaatattgcatggacgaccgcccaagtcccaacaaccaaatagatgttgaaccatttattgccgacgacggttggtgaagttaataggtccggacgtaacagccacagcacaaaaataacgaccaatacgccaagcgatatcatcgccaacatccatttctttgtcattgttgattttgcaacccgctccattatccgacaccctctcaccgttagaatgcccaaaattatagcataaatattttgacgattaaacaataaaaataagacttttttataaatgaaaacattgtgaaaacttattcgtatccgttttcactgcttctttcatttgtctggaagcggattaaaactaataatatcaattaattccatccacctaattatgtcatcatttttatttccaccacaaaatgtattccctttagtgcagcaaaaaatattttttacacaaactagtcttgctcacgtttcatcaagttagtcgacacagaagcattagaacttttttcattttctaatcattttgccatttacaaatcttactttcaggcgtatgctaacgacatcaaattgatgttaggagtcctgatcaatgaatttaaccagcgtccaagttaacattattatcgaccatacaattaccaagtgtgggcgatagttttgattgtccgcacttctccgcggacagcgttggtttcgccaagagctgttttgttgctcttggcttttttatttgtctaaatcactaacatcaccctctaggaggcgaagatcgcaaatcatcgatcagttttttattgtacttaatatcaacgatatacataattgaggagtgaattatatggaaacagttacacctacaacattacatacgagtcaaacaaccaaactcaagcgagattccgttaaaaccgtcatcctagcatctatgattgggaccgcggtcgaattttacgatttttacgcctatgggaccgcggcagctgcctactttcccaaagtcttttttccaactatgacccccgcaattgcggtgttacttagtttgctgacctttggtgtttcatttgtcgcccgaccgttaggatcctttgtctttggtcattttggtgacaaaatcggtcgaaaaaaaacgttactagtttcactagttctcatgggattttcaactgtcctcattggctttcttcccggttacgcgactctcggcttttcagccgtcctactcctttgcctttgtcgcttcgtgcaaggaatcggtcttggcggtgaatggtccggcgccgtactagtcgccacagaaaacgcgcctaaaagaaaacgcgcgctctatggatcatttccagaactcggtgcaccattgggctttttcctctgcaatggcctgttcttcgtcttggaatcattcttaacccccgcacaaatgctaagctttggttggcgaattccttttttggcctcgttcgtgatggttgccatcggcctatgggttcgtgaaaaaatgcaggaaacaccgcttttccgcctagcgcaagaaaaacagcaagttacaaaatcaccattgaaggatgtctttagaactagctggcgtcaaattctcaaaggaacctttatcgtttcggtaacctatacccttttctataccctctcgacgtggtcattgacctatgcaacgaccaccttaggcttctctaatcgtgcttatctcttactactcatgaccgcaatcgttgtttttgccgccatgatcttagcatcatcatacttggctgatttctggggtcgcaaaaagatgctcatgaccatttccgctgcgctcgtcgtcttttcgtttaccttcccttacctcctcagtggtcagcataacactggtggggcactcacgtttctcgtgattggctttttcctaatgggcttcatttacggccctgtcggggccttacttcccgaactcttttccaccaaggttcgctactcggggtcggcactcgcatacaacctcgcagcaattatcggtgcagcctttgcgccaacaatcgctacttggctcgccgatacttggggtgtcaagtatgttggtctctaccttggtgtaatggccgtcttttccttcgttgccttagcactgaccaaagaaacgaaaaatattgactacactaagtaaatttaaaacggatgttgcatcttcttcatgcaacatccgtttttttataaccagtatccgcccgccagcagaatgcacccaccaacatacgtcgcaaaaacgtagtaaaacgccaaacgatagtagtgttgcttaattaacaccaccgtttccagactcaatgttgaaaacgttgtaaagccaccacaaaatccaattcccagaagcgcataccagccagtggttgcattaaaatgactcgccactacccccaaaatcagggctcccagccagttaatcagcagggtggccactggaaacgtactggcacgctgctgtttgatccacttagtcgtatcataacgggcaatggcaccaagcgcagcgccaccgccaactaacacgccactaatcatcgattgaagcctcccgtctttgattcgagcctaaccacattcctgcggccgccatcaaggtgccaccgataatactacttactatgtatgttaatgccaaccaccaatgctgactcaaaataagatggtaaacatccagtgtcaacgttgagaatgttgtgaacgcgccaatcattcccgttccaagtgctaggctcagagccgccggaattttcaaccgccgcacgatattgccagacagccaggccaacaaaaagcttcccactaagttgatcaagagtgttgtcagcggccactgaccagttggtagtagctggcccaccagccatctcaagacgccacccacaattgcaaacaggccaattaataattcgtccatcttttcccttctttcctaatcccatcagtctatcacaactcctctcaaaaaacacacccagaaagcgcgccaccaactatcggtgacgcgctttttagattgttcattatagatgattagcaacgtagtcaccaaacccgctggttgacaggatggtcgctgtgtcgtcggttgcgaaatcttctgtcacgtgatgacgcttaattgcggattggattccctgtcgaatcagcgtcgcgacctctgaccagccgatgtagtcgaacatcatcgtaccagataaaataatcgaagttgggtttaatcgattctgccccgcaaactgcggtgccgtaccatgagtggcctcaaagattgcatggccggtttcataattgatgttaccaccaggtgcaatcccaattccgccaacttgagctgccaatgcatctgaaatataatcaccattcaagttcattgtcgcaacaacctcaaagttttctggtcgcaacaacgcctgttgaaagaagttatcggtaatcacatcgttcacgattactttccccgcttgtttggcgtcagccaaggcctgatctgctacatcagcaccggcattttgtgcgatctgctcatactgtggtgttgtaaatacttgtcctgcgtactgattctcgagaaagtcatacccccattttttaaaactaccctcggtctttttcatgatgttgcctttatgaactagcgtcagggtatggcgctgatggttcagggtatgttcaatggccgccttcatcaaccgcttcgtcccctcactcgaaattggtttgatcgcaaatgccgcggtctcggggaagcgcaccttctcgagttgtccctgagatgcaagtaactgcttaattgcctgagctgctggcgttcccacatccgcttcaattcccgcatagatatcctcagtattttcacgaaacacgtcgatattgacccgttcgggatgaatcaccggtgatggcgtgccttcgtaataattgactggtcggaaacatgcgtataggtccaatttctgccgcagcgtcacgttaattgaacgatgtccctcaccgatgggcgttgtcagtggtcccttaatggcaaccagatcctcttttaatacccgtagtgtatcatccggaagccactggcccgtttccttaaatgcaacctctcctgccaacagcgactgccagctaacacgtcgcgccccctgatacgccttttgaactgccgcatcaaatactttctgggctgcttgccaaatttccggtccaataccatccccctgaatgtagggaatcatgggattgtctggtaccatcatcttcccgttgaccttcgtaatcttctccgctgtcatttttttggattctccttctcatgtcctggatagtgccgaccagtcggtcccacatactctgacgatggccgaatgaggcatccatcactttgttgttccataatgtgtgccaaccatcccgccgttcgacaagccgcaaacattgtcgtaaatgttgacttatccaaccccaagcaatggtaaattaatgccgtatagtaatctacattgggatgcagatgtgttttttcaaacatgtaatcccgaatttgctcttggaggttgaaatacaccgaattattggtctcgtctgcaatctgttctgcaattccacgtaaaattttggcgcggggatcaccatccttataaattcgatgaccaaatcccatgatttttttaccggccgcaattcgctcgttgacatagtcaatgggcttttgtccggtatgacgaatctcttctagcattttgaaaacttgctcgttagcaccaccatgcaaggggcccttgagtgcacaaacggccgccgttaaacaagaataataatccgcttgcgtggatgccacgacacgtccggtgaaggtggatgcgttaaattcatgatccgcgtgcaacaccatcaccgtattgaacatgctgacctgactcggtgtcgggcgtttgcccgtaaataaatacatgaagttttccacaacgccccattgtggattaaccttcatcagctcctgattgtcccgcaagcggatgattgcggcaatcgcagttaacatcttcgataaaattttgagtggctgatctcgtctaacatcattatgggtggtcccgagcaacgataccgtcgttcgtaaaatactcattgggtgttggggctccagcgccacatacttcattaaccgaattgtttcatccggtaatttcatttcatcaaccaactggtggcgcacctctttgagctgtgattcagttggcaatttcttatgccacagcaagtatacgacttcttcaaacggcgcatccttgagttcattaattgggtagccagcataggtgagaattgcgtccttggttgagctaattttagtctcagaaatgacgacccctgccagtccttctggtaatttcattcatacacctcctcgtactgttcacctaagcattcaacttatcatccacaattaacggtaggattccaccatgctcgtaataggtccagtcaatcggggtatcgaaacgcacccgcgtatcaaacttaacctgtcgcgtagcagtcgttgcagtcacgtgcgcgatctgcttatccaacttaatcgtatacgtttcggttccatctagcccgattgtggctgccgtttctcctggcaaatattctaggggaataatgcccatcatggctaaattagaccggtggattcgctcaaagctctcggcaataataaccttcaccccgagcaacttaacccccttggcggcccaatcacgagatgatcccatcccgtaatctttaccggctaaaacaagcaagggtgtctggtcatgcagatattcacgtgaggcttcaaaaattgtcgtgggctcgtttgttggtaagtaagtcgtgaatccacccgtggttccaggtgctaattcgtttttgagacggatattggccagggtgccacgcatcataacctcatgatttccccgtcgcgatccgtaagaattaaagtcccgcactgcaatcccatgatcttgtagatattttccagcaggggtcttagacccaatgaacccagccggcgaaatatgatcagtagtaattgaatctcccactttcgccaatactcgaatcccttgaatctcctctggttgttgatctgccgtttcaaagaacggcggtgacgcaatgtacgtagatgcagcatcccaatcgtacgtggcagacgttggtgcttccaattgattccaagtttcattttgttggaaaatctgttggtaattttcagagaattgtttgggtgacaggtactgacgcgttaaatcagcaatcaaatcgtctgagggccacaaatccttcatgtatactggttgtccgtcacgccccgttccaacgggttcggtcgtcaagtcgatatcacaggttccggccagcgcatataccacgaccaatggtggcgaagccaagtacgtatccttcacgagtggattaacccgtccttcgaagtttcgattaccactttctaccgccgcaattggatacgcatctgcactgagtcgagattgaagctcttcgagaagctgcccagagttcccaatacacgtcgtacagccatagcccactaagttaaacccaatttcatccaaatactgctgtaatccagccgcctttaagtattccatgacgactcgtgagcctggtgcaaatgaggttttaacataggccggtaccttcaatcccaattcaaccgctcttttggccactaaagccgcagctaaaagtacctgaggattagaagtatttgtacaactcgtgatagcggcaattccaagcgaccccggccgtaactcaaacgcctgctcattaaccatcactgggtaggccggcatgtcgcgacgatcatcaaactgctgtggcatttgcgctaatttcactaaatcctgtggtcgattaggtccagccacactactttctacggtgcctaaatctagggtttcatactcactatactgccgttgatcatcttgaccagactcgtaaaataagtggttttgatgcgcatattgttcaaccaactcaatcagtgccgctggccgatcagtcaattttaagtagtcgagtgtctgccgatcgattggaaagaacccacaggtcgcaccatattctggtgccatattagccaccgttgcccgataagccaacggtaaatgatccaatccctcaccgtaaaattcaacgaactttccaactacttgatgttgtcgcagtaaattcgtcagcgtcaacgctaagtcagtggcggtcacacctgctgcgagacggccgattaatttgacgccaacaaccttaggaattggcataaacgaattttccccaagcatacttgcttccgcttcaattccgccgacaccccagccaagcacaccgaggccgttaatcatggtggtgtgcgaatcggttccgactaaggtatccggaaaggcttcgaagctcccatcactttgttgcttggtcattacgaccgttgccaagcgttccagattcacctgatgaataattccggtatcgggcggaataactgttaaattatcaaaactattctgcgcccacttcaaaaatgtgtaacgttcatgattacgttcaaactctttttgaacgttaaacgcaaacgccgtatcatcccctgatcgatcaacttgaacagaatgatcaatcaccaaatctactggcacttcgggattgatcgcctgcacatcgccaccctttttagcaatcgcatcgcgcatcgccgccaagtcgactaacgcggggaccccggtaaaatcttgtaaaattacccgttcgggtttgtaagccacgtcagcatcgtgttggtcatcccagtggactagcgcagtaagttcatcaccttgggactgattgtgattatgccgtcgaacggctgcttctagtaggatgcgaattgtatacggaaacttatcgacatccacctgatgctgagctaaaaactcggcaatatcggcaaatcgataagtctgatgattcagttgaaaactattttcatacgtggtattcgtcaaatttatcaccatctttcgccttaattgaaacccgatttacatcttctaatttttctctcatttaaatcggaatagtctcaatctaaagcaagtaaagggtttcgtcaagttagacgatgtaaaccagttgcatcatttctaattaaaatttaattatagattagttttacaaacttttcttaagtgaaaatcccctccaagtttatgaatcaacaatatctcacattttcatgtcatcgttataaatttttttatactttaacgcaaaaaaagaggaagccagtgcttcctcttttgccaagtctgatttgactagttcaatcgtgcccgtaatttatcaccaatttcttcaaatcccggcttgcccaataggccaaacatattggtcttgtaggcttccacccctggttggttgaatggattaataccatttaagtagccagaaataccaatcgccacttcaaagaagtaaatcaggtatcctagtgtgaattcatcttgttgtggaatattaacggtcatcactggcacaccaccgtcaacatgggccaaaacaacggcttggtacgccttggcattaacaaagtccattgtttttccttctagatatcccaaaccatcgagatctgtgtcttcacttggaatttcaacatcgtgtactggttggcccacttttaccacggtctccatcaaattccgctgaccttcttgaatatattgccctagcgaatgtaaatcggttgagaagttcgcagatgatgggtaaatgcccttttgatccttgccttctgattcaccggccagttgcttccaccattcggcaaacattgtcatcgttggctcgtaattctctaacaattcagttgtgtagcccttccgatataaaatattacgataggccgcatactggtatgcttcattttgactcaaatcaggattactgtagtcattttcagccgcacgagcaccagccattaattgatcgatatcggcaccagccgctgcaattggtagtaatccaaccgcagtcaatactgagtagcgacccccaacaccgtcaggaattacaaaggattcatatccttcagcgtctgcttccgtctttaacgcacctttttgacgatcggttgtggcgtaaattcgtgtcttcgcgccagcttccccatattttttaattaacaattgcttgaaaatccggaaagcaattgatggttcagtcgtggtaccagacttcgagataacattcacagaaaaatcacgatcgccgatcaagttgatcatgtcataaacatatgatgagctcagtgaattacctgcaaacaaaatttgtggcgctggacgatcctcatccttttgagcttggaagaaggccgtgtttaaaaagtcaatggctgcacgagctcctagatatgaccccccaattccgatgacaaccaaaacctttgaatccgactgaattttcgcagcagccttcttgatccgcgcaaattcgtccttatcatagtcggttgggagatgaagccagtcgatataatcggcaccggcacccgttccctgacgtaattgatcgtcagcgacgttcaccattgcttgaagttcgccaagttcattgtcatgaacgaacgtttttaaactgctactatcaaatgaaatatgtgtcatctataaaacctctttcttttcgaataattggtatagatattatcaaatttacaagattcgccttacaaagtaatattctaccgcggttattcaattttcacaaccgaaaacggaacaaaaaaagataattggtatacttaaataccaactatcctttagaattattcaacactttgatgttttgcatggtcccgatcagggaagaatacagtaaacttcgtccccttaccagattcgctatcgaccttaatcgtcccaccgtgcaaatcaactaattgatgcacgattgccagaccaagccccgattcgccatatttggtgttcatccgtgaacgatctgctttatagaaccgttcccaaatatttttaacctgatcttctgtcatgccaattccggtatcttgaatactaaattcacttcccgtatcggtttgacgaccggtaaccgtaatcgtaccattttccgtaaactggatggcattttgaataatattaaacaaaatttgaacaaaacggtcgtaatcggcataagtcatcaccgtcgacggcgtttcaatttcaattacgtctccctgggttgcagccttctttcctagttgagcactcaaattgttcaacacatcagcggcattaaagaccttccgagacatagaaatttggttcgtgcgaattttttcatagtctaaattatcattgaccagccggatcaaccgtttcgtatcattttgcattaacttgatactattcgccttatcctcttctggaattgcatcataggctaagccctctagcagtccgttgatggtcgtcaacggcgttctcatctcatgggcagcgtccgccataaactggcgtcgacgctcttcttgccgcttaatttcttcttgagattcctgcaacgaatccgccattttattgaaatcagtggacaagtcactcagctcatcgctaccttggacagccaaatgtacattatagttcccctgagcaatctgatgcgttgcagagcgcatcttatcaattcgacgagtcgtcgagcgggccaaaaggtaactcaaaaccaacgcgatcaacgatgaaatcacaaacgcaatccatagattactgcgaatttgctgcatatttccttgaatatcggacacaaacgacccaatcgacacaactgcaactaatttgcccttgtagaagtacggtcgcaagacatccgtcattaatggtcgactactactcttagtcgagcttgattttttcggctttttacttgattgctgctgattggtcggtcgtgacaaacgatcctccatcttatgaatcgtcttaccagcctttagctttttccaatcggcactggtcaacaccgcagaatagtttgagctggaataaatgaccttatccttggcactataaatcgtaaaatgcacgttttgacgctgtaacagctgggcattattttcaagtggtacggttgtgaatccttcaaactgttgcgttgcggtatcataacgcatcgaatcttcaatcaaactatcagaataactctgcagttgcttccaggtgttggtgtaaagcattcgactcgttacgttgatgaacagcacaccaacaatcacaattaaggttaaaataacggcaaagaaacctaacatttgccgataaattagtttcattgtgtcactccattgtcatcaaacttgtagccaacaccccacacagtctgaatcacctgaggacccaccttttcgatcttttgacggagctttttaatgtgcgcgtcaaccgtccgttcatcaccatagtattcgtaatcccatacgagttgcaatagttgttcacgtgaaaagacttggcggggcttttgcgctaaggtcttcagcaaatcaaattccttcggcgtcagatcttgtacctgttggtcattcaggtaaacctcgcgcgtcttagtatttagtttaaagtggtcagtaatcacatcgaactgctcgtcgttattttcatcaatgacgttaccgatcgtattcagttcactccgacggtacagagctttgattcgtgcaatcagagtaattggactaaatggtttggtgacgtagtcgtcagcgcccatttccagccccaacacttggtcactttccgaatcacgtgcagtgagcataataatgggaaccgttggagacaggcgccgtagttctgcagccacctgcattccgtccattttaggcaagtttaagtcaagggtgacaatatcccaccctttcacatcgtcttgaaattgttgcacggcttcttcaccgtcatacgcaaagtgggcgtcccacttttccttcttaaaaaacatggccatcatttctgaaactgacttattatcttcaaccattagtattttcataaattatgctcctcccgaaagcggattatctaagttttagtatacggcttttacgccttttttaatagatcattactttaacaatcattattttactaaacacttataatgatttattgataagaatgtgaagaaaaaacgatctttacttcgcccgccctattgtaatcgataggtcaaattacgttgaataaaccgtgcaacatggtcctgatagtctgctggatcgatccaaaaactctcagcatgggtcgcgtttttgacaatccacttctcttttggcccgcgcgtcgcgtcaaagttagcttccaccatgttaagcggcacgtatgcatccttttcaccgtgaataaataaaatcggtcgataattatggcgaagctggttaactgatgacaccttttttagattgaatccttgccgataaatgttgatcgcactgactgctggtaaaaaaggatatttgggcaaatgaaaagttttcttgagtaagtaactcatctcatcatcaatatttgagtaaccacaatccgcaatgatacaccgcacttgttctggtaatggttcaccactcaacatttccatcgtcgccccacccattgaaacgccaaacaagacaattcgagcgtctacgccagtttcttgaatcacccgctgaatccagttttgataatcaagtcggtctaaccaaccaaatgaaatgtactcaccgcttgaatgcccgtgggcccgatcatccggtagcaatacgttaaagcctagctcatgaaacatgttggcatagttagccatagtttcaccgttgcccttatacccatgagccacaatcaccgtatccgtagtttcctctgccgccggaatgtaggtggcacttagttttaatggccgatcagacgcctcaatttcccaattacgcgttggttgtgtcttgagccagttcacataatggtagtattgatccgcatatttttgcttctcagccgaagtttcagggacctcatcaacccgatgaaatgcaaatttatatagtttctctgctgctcccatcgttcccgcagcaacaaaaagtggcgccatcaggcccattgcagttttctttttcattttcgtctctcctataatgttgccaacatcatcatttataactaatcattttactataaaaagttgattaccgtcattcaatcgtcttcagtattactaaaacataatatttgcacgcaaaaaaataagaataccatcactgatattcttaactgtgtcacctacgtgacccattataaatggagatggcgggatttgaacccgcgtccaagcatatcgccattccaacctctacgctcatatctcaactatttaagtttcgccaatcaaaacgccgctgatcagggctttcaagattcgctagtccgattagtctcttctgattgctcctgactgaagctcacagcgtaagttcactaaatttaggacccagtaacgagccgtgaacaagcccggctggatctacacccgctactatttaggcagctaaagcgtaagagttgttattattttttgcagttataatttaaactgagcgtttttacgaagacgcaaccttcgaagcgcagttgaaactcgacctatacctgtcgaatccataaacatccccatgtctacagctgatattgtaacataaccacacctaaaatactccattttcgctcaaaaaaggctccccaccaatcgtgagaagcctagttaatctttaatttaaattttagtaccagccattagctacccagtgtgctttggcagatgaccatgaaccataacggctcgttacgtactggttagcaacccgctcttggttagcagcagaataatcaccatgcaagtagctggcgctcaattggtacttaccaacgtactgtccgttacgagcaccgtagtttccacctgattcgcgtccggcaatccatgccttagcagaagcatccgaaccactagcagcagctgtcgtactctgcgttgtcgtgctttgagtggtggctgtttgcgtgttagttgtggtagtggtaggtgttgaagcaacttcggactgtgttgcttgcttgatctcaccattactcttgatcaataatttttgaccaacataaatcacattaacatcattaattttgttttgttgcgcaagatcattcaccttgttcacatcatgtgcataagtcgtggcaatttctgataaagtgtcgcctgctttaacagtataaatttcatcagcgtttgcttgaactgtagtggcaacaacgcccaatgctgcggctcccaatgctgttgctgaaatcttcaggatgttctttttaatatccataatttatatatccgcccctaatttttaatacttcttttcttatcaacggtgcatataataacgcatagatattactaatctgtaacatagagatttctttttacattaattttgtcatgttggtaacaattagaaatacttttcgataaaatctgccaccccatcgtcatcattagaaagggttacatcggttccaagcgccttaatgtctggtttgccattagccatgaccacaccgacctgcgccgcttgtaacataccactatcattttctgcgtcgccaaacgccatcaaattttcgaatgtccaaccataatgtgctaataatgcttttaaccctaccgctttatccatatcatgatctaaaaattcaagaattttaggttgcgaacgaacaatatgatattgagctgccattgccggtgtaatttcctgagtaacatgatctaaaatctcggaatcagttgccatgaccactttactgtatggttgttccttcaaatctgcatacgattttggaacaaaggcaatgttagcgttcagcattttctgatagaccgacggcgtcaagtcagttaatggataaacttgttcgaaatcaagaacatcaagcggatatcctccttgaacgcaaaaatcatgcagcaacgccaaattatccttattcattccctgcttagccaatacttgccgatctgggttctgaattaccaacgcaccattaaacgtaatggtgtagtcgtcggcaccggtcaagccaagctgttcaatatacttccaaattgcattaattggacgtcccgtgcatagcacaactttgattccctgcgctgaaagttgtttaagtacccgttcatttcgagcgctaattttcttatctgtggtcagtaacgtaccatctaaatcaagtgcaaccatttttatcattgtctgtcatcctccatgtacctaaatttaacatcatttttagaataaaaaaagagctgtcaccaattttagttggtccgcaactcttcttatcttccactactttgattcagacgatgcctgttgttcaatcttatcttgatttacaatgcgccgatcaaaatcttccagaaagtctaaaaattcctgggctttttcttcaccgaaaatttgaacccatcccgtaaaacgatcagtcacatcctgactaatttctgcttctacgcgcttgccttccttcgtcaaatgaaggaagagtcggcgccgatcattggggtcggcccgctggtacacgtatttgtgattgagtaacacttttatttgtcgcgaaatggcacttctcgttacctgtctttgttcggcaatatccatcaacataatctttttttgtgtcgcgatatcatgtaaaattaagtactgttcgaaagataaatagtacttcgctgctggttcagaaatgaaactgtcaagagactttagcgtcgacatgtacagactgattgctctgttcaataaatcatcagaagccattgtaatcaccttttttccgatcatcaaaatttagaattgaactcattcactatagaatatgctacactttaaccaatctgtcaactcattaatatttaggggcgttaacttttgaatctaaaaccaatccatcaaattgaacttaacctattggaaacttttattatgctttgtcatcagtattcgcttaactattttctaatcggtggctcattactcggggccgttcgtcatcaaggatttattccctgggacgatgacttagatgttggcatgccacgtgaagattacaatcgctttttaaaagttgcacccgttgtgttatctcatagtgcatattttcttcaaacaccatttacggatcgtaattacggccttagctacgccaaactgattgacactgaaacccagattgaagaatacaataatatgaaccatgccaaaaaaggcctttttatcgatatttttcccttcgaccaaatttctccatcgtccggtgaacggacatcacagatggctaaactcaaactccttgatggttccattctggttcgccttggatatcacatcgttgagaccccactttcccagatggcgcgtcccttaacggtcaaacaatataatgccgttcgaacgctcaagcataaacgtgaagcactcatgcaagcgttcagtgccccgcaccagtccgatgcagcatttaaaaatttggcatcgcaatacggctacgataaagaaattttatcggctgatgaaatgactcatctaaccccacaccttttcgagcacttaaccgttaatattccgacagcctacgatgccattctgacacggatgtacggcaactaccagcagctacctaacgccaatcagcaagttccaaagcattttaagcatgtcagcattaataacgatctattattttaatgattaaaagaagccccggagaaaccatctccggagcttctttacatttctaacgcacaacgattactgaacaaggagcattttgggacatataactagcctgtgaaccaataaaaatactacttttatcttgtgtttccgaaccgcacaccaacaaatccggttgaaattcaggaatgatctcacgcacaatctgtttcccgggttttccctcccctaagaaccgactcacatcatccaccccaaaatcttgagccttttgaacatacgcatccaccgcggccgccatctcttggcgttccttttcaagcacattaggttgtaagctgtcgtagacgcttaaatcgccagtttcaaggatcgtcacaattcctaatggtaccttatatgcatgtgccagtgtcacggcataacaaaatgcctttcgcgatgaactagaatcatcctcatcaaccgcaactaggatcttcttaaacgtcattggttgcacatcgaaatcaatctctgtttttttcattatctcgctacctgtcttttaaaatttgcgtcacaattagtcgtgtgtaatagatatttcctttatcactgggatgaacattatcactggcaaaccagctcgtatgccccttactgtaactgtaccaatcaataacatgcacatttttgtgggcttgagcagttttttgaatcgatttattgaccgtattttgccaatttttagtcggaacatgggccgtgacccagtataactgccgcttactgccgactgccgacaaaatctgttgaatcgtttgttcacttaaggccccatttgttcccaagttgatcacaaccacatcattcaaatgccctttgttggcaagttgcttaatcaaggctggtgcctgatacccctgacgtcccacctcagcattcacgtatgcattgggcacaacctcttgtaaatcagcagcaccatcggccaataccgaatctccaactgctgttattttgagtgtctgagctttcgttgcttgtttttttgtcaatccatacttcttttcaatggactgctttttaccggatggattaggtaccggttggcccttttcaattgcatcattacgtgctttaacttgcttggaactcttctcaatctgagtctgcacgtgattaggtttgggtgtttgtggcttcaggaccattcccaccacaaaaacgatactaaatgcagcggtgatcgccgcaccaagccattttttccagccagcattgcgatcaaatacatgccttacatcggacattgcatggtgccaatcatagtgcagcaagggttgttcaatccaacggtacgaggcttcactaatcaggagaataataattaattcagccaacgcatttaacacgggatggtcacccattgatcgaacgcgggattcgtaaaagaccattactgggtactgataaacataaattccatacgaccgttgtccaatccatttaaataccggattggtgagccagccgttcatatggcctcccggatgagcaattaccgccattaagatcatggcgaacagggtaaacacaaacatgccaccaaaataggtaaatggcgcctgcccctgcaatacaaaatataacaacaaaacaattgccagacagacgattcccgttacatccaaaatgcgcgtcgaattcttcgaaatctggctttttaagcgatctaccggccataccattgccaaccacgcaccaagaaaaatggcaaagctccgtgtatcactaccatagtaagcacgattaatattagttggatcataaaagactgccattagaatggctgaaaggatggccagtccaaagataattccttgaatcaatgattttcgtttaactaacattaccagtagtagtagcaaaatgggccaaattaaataaaattggccttcgatactcagtgtccacatatgcgtaaatggcgactcacccgcaaatcgatcaaaataggattgcccatgaccgatctcccaccaattataaatccacagcaggtttgttacgacaatacttcttaaatcctttaatagcacccgttgaaacaacgtaatatacgtcgtactcaataccaacatcgcaatgagcaccggatacaaacgtcgtaatcgtttcaaataaaacttaatcaggtggattgttcccgttcgttgaacttctttcattaaactgccagtaattaaatacccagtgagcagtaaaaaaatcggaaccccgagatagcctccctgaagggttgccggtagtaaatgatacacaattaccccaatcaccgcgagtgaacgtaacccgtcgaatccggtaatatagcgtctttttcccaactgctgctcctcaaatgatggatgcattcttgctccccctaaaaaataattccgctccattatacttcacttttacagggattagtagcaaaaagagcaccgtcatcattgctgattagcgcacaaaaaaacactctatttctaaagtgtttgctagctgccccggtagggttcgaacctacgacctcttaattaacagtcaattattctaccactgaactacggggcaatactattaaattataaaacaggtgctctcacaccgactgccccggtagggttcgaacctacgacctcttgattaacagtcaattattctaccactgaactacggggcaatgaaaacacataactatgaaattataaccggaaatcacaaaattgtcaaagactaatttcatgatcaactaaatttgaagaaacgtttgctttcttcaactgccccggtagggttcgaacctacgacctcttgattaacagtcaattattctaccactgaactacggggcaatgttgttaaacaacatcaattattatacaggatcatttactgacttgtaaagcactttttaagcaatatggttttcttttaaaatatttcgtacaacttcctctgcttcttccgttttcttccattcatcccaatgatccatcgattcgtcttgcatcacatagtgttcattgacgtagtcctcatattttgcaacattttgggaatgcgggatattgagctgtaaaatgcgtacttcttgaatgaaacctcgttcagcagctagctctgcccgtccattctgaaccatgttaccaatttcaaaatacgttgacccatcttcgcgtgtaatttcttcgatcaagtctaatacttcatgctgtgccattattcatcctcctcaatctaaactgccactctattttagagaagttagtgatacttgtcaaaaacacaaaaaatcaccgttcgggaaaaacggtgattggcataagagagaaagagaattgattagaaggtaaatacttaataccttacgtcaattataataccgcttactgaaagcgctgtcaacactaattctcaacttttcctttttttatttgatcagctgccgcttcatcaacgataagcgtgacgttggaatgttgctgcagaatgcttgctggaacggccgtcgttaccggccccaaaaccagctttttcacagctgctgcttttgctttgccatacgccataataacaatctgtttagcagccataattgatttaattcccattgagtacgcagatcgcggaacatcagtggattgtgcaaaaaagcgcgcattcgccgcaatcgtcgactccgttaactgaacctcgtgggtggtactctcaaacggcgttcccggttcattaaacccaatgtgcccattttgaccgagtcccagaatttgtaagtcgattggataccggtcaagtatttgatcataccgctgcgtctccaccgtcgcatttctattcatgccattcggaatgaaggtttgctgaaatggctttttactaaacagataacggttcatataatatgcatagctttgtggattttcttgatcaagaccaacgtattcatcgagattaattgcaatacaccggctgaaatctaactgacttgcgctaagtaagcgataaagagtctgtggtgtccctcccgttgctaacccaaatactgcctgttcatgacgatctttgagtgtttgttgaatcatcgcaactcccttattagctccctcaactggcgtctttacaatccaaattttcattacgctcacacccctatatggtatagtccaattataatttgattcagtaatttaagcaactccaacgactgacgtgcctactttccttacagtccctaactaacggcaactaaaaaggcctcttttggtcgacaaattaaccaaaagaagtctttttaacgcatttattaatgcaaaattaagttcaagaataggaccatcaacagtccggtgatcgaaatcaaagtttccaacaccgtccaaatctggaacgtttgtttaacactaagttcgaagtattccttaaccatccagaatccagcatcgttaacatgtgatgcggccagtgagccggcaccaattgccaacgcaatcatgacaggatccgcacctgttgattgcatcaatggaatcacaagaccagaagcagtcatcccagcaacggttgctgatcccagtgagatccgcagaattacagtgattacccatgctaagataattggtgataggttaacattggccatcaattgttgaaccgctttaccaacaccaccatcaatcaaaacttgtttgaaggcagcaccaccaccgataactaagagcaacatagcaattgacttaacagcatcgccgattgaaccactgatatctgacatcgtcttaccacgatggaagcccattgaccacattgcaaacaacaatgcaattaccatcgcaatcattggattcccaactaatgttacgaaagcagcaaagccatgaggatgagttggtgtttcgccaccctcaaacgcaatcgaataaattgtggcaataatcatgaaaataactgggaaaagtgatgttaaagctgaaataccaaagcctggcgtttcttccagcttgtatttcttaacagtaattccgggtaatgatttcttaattgtaaatgcagatggtgcatacatttgtgccaacttagtaaataatggtccggcaacgatcacacacggaattgcgacaataatcccgatcatcaataccttcccaattggggcacctaaagctgatgcaacggcagttggtgctggttgtggtggtaaaaatccttgggttgcagacaatgcagcagccattgaaattccaagataaagcattggtacttctgcttccagtgcaattgaaaagacaatcggaatcaaaagaactagcccaacttcgaagaacatcgacatcccgatgataaatgaagcaaccacaacggcaatttgaagccgttttttaccaaacatatcgattaatgttttcgcgatacggtacgatccaccggcatctgataccaatcgaccaatcatggcaccaaacccgaagacaatggcgagttcacctaacgaactcccaatcccgtttttgattgacaccgcaatttgtgctgggttcatccccaataaaatcgctaccaaaattgaagttacaattaatgacacaaacgtgttcattttaaatttaatgattaggaacagcaaaaagataattcctaacaataagacaagaaattgcatgttttttctccttctaaatatcactctaaagatcgtttcgcaatacggccaattatagcaaaacgctttcaaatttcaacagaaaaatgtaaaaaatttaattgattcttgtaaaaacatgtaaattattttcgcaaacgcccttggtgataggatttaatgacttcaaaacttttttcgaaaaaatagtaaaaatttactaaattccaattatttcttgcgattttataaaaaaagacgattctgatttgtataaaccagaaccgtctttgtgtatattttaaagtactatcttatttagaaattagcgttcaactattgaaccgttaccgattttgctaggttacgtggcttatcaacgtctaagcccttccctaagctagtgtaataagcgagcaactgagcaggtaccacactcagcaaaggtgttaataatggatcaacatctggtaatacaatcgcatcatctggctgtgctaaatgtttagccgcaatcgttaacacactagctccccgagaaaccacttcttgtaggttgctccgtgtcaacccagctgttcgatcctgcgtaataattccaattactggcgtatgttcttcaatcaacgcaattgtgccgtgctttaattcaccagaggcaaacccttcggcctgaacatatgaaatttcctttaatttcaaggctgattccaatgcaacagaccaatcaattccccggccaatgtaaaaggcatttcgtggttccgacaaataccgtgacgcaattgactccaatttttccttgccgtcaactaatgcttgcatccccaccgcaacaattcctaattgttgcttaagatcaaattcagtggctgcttgctgatcgcaggtcatgcccagtgccttagctagaatagcttgtaatgcaacttgggcagtataggccttcgttgaagcaaccgcaatttctggtccggcatgtaacaacagcgtatatgaagcttcacgagacaaggtggactttggtacgttggtaatcgtcaaacttggccagccctgcttcttaatattaaccaacacttcacggctatcagcagtttctccactttgtgttaagaaaatgaagaatggtttttcagacataattggttgttcataagcaaattcagatgaaataaagacttgtgttggaatcttagtcaatcgttcaaacattctggctccaactaaaccggcgtggtagctggtcccggcaccgataatatagagtcgatcggcttttttcatttcattcaataatcctgcttcaatggttgggcgtccatcttcatccaaatattcttggactaatttacgcatcacagcaggttgttcgtcaacttcttttaacatgtagaatggataagttcccttatcagcggcactggcatccatatccacacggaaagtatcacgcttcatttcattaccttcaaaatcatggatcgtcaccttatcaggcttaacgatgacaacttccttatcttgaatttccataaacgtatgcgtttgtttcaacattgccacagcatcagaagcgactaagttgaacccatccccaattccaactagcaatgggcttttgttttttgcgacataaagcgtgtctggtgtttcgcgatccatcagcacaaaagcgtacgatgaatcatcgttaattaaatgcagtaccttaagaaaagcagattgagtatccatcttgtagtcaacgacaaaccgatcaatcaattgggcaattacttcggtatcagtttgactgacaaagttaacgtcagcaaggtattcctgctttaattgttcaaagttttcgatcacaccattgtgaactaagtaaaagcgctcgtcagctgaaaattgtggatgcgcattgacttcgctcggaaccccatgagttgcccaacgtgtgtggccaattcctgccgtccccgcaatgtcatcagtcagggcattttttaaattagaaatccggcccactcttttaacgaggtagtcatttccagtttgatcatttacataaatccctgctgaatcatatccacgatattcaagccgttcgaggccttcaatcagtacagatacgctttgctttgttccggtaacaccaacaattccgcacattatgcttaccatccttttttcgtaaaataattggtttgagtcgttaattggtatagatcgtaaagttaattttataacacttgacaactacatataataaagatatttatcatcaatgtcaacggattgataaattggtctataacgatgatgacttttttactagtaaaaaagtgttctgtcagaattaaccgacaaaacacttgttttaaccctatttaagaacctttttggcaacctcagcaattctcgcaacgtactgatgaacactctcttttgttggagcttccgccataattctcagaagtggttcagttccacttggtcgaaccaaaacccgaccatcaccggccatgtctttttcgacttcggcgatgatgttcaataaatcttcattcttcaaggcagcttgcttgtcgctaacttcaatgttaactagctcttgcggatattcagttacttcagccgctaattctgacaacggcttacccgtttgcttgatcactgataacaattgaagtgcggttaacatcccatcaccggtggtattgaaatccaagaatataatatgccctgattgttcaccaccgagattatagccattcttaaccatttcctcaacaacgtagcgatctccgaccttggtcttaacactggtcattcccgctttctcaagcgccttgtacatccccagattactcataacggtcgtcacaaccgtgctcttctttagacggcctctttgatccatgtatcggccacaaatatacatgatcttgtcaccattgacaatttcacccttttcatcaaccgcaatacaccgatcgccatcaccatcaaaagcaattcccacttgggcaccctgctcaaccacgaatttttgtaatgcctcaggatgggttgaaccacagttcaaattcgtatttaacccatcaggtgacgttccaattgtttcaaaatcaacgtccatgtcagcaagcaacgaagaaacaaagccgcttgttgccccattagcagcatccacggccacctttaatccagacaaattgtctgacagggtctgctcgaggaattgggtataacgcaacgcaccctcatgataatctgaaacgcgcccgagaccttgtgcacttggccgcggtaagtcatcgccaggcttgtccaaaagcacttcaatctcagcttccatttcatcagataacttgaagccatcattgccaaagaacttaataccattatattgaattggattgtgtgacgcagtcaacatgacacccgcatcggcttcctgagcgcgaactagataggccacaccaggggtcgtgacaattcctagtcttaatacttcaattccaaccgataggagtcccgcaattagtgcactctccagcatctctcccgaaattcgtgtatcgcgtgaaaccaacacttgtggttgttttcgttgcgaatgttgtgttaacacatatcctccggtacgtcccaacttaaacgccaattctggacttaagtcctcgtttgctacgcctctaacgccgtcagttccaaaatactttaattccataatgtttttacgttccttttctttttaataaaatgaagtatcaactaattcgaggttgaactactacttgttgatgaatgactatcctcactgctgttactattgctgctactctgatcactactactgctactgtcgctatcgctattatcacttgtagtactatgaccactgtcaccgcttgaactgctacttgaaccagctgcactattttgtttgctaatcggaattttaatcgtagtcgtttgtggtgtaatcacgacattgaccgtattgccattcttatcaacggcctgtaaagtgacctgtttagaaatatttgtcttgtccttctttgacaagctaacagatgcgacgacatgatcgaccttattaacttcggcaatggcaccggtaatttggacattgtccgttgaagtggtagctttccccgccttataaccatcggctagctgagaagtatccactttcgtctgaacggccattgattccgtcttccgtgactgaatgagtaccgtaaactgtttaggcttaaaatgatacgttaaatcattgttcagtcccgtctgttttggtttcacaacatgtttgcccggtcccaatgaactcaagtcagcatataccttaaaattctgtgtattcgccgttgctgtcaccaatgccgcgggacccgataccgtaaccttcacattcttgggatatccggatacgatataacgatcactatccactgttaaatctagtggcatcgtcaacgtttttttcttggttgaggttaatgacgttgtttccgtatttagctccgttttatgcgtattgccaagtttttctccattgacatagataaaaagaagtacggctaaaacaagcgcactgattctgaaaaaccaccgggagttaaatggattttgcggtttattattttttttcattccgcgaccctcctttgttaaagaagccctcgaaaaactcagtaactgcatttcgactttcggtttccttaacatacagctgatcacgtaagaacttcaaataagcctcgcgatccatgctccgtagtaattcgttgttcttcgtaattgaaatctctccagtttcctcggaaatcacaatcgtgagtgcatcggtgacttcactaatcccgacagctgcgcggtgccgggtacccaactctttaggaatcagattactttcagacaacggtaaatacgcagcggcaaccgcaatgcgattattcttgatgatcacagccccatcatgtagcggagtatttggaataaacgtgttaattaatagtgccccagaaacttcggcatccattggaattccagtttcaatgtactcctctaatcccgtttccatctgaatcgtaattaatgccccaattcggcgcttcgacatgtattgaagggcttggtctaactgattaatcagagcctcttcttcctcattttcgtgccgatttcgggttagtaacgttccacgaccaagatgctcaagccctcttcgaatttccggttgaaagatgaccacaatcgcgatcaccccccagttaataatttgatccatgatccaagaaactgtccctaaaccaacgtaccaactcaccaacttaacgatgatgatcacgatgattccacggaacagctgtactgctcgcgttccacgcaacatcataatcaattcatagattaaaaaccagaccaccaagatatctactaggtggatcaagttctgccacgtgagtagtgagctccaactaaatgccatagcactacctccaaaccaaactcagttaacattatagcatgtcaccaattaagtttaaaaaaaacatcgtttcctatttattaatttattcataaaagtaatcacatcggtttttattacctatttttttgttaagctagatgagtatgaggaggagttttatgcataaagtaaccattaactggcaaattcgattcttttttctgattttaatgattttcctactattatttgccaaatcaccctttaactttttaattttaaacaccattttaggatatattcccattgaactgggatttcatctacaacgcactaactcttcaaaatcgctctttttttggttgatgactattatttggttgctcttttatccgaatgccccctatctgctcaccgacctcttccacttagcgctgctgaatccccatattggcaattcgggactccttaaatctgatcccacaatttggttcaacttctcactcctgctcacaagtgccctgagctgtactttaattgccatgaatcaaatgattgattttagtattcgcctgcagaagctctggctccccaaacttcgattttccgcatggggatttatcgtggtcatgtgcctgttgagtagtattggcatctatatggggcgatttctcagaatccactccctttatatcttgcttacaccaacatggtttacacaccaaattctcaccatgtggtccatgaacatggtcaagttcaccattttattaaccatctgccagcttgttatttgttggttgttgtacaccattcgatatcaagcacaaaatgctactcgtcttcgctgacgagtagcatttcattttccgaataattcacataggttcgtagtcgttgcgctgtcattttggtaattcgttgttggccgacaagttgtaaaatgccatttcgttgtgctgctaatgctgcaactcgaagaccttcaagttgttgttgataaacttcctgtttcttttgtttaggatgtttgatgcgctcaattcgattgcgataactgacgatcaaatgataaatagcctgccgattaacttcttcgtcgttcttggccgccactgccacatgcttagacagggcattaatcgcggccttcgccgtttcaatatcaattcgcttctgtttgactgaattaatgttattgtaaccgagccaccacttcaccaagccaactagattatgaccccacagatacagccgcttaatcgaccaccaacgatccttggcgttaaattcatgcgctaatcgtttttccaactggtcaatgtgttttagtgcttcataatactcatcagtattaataaattttttctctagcatcttgataagcgcatcacgctcaccttcaaaggccacttgccgcagggccatttcttgtgcaagtagtttgtggagcacatcatctggttgtgatttcagctgcaatcgccgcatgagtaattggtagctcagcatcaaatcataggctgcctgttgattttcttcccgtcgatgctcttcaattgcctgcacagccagctgcatcaaaaagtatttagcttcactatccgttaaataccgttgatccttgtcttcctcttgttcttcttcttctaaatcctcttgttcagggtcactgccccgcgtcaaaaatgaaaaatcagcctgcgaaattaacggtaataaaatggccgctactaagagacttaaaataatgacgcccgccgcgataaacagcattaatgaccgttcaggaaaggccttgccgttttccatcaataatggcaccgacaaaaccccagccatcgtaatcgcgcctcgaacccccgaaattccagctaggaatgctgaacgaacgctaaccacatgttgatgatcctttaacttacggtaagattcgtaaattaaaatccaaataacacgaattgaaagtaatactagccacgcaataataacatccaagaatgcggtccaattgctgatgtcgccactttcgagcgaatccgtcatggcaattggtaattcgattccaagaatcacaaagacaattccgttaagtaaataaacaataatgtcccatgtcttttcggtaaccaacagtaattcgggcatttcctccagcacttgcgtattggaatacgtatttgacacaattccggccgaaaccaccgcaatcaccccggatgcatgaaataactcttcaaccactaaataaacaacaaacggggtcatgatcttgtacgcaacgttaaaaatgacgtcgttaatgccctgattgcgtagaaaatctcgtaccagttggatgacaaacatcactgctaccccggcaattaacccaattccggctgtatataagaagtctcccgctgcttgtgttagcgaaaaataaccggttgtaacggccgccacagcatacttaaacccaatcaaccctgaggcatcattaatcaagctctccccactcacgaggtgcaagatgttatcatctaactttgctcgtttggcaatcgattgaacggccaccggatcagttggtgacaaaattgcggctaacgcgatcgccacgggtaatggaattcgtggcacaaataaataaattaagtagcccccaacaattgcggtcacaaagactaaaataatcgcattcgcaaaaattgggcctcgcagtttccataactcctgtttgggaaatttacggccatcattaaacagtaacggtgcgataaacagcagtaaaaaccagtctgtctccaacggaatcttaacggcaaagattagcgccaccaataacccaagcgcaatttgaattaagctaactgggatctttttgatgtagtgactacaaacatttgatagcagcaccagaacgattaataaaataatagcttctaatatcggcaaacgttttctctccttaattttttacactgtgaaaaaaatgagtggctttcacgccgctcattttactgacgtccaatcactcggacttccgtctctaattgtactccaaattgtcttgacacttcatgttgcacatgatgaataacgtcgacataatccgtcgccgttccaccaccaacgttaataataaatccagcatgcttcttagaaacctgagcaccaccagatgtgtaaccctgtaatccagcgtcatgaatgagcttaccggcaaaataccctgtggggcgtttaaaaacactgccacacgatggccattctaagggttgcttagcggcacggcgcgcatttaagtcatccatttggttccggatcgtatcataatctccagtcgctagatcaaattgtgcgctcaaaatgatatcctgccgatcttgcacactgctgtgtcggtaaccaaactcaagttgctcgttggtcagcgtctcaatcacaccctcgcgagtcatgacggtcgcactgacaatgacatctttggtttcaccaccgtaggcgccggcgttcataaacacggctcccccaacactaccagggattccagccgcaaattccaggcccgttagtcgtgctttgcaggccgcttcgctcaccgcaataatgggtgcaccagcttgtgcggtaatacgattttcttgaatttcaatgcggttcattgccgttaaaataatcactaagcccgcaattccctgatcactcacaattaggttgctagcattgccaatcaccgtgagtggcagtgcaatttgctgcgcatagtcaactaactgttgaacctgttcaacactcgttggaaaggccaaccaatccgccggcccacctgtatcagtatttgtataatcggcaagcgacgcattctccagcagcttaatatcgggaaataattgatcaattttttttaggttactcaatttactcaatcctttttcattgttagtattattgtaacatgaaacaggggttcgaaaaaagaatcgttcctttgcttattttccacataactattaaaatacatcaatatggaggcaatatcatgaattttatttcgtggaacgttaacggcttacgtgccgcagttactcaaggctttattgatacatttaatcaactagatgcagactttttctgtctgcaagaaactaaattgcaagaggggcaaattgatcttgatctgcccggctactaccagtactggaattacgccgaaaaaaaagggtattctgggactgctatttttaccaaacacgaaccattatcagtgcactatgggattgataaggatgaatttgaccatgaaggccgcatcatcacattggaatatcccgagttttacctactaacatcgtacacccccaattctggccaacaactaaaacggttagcctttcgccagcgttggaatgaagcttttctcgcctatattaagcagctcaccgcgaacaagccgctcattttctgtggggacctgaacgttgcccacaccgaaatcgatctcaaaaatcccaaaagcaatcaccatgctgctggatttactgatgaagaacggcaggatttttcaacgctcctctctagtgggttcgtcgatacctaccggcacttttaccccgatgccaaagaacagtattcgtggtggacataccggtttcacgcacgcgaccggaatgccggatggcgcattgactacttcgttacttcaaatagcttgaccgatcatcttctggatgccaaaattcacaacgaaatttttggatccgatcactgtcccgtcgaactagtcactgatcttagtctttaacataatggagaacgacaatgaactttattgcaatggattttgaaacagcaaatgccaaacgggccagtgcttgctcccttgccctaacaattgtgaacaacgatcaaattgtggatgaattttattcattaattaaccctcaggatgaatttaactggcgcaacattcaggttcatggcattcacgagcaagacgttgcagacgcgcccaccttccccgaactttgggcgcatattggcaatcttttcggtccacaacaactagtggtcgctcacaatgcttctttcgataatagcgttttacgtaaaagcttagaacattaccagcttcctgcgattaactatttgacgctcgacacagttaaaacatcccgacaacttcttccaggatacgaaaactacaaattaaacacggtttgtcgagaattagatattgaactagaacatcatcacaacgccctagatgattgtcaggcatgcgccaatattctaatctaccagtcccaacatttcggatttgaaccattaaaaccatttattaaacctttctaaaaaacaacggcactgattaaaccagttaaaactagtttagtcagtgccgtttgctgttaaaatttaatttccattttgagtgccggtagttgaacctgatctcgattaatgcttatttcggtcatcaattcaaaacctgttttttggtacaactgaattgcgtgctggttgcttgccaatacctcaagcataaggccatccaaggtactataatgctgtccccaattcaaggcctcttgcatgagggctgtccctaacccttggtgccagtatgctttacgaactgcaattccgagttctccgaccgtcgcattggggactcgtgaaactgttacaattccgattggggtttgatccaaccacgcaatcaaaattaaattatcggttgtttgtcctatttgggcaatgttcgttgcttcagtatccacggttaaggtagcaaactctggggaaatcgtaaacgtatccgattcaacttgcaagagtctcagcatcgccaaaatggcagctgcatcttcttggtgcgcaacatctaaataaacatcagtctcattgttcacggttgccaccaacttgttgcagaatttgttcaaaatgaggcccgtgtgcaatcaattctagtcgccgaacatcatcaatttcggttcgttcaaaactaacttctaaaaactgagccggaagctcatcggccacaaactgggcccactcgaccacgctgaccccgtcaccatcaaaatattcttctaaccccaaatcactaccaccgccattttccagacgataaacatccatatgatacaggggcaaacgcccattctgatactcgcgaataatcgtaaaagtgggactcttgatagtttcatcgatatccaatcccagcgctagccccttcgtaaaggttgtcttcccagcacccagatcaccactcaaaacaatgacatccccagccattaccaatttcccaatttgttgtccgagctgcattgtttgttctcgattctctaccgttattcgcattttttcaccatactttatttttttaatctaatgcctgtgctgcagtaaccaacgatactttatagacgtcttcttcattagcaccacgtgacaaatccgaaattggcgcattcaatccttgtaaaataggcccgattgcttcaaatccaccaaggcgttgtgcaattttataaccaatgtttcctgattgtaagtccgggaaaacgaagacgttcgcatgaccagccacctttgattcaggcgccttcttcgcaccaacactttcgacaaatgcagcatcaaactgcagttcaccgtccaaatccaagtcaggcgccagttcgtgggccaaatcagttgcctcagccactttagtaaccatgtcatcctttgcagatccctttgtcgaaaagcttaggagtgccacacgtggatcgatgccaaagagctgtgccgtatgtgcactttggacagcaatttctgccatcgttggcgcatctaattcaatattaatggcacagtcagcaaagagtaaccgctgatcacctttttgcatgacaaaagcgccactaatgcgtttattgccgggctttgttttcacaatctgaagtgccggccgcaccgtatcaccagtcgcatgaaccgcacccgaaaccatgccatccacctcatttaagtagactaacatggtcccaaagtaactcacatcttcaagcatcttagctgcttgttcaggggtgtttttccccttacgacgagctaccagcgcgtctaacatgacttgttgcttatctgcgggataagtctttggatcaatgatttgaataccagttaaatcaaatccattttgtgctgcattagcttcaatttgagcttgatcacccaataaaacagggattactagaccatcttttttcaatcgaactgctgcaccctgaattcgttcgtcttcaccttcaggaaatactaacgtcttgttttgtccttttacctttgatgctaagtctgcaaataaatccataacttgcgcctccaattaattaaatcacatcatgcgtatcttcaaccgacaccgtttccggcagttgccaatcaattggcgtctctcccatcgctacaagggcttcgttagtttttgaaaatggacgggaaccaaagaatccacgattagccgaaagcgggctcggatgtggtgattgcaacacaatatttgtatcagtattaatcaggttgatcttagactgcgctgcttttccccataaaataaatacgaccggttgcgatcgtaccgagagtgcatgaatcgcagcatcagtcagtttctcccatcccttaccgcgatgagaaaatgcccgcccatcgcgaaccgtcaaaacggagttgagtaataagaccccctgcttggcccacttttccaaatagccatgtttgaccggcggataaccaagatcattttgtaattccttataaatgttttgtaaggacggcggaatttgaacgccaggtaacacagaaaagctaagaccatgggcctggtgaggaccatggtacggatcctgacctaaaataaccactttaacgtcgctaaagggtgtccagttaaacgcttcaaaaatatgatgcatctctggataaatggtctgatgttgatattctgattttaaaaaattgtgtagctgggcgtagtaagcttgctgaaattcaggctctaatacgtcccaccaatcgttgtgaataaatggtttcataattacaaagcacctcggttctattctagcatatccacattcaaaatggatattttctgttaattgaatcaaaacatggtaagataggcatagtaaattcgtaattttttgaccgtagccaagggagggattccagtgcgaacgctgtacattcatcagcatactagtgatctgcgtggtgcaacaaccgtgaaggatgaccaaaaccaaacggtctacctattggtaggaaaatggggactgcgtcaagacgtcctctcactatacgccgtcagtggcgaacttctcgctgaaattcgccaactgacactgggaattctccccaagtttgcgatctatcaagatcatcaacaagtcggggtgatcggaaaatcactgggcgtttttaaagaagttatttatatccgcggtttaaattggatcatcgtcgggaatatgctcaaagaaagttatcgtgtatatcacggtacacagctcattttttcctttcaatcacaaactcaaggcggtcaaacttttggtattctagaagttacagatgaacggctagagcctatctcaatcgtcatttctggggtactcagtcactgggcacgccgttcagataaactcacaatgcccaccaaaagaagactgcgctttaacgacaatcctagtattggttagtcctttgattaatgaaatctaaaaacactcatcagatttgacatccgatgagtgtttttattttctggttaataatgcttcataacccgttcgatttgccgattttgctctcgccgtttaatcgtctcacgcttatcatactcgtgctttccttgagccacaccaagtaataccttagcgtacccatttttaatatacatttttaatggtacaagggtaatccccttgtttgataactcaccgctcaatttacgaagttcctttttatggagcagtaacttacgatttcggaggggatcatggttaaactggtttccttgatcatataaactgatatgcacattcattaaccacgcctcaccatttcgaatttgggcaaatccatctcggagattcacacgcttgtcccggattgatttaatctcagtgcccgtcaaaacaatcccagcttcataggttccttcgatcgagtagtcgtgacgcgcttttttattttgcgcaacaacattatcatttcgctcctgatgatgtttaaccaccgttaatcacctcattatctatgattattatgactaccatgttgagatggtttactgccatcccgacgacgggcctgcccccgattaatttgacgattattcttgtgaccattgtctacaccatggtgatcccgatttctattgccgccattaccaccacggccgcggccaccaccattaccacgacgatgatcatcggtgcgtggtacccgaagctttgtcgtaggtgctgattttggatcaactagctcaaaatcaacttcccgctgatctttatcaacccggatcaatttcacttgaattggttggccaatttggaagattcggtggtaacgacgtccaaccaacgccatgtgcttttcaacatattcatagtaatcatcttgcatattgctaatatgaatcaggccttcaaccgtattttcaagagatacaaacaggccaaacttcataactgaactgacgaccgcgttgaacgtctcgccaacatgttcttccatatactcggctttcttcatgctatcaacatcgcgttccgtgtcaatcccacgtcgttccgttacggaagtatgttcggcaatttcaggtaattgttcctcatacttagctttggcttcctcacccgtgccgtgtttagcataccatttgatcaagcggtgaaccgttgtatccggataacgccgaattggcgaagtaaagtgtgtatagaagtcggcgcccagtccaaagtgtccgatggattggtcagaatacttcgcctgtttcatgctccggagcatcatcgtttgaaccatttgttcttccggtgtcccagcaacatcctttaaaacattttgcagcatcttaggcttcaaattattgatgtcaccgtgtacagggtgtccgatcacacttaaaaattcaaagaaagatttaactcgttcgccatcgggcgtttcatgtgtccgatataggaatggcacatgaagccgtttgaagtgttcagcaaccgtttcattagccgctaacataaatgattcaatcattcgttctgataaaccacgatcccgcagcacgatgtctgttgggtgtccctcttcatccacaacaatcttagcttctggtgcatcaaaatcaatggctccacgatgtttccgcatcttcaacagaattcgatgtaaatcagccatatcttcgaacattgggactaaatcacgatactgcgtgcgtgtcttttcatcatgagcttcaacaatggcgttcaccgctttataagtcattcgtgcatgtgacttcatcacacttgggaagattttatgattaacaacctttccttcaccgttaatttccatctcacaactcattgaaagacgctctacaccgggatttaatgaacagatcccgttggataaccgtcgcggaagcattggaatgacgcgatcagtcaagtaaactgacgttcctcgttcataggcttctcgatcaagcggagtgccttcttggacatagtgactcacatcggcaatgtgaaccccgagatgataattaccgttgtccattcgccaaacaacaaccgcatcgtctaagtcttttgattcgatgctatcaatcgtgactaatggttgatttgtaatatcaattcggccttctttttcctcttccgtgattgattcttcaacattgttagcttgttcaacaacgtcttctggaaattcatgtggtaggtcatgcgcataaacaactgataagatatcaacaccgggatcgtctttattcccaatcgactctttagcaatcccgaccatcgtcttaggctcatcatcagttggataacgggtcacgtctgccgtaacaacttcgccatcggtcggatgaatccccttatcggttaccatgaatttatatttcgaaattttcttatctttaaggacaacttccccaatataaccattttcggcagccatcttaaactcacccacaacactttcataatggtgagtgataattttagtcacttgtccttcaggtccctgcgatccatccggttttccaggccgtaaaatgtcaacctctacttcgtcgccgttcagcgcatgcatggtatgatccgggttaacataaatatcgggttcatctggatcatatgccacaaacccaaatcccttatcattaccgtgaaaaataccagataaaacgggctttttgggtaccgcctgaaattctccccgatcggtaacctgaactttcttttcgcgctccaactgtgccaaagtttggatgatcgtcgtaaactgatcagctccctgtaatcctagttgagccgctaatttttctgcagaaaagctaagttcactatttccttgtaagtgctgttgaatttgttcttttaaattaattgtcattatctacctcaaaaattgtcgttaagtaacttaaaacatctgtctctaactgttgatgcgcggtattaaccgtcagtacatgggaagctgtttcataaaaatgatagtccaccacctgcccagtttgttcgagagcctgcttcaactgcagccctgactgcgcgctaatcatctcatcttgcccgccttgggcaataaagaacggcgatttgacatggtttaggttagcttgcacacccgtaacaaactgattaatttggccaagttggataggtaactgctcacgaatccacgccaatcgcgttttgatttggtcttctgaaaggtcctgctgtcgataaacatgccgcgccatccgtggaaattgttgtggtacatttgtatgttgattagtaataattggtgatgaaaaaacgccaccgccaactaactcccgatcaacttccagggcccgagttgcaaaaatgccacctaaagacagtccaaacactgcgatttgctgataaccagccgctcgaacaacttcgatcgcggactgagtatctcgccaccatttttcgggagatccctcacgtaaaatatcacgaggatcatcggtcgcgtgcccggtaaaaattggtgcgtaaaccgtgtaattatgacgctgtaaaaagcgcgctaataggcgcacatcattgctacttcccgaataggcatgcagtaaaattactgcttgtggtccctgctcgaagaaaaacggtgttggttgccgtaacacgtgaccatccctcctttaaaagcaaaaagccccctgtaagaaatacaggagggcagccttctttaatgtgatgaaatataaatcaacgtcagtgcaagaatgaagaaaatcgcaccgcaaatcgttgtcgtaatttgcattacggcttcaaagccccgggctttccgtcgtgaaaacagatcgcccgcaccaccagtcaaagctgacattgcatcgttattattctttgctggttgcatcatgacacatgcaatgataacaacacaaagaatcaaaaagattgttaatagtaaattatacaaggaaaaatcctcctaattttcacccgtcatacatctcactcattgtatcataggtcaatggatgattctagttgtttgctacttatttttttcagtcccttgcgccgccgttataatctttacaaacgcactatggcgcattcggggggccactgagattaagagcgtatcgccggctttaatttcagtatctccgtgaggaatcaattgctgttccccacgatgaatagcatacaataaacagcttttaggccaattaaaatctcgaacctgcttaccgtctagtaacgcgccgacaaacacggttgtatgaatcacgtcctgtgatttattcgcaatcaattgcggttctcgttgcaacagtttttctaataacgacgcataaatcggtgcaccatttaaaatatccactacaacgtacgccaccaatgacacaacggctaacggcattaaatgccccagagacccaaccatttccgtaatcagaagaattgcggtgaatggggccttaccaattccagcaaagtaccccgccatcgcataaataataaaattggcaatatagacactaggcaacaatccagcggcatgcatcgcagcgccatataacccgccaatcacagcacctaaagtcaaaatggggagaaaaattccgcctggtagttctgatccgtaactcaccatggaaaataagaatctaaggagtaatagcccgccaaataacaagactgatggattcattcgcgtcaaattaacgataagcgagttaccgccgccgagtgtttgtggccaataccaaccaataataatgactaatatgaatggaactaccggatacacaaaagccggtaattttaatcgaccatacaatcggcccatattaagaagactaacctgatacaatcgccctaatattcccagaataattcccaaaatgagtaaatgaccatactgattcaccggtaacgaatgtgcataggtaatgtgtaaaaccggcgttaatccaaagaaattcagcgaaataaaatccgcgctaagcgcactaacaaaggcagacaaccaaacaactggggaaaaattatggtagacctcttccaagacaaacatcgtactggcaattggcgcgttgaaggcagcagataatccagctgctgcaccactagcaattgaaacgcgtcgtgctaatggtttatcatgccgaaactccgcaaatccttgtccaatagttgcgcctaactgaatcgacgggccttcacgcccaagaaataaaccagaaccaatagctaggacaccaccaataaatttacgccaaagtacgggccaccaagcttcttcgtaatcaccagccaattgtccctcaatctggggaataccagatcccttaattgctggataaccttgcgttagtttccccaatcccaacgctaacaacactgaaattaacacccacacgaccaaatatcctggctgctgatgcaaaaattgatatccgatcttaatgagtttcaattcccattcaattaataatctaaacgtactcacaacaaacccggccaatgcaccaatgattatgcctcgcagtagctggttggtcttagtccggtcaatgttcactttcatcttcccacccacagttttctatgtatcaaaaaagctcggccacaatcgcagcccagcttctttgaatctcataacaaattacttgttgataacgttgttacgagcatcttcgctcaagttatagaatgagttgattcctttgtattgagcaactgattcagacaattgatcttcgatacgcatcaattggttgtacttagcgatccgatcagtccggctcattgaaccagtcttgatttgacctgcattagtagcaacaactaagtcagcaatggttgtgtcttcagtttcacctgaacggtgtgaaacgatcgctgtgtaaccagcttctttagccatttcgattgcttccatagtttcagtcaaagtaccaatttggttaactttgatcaagattgagtttgcagcgcccatcttgataccctttgcaaggtagtcagtgttagtaacaaagaagtcgtcaccaactaattgaaccttcttgccaagttcgctggtaatttcagcccagtcttcccagttgttttcatcgattggatcttcgattgaaatgattgggtacttagcaaccaagtcttcgagatacttaacaaattcttcagtagtcagttcttcaccagttgaccaacgaagcttgtacttcttgtcttcgtcgttccaaagttctgatgaagcacagtcgatggcaatggcaacatctttgcctggcttgtagccggcttcagtgatggcctttaccaagtattgtaatggttcttcgttgtttgcgaagtcaggagcaaatccaccttcgtcaccaacagaagttgccttgccgtcagcagcaagaagcttcttcaatgtgtggaaagtttctgaacccatccggatagcttccttgattgagtcagcgccaacaggcatgatcataaattcttggaagtcaaccttgttgtcagagtgagcgccaccattgataacgttcatcattggggttggcaatacgtgtgcattgaaaccgccaaggtagttgtacagtggttgttcaagttcatcagcagcagcacgggcagcagcgattgaaacagccaaaatagcgttcgcacccaacttagccttgttttctgtaccgtctaacttgatcatggccttatcgatagcaacttggtcagtaacttcgtagccaacgatttctttagcgataatgtcgttaacgttagcaacggcctttaatacacctttgccaccaaaacggctcttatcaccatcacgtaattcaacagcttcgtgttcaccagttgaagcacctgaaggcacgattccgcgacctgcgccgccagcttctgtatataattcaacttcaacggttgggttaccacgtgaatctaggacttcgcgtgcgtaaatatctgtaataagtgacatttgatgattctctcctctgatttttaaatttggaaagcagttcctgcttcattgtattattttgtgcagttaaatacaagttcttttccatgagataatgcggttattggtaattaaccagctgtaaaaatgattgggcatcaagacttgcgtttccgaccagggccccgtcaatattatccttagccatgagttcgctaatattgtccggattcacactaccaccatacaaaacgcgaatctgattggcaagatcatcgttatagacgtcagcgatggtttgccggatcaaatagcacccctcttcagcttgttcagaactagcactcgtcccagtaccaatggcccagctcggttcataagcaatggtgacccgtttgacttccgtttcactcagccctctaagatccgccataatttggctaacaacccaatgaatcttgtcaccagcagcttgacgccccattgtctcatcacaacagacaatcggatcaaggcctgctcgaatagcgccatgcaccttcttattaataatttcatccgtttcatggaaataaagacggcgttctgaatgacctaaaattacataattcacacccagttgtttgagtgcgattggacttgtttcaccggtatacgcaccaaaatcctcgtaaaaacagttctcaccgataatatcaagatccgtcgcttgcgttctagccgccatcgcttgcaaaaaaagcgctggtgccgcaattgcactctgaacctgatcttgcggaggtaaattggggattacttcattaataaactgcagtgcttgatcagcagtcttattcattttccagtttccagcaatgaatggccttcgcatgtctaatttcctccttttttagctaacactcacattgtagtgaatatgatgcaaaaacgctaccaatttgagtaaaaacataaccatcacatgcttcgatttttcaactgaatccgatgccaataatcactcatattaattccacttttcagtatttcattagtgagcctctggaataagatggtcaaccagtgtcgttatgccggctgggttaacctgcaagatacttctgtcttgaacagatttacgcagtctcgaccacccaactaatgccaacacataggttattggcactagccccaacataaagctactatcgccaccttcagaaattaataacactatcagaaagctaaattgtgtcaattgtaaaattcgcgtcagaggcgaagtatctagaatactcaataacagtcctaaagtaatcattatccaagaaacctgtgcaatcgtcttataaatcgtaacgtgtttgccaaatttgaaaaagaatgaacgaataaacttaaaatgggtcgttccttgaggctcatctagcagccctgcaaacgttccatcactagttgtatgataattcttttgtaccaagaatcgaacataccctagcaccccaaacttttttaaccgctgcttgattaccttggtattggctgcacgctgcgcatttcgtttagtaaaactcgcactgtactgttcatcaatttgcgagtagttgcccatcgtcgatgcgttcatccccaacatgacatagtagctaggtaataattttagtgccgaattgttagttataatggtttgttgtgtcgtatttttttggttaatcccagtcaatccaccaattgttaagatcaaaattagtgctcccagaatgattcccttgataaattgagcattcttgtgcttacgttttccaattgctaccaacattgctactagcaaaactaaccccaaaatgaatgaactgggtctagctaggtaagccatgaatcccccacaccccaacatcacattggttaaaattattttgacataattactaaatcctgaattaaattcaataattaatagctgggccgcaaaaataactaacgtaatcgaaaataataatagactgtcattgctaaacacaaccaaccgcggacttaacaaaatacaaatggggaccaatccccaaacactcattcgctttaaagaacgtcgtaaaatcaggtacaacatcgccattgcgccatctataagaataatatttaaaatgacgaaaaccaaattgagatttgtaattcccattgatcttgtcacatggtaaataccacgttctatcaacatcagtgaaaaatgatttggataccggacgaaatcattatacaaatagctgccttcagagagggtattgcttgtaacagcccacttaatcagtcccgaattaaatccatttacgcccattaaggaagtcactaacgttagctgtaacaccaccattagtccaagcgcagtccacccttgcttaacgaccagccaaactttttgtccaacggttacatagttgaatttgaaaagatgcccaaataaaattaacgctgaaacaacaattaaaataatcattaaaagtgtcccaataacaagcccattcaaattactggtcgtcagcgttccaacaaagacaagcagaaacataattaaaattactcggttaaataaaagtttcgaaaaagttttcataaaatgttcccccactatctacgtttatttgacaggttacttgaactatccagatgccattccagtatccgaggtaaattcaaagctttgagtttagaccagccaatcattgaaagcagtccgataattggaatgaactggagcatatatctggaacgaccaccttcgaaaatcagtaaaaacaatagtaacccgataaatgacattcttagtatccgtgcgaacaatgagctgtccaatagactaaataccactccgatcatagtaaaaatccacaaaatttgagcaacaattctaaaataggaatatcgagatccatacggatgtaacagtgaatatagcaccgaatgttttttcactgagactgaataaagcgagctatcattggcccatgctaacgtcccgtcacttgtatttctgtaatatttcagtgctaaaaattttaagtacccggtcaccccaaaattttttaatctcttcttgatctttcgaatattcgcacgatcttcctcaccccgactatgcttttgatcgcctttaaccgcatactttaggctgtagtcgtagtccttcatagaaaaaccaccttgcgaatccgtactcatacccatcatgataaaatgggtcggtgtgaaactgacgtttttattaatattgaccagtgtttcatttttggtcgcgtaacttttaccaatttgaagaacaccaaataaaccgattaccgttgccatgccgacaatgatatataacagacattgtcgtttgttcttctgttttcgttccgttaacaacaacgaaaacaggacttcgacaccaattgcaacgactataattaggatcgtcggcctaagctgatatgcaaaaaacagcaacccaccaaaagacagaccattgattacaatcgctttaatggtcaattgatgtttttttacaagcccagtcacattttgaattatccaaagcaggcaagctaataaaggtagcataaaagtgtcagaataggcaacgacgacccacggtgaaataataaatgttaccggtagcaacgcccaaatgatttttttattcgtgtacttccttaatatcactgacatcgtcaaaatggcaccatcaataaatactaaattaatagcattaagcatataactaaaattatgaattcccagtattttactaattataaaaatcaatcgttcaaggtataacaagcctaaattgttcggattaatcgaaaaataccagttacttcttacccccattgccgcttctcttacaattccagcatcgtaccctgtctgaaaagaaaaaaatcgaatcaaaatcaattgatatccgattaccaaagcccaaaaaagccaggctttatgcgttaaaagactcaattttttgaatccttttaacaaaatatcatgttctctcgcaaaaatagtaattataccggcgataaagaataaccaagccactacgaggccgaactgctgtgtatctgtaaaattcttagacgcaaaagtgcccgccaatattaatataaacaactccaaaatagtaatatcaattgcatttctaatcctatttctcatattacattcaccacccaattctcatcatttcacgctttatgctgacgccttgcaaatccaactttaaataatccaccaagaaggcggcaagactcttccgccaccaaggtcgccattaataaaaagattggcagaaattgaattaaataccgacttcgaccaccttcaaacataagtaaaaaaagcattccgccgataattgctagtcgaaatagctgaactaccatttgccgattacgccagctgaagaaaatcatccccagccatataacccaccaaaactgtgctaaaaatcgaaaatcgccaatatgagttccatacaaataaacaaactgtcggatactgccagcaaagccacggcgtgctggatgagtcacaccatcattaataaaatgaccttctttaacccaagcaaaggtgccatccgcagtattattgcgttgctttttcagtaaaaactttccgtatcccaagacccccattttcttcattcgcgatactagcatgtcccttgagtacgctacacgagcttctttcgtaggtaattcggccattatcaatgcatcatgggcattatatccaccttctccagatactcccatactcataaaatgaatcgccggaattgcccgttgacgattaacaacaacgtagttctgattatttaaataatagttacctccaaaatacgcacctcccaatgtcagcaaaacaatcattgggatcatcatccgaaatgttaaaattcgatcgattccgtgattaatcctttgaattgtaagttgtctgaacgtaaataatttgattgtatgattttgaatccaatataatatttcaatcaaaattatcgcaattactggaataatcgcagaaggtttcataaaatacgcaccagcaattgacagacctaacaaaaatgctacaaagtatgctgacctaaatcgtaaatgaccaaagcgcaaactaaaatagcaaaacatgtaacaagatactaaaggcaatacccaagtatccgtatagggcacaataatcatcggaaaaatcgaaagccatattgcatgaatataaatgcctaatgccgtcttttgtcgatctataatgcgaattgaaataatatttagtaatgctgaaagatcaacgacgatcatggttaccaaatccattgctaaccatgaagtactatgtaagagctgtgccactccatgtaatatcaatagtaacggtaagttattaggattaatactgaaataggcttgaagttgactattctggggttctattaatcccagatgaattgcaccaacatcaaacccaatcgctggatgaacacatattataaacagcaattgccatgccattaccacgcccattaataagctcgctgttaacagttgatgctgtacaaaaatccgccacgctatgtgacggatttttggataaacaatgattgcaacgacaatcgtgacgacaaaaatcaagaacatcgtggttacaatagtcgttcccgcacctgttgttaaattatcaccaacaattaaattaggaaatgtgactgcacaaataaacgtgataccaaacaaaaaattaaaaagatataaaatgcctcgattgctaatgcgaaacaacttcttattcacggtaaaaaactccccaaccaatcaaattaaaatcttttacttccgagtttctttgactcgctgtaaatcctctttgaaaacagatcggacacttccaacttcatcatcaaattttttcgtgttccaaacagccatctccgtcatcgtatttaaaattccaacgaatcgaataaatgcaacaacaaaattatagattggtaatgtcaacgctacccaagcaagtcgcgtataaaaacgtcgttcttctgtaaaatcacgcaataacatccgcacacatacataattaaatagtgcgacaaccacatagaggatataaataataaagtatgacattgccatcataatgactgaatatcgaaagaaaagtaacgcaatactggcaaaaatccaaatcatcttaggaaataaaaatgtatgatcaataatcatgcgtcgaattaagaaattactaaagaaattttttaattcaatatgctttgaatattcctgcgaaacttcaatttctccacgttgccatcgctgacgttgtgtatataattgcgacaatcgattaattggctcaatataaaaaattgcatcagaacaaataacaacctttcgttttagtttttcacgaatttgaaaggtcatatcggtatcttcgccaaccgttgaagtgctatacataaatgtgttgagtaatgcttcttttctaaaggctgaaaaagcaccagacattgtaaacatttggttactatcagactcgatcactctgccagacaaaaacgcctgtgcatattcaaaatattcgtttttattcagtatttttctaaaaaatcccttttcagtcttaatttgttctttttgagttaatattgtgccagtcatcgctgctgcatcatagtcattttcaaaacgtagcaccatattcatcagtgcgtgcgattcgaggacaccatcgctgtctatgttaaatatgtaagtcccaatgctttcatatatcgccgagttaagtgctttagcctttccttgctcggtatgaatcaactgcatatgcatatcactaaaatgcgagtgagcgcggctgaacacttcaaaactactatctgtactctgattatcagccaagatcacctgcactaactccgttggatacgtagaatcatgaattgattgaatacaacgatacagcgtatcctcagaattgtagacggggacaattacagaaataaatggcattttatcaggcatctctaattttttatgtcgcaaatttttcaaaaagagtctaaaaatcgagaaaaaagccggtataatttcaaccacgattggaattaaagcccaagtaagccagaatcccattttaaataatgttaaatttaaccagtattccatattgattttttactcccttctaaatcgaatcccatgcattcgcgctttaaaattattatataagctatgcgaaatttgtgagtaagtaaaaacgttataatacaatacgatcactaaaacataaaataccattcgtcctataactgaatgagccaaaaagaatagattgccaccaccaaaatgtgtgattgtaatcacagtcatcagacgaatgacatttgctaaataaatccataaaattccccataaaacaaagaaaactttctcaaatttgttaaatagtgggtaaaagaccgccaaacttataaacgcagtagtttcaataatccccgaacattcataatcaatcgacatcatgactggggatgtcggattactaatgctcactaacccatatttgggcataatcgtgctcatatgagtaagtccacccaaccatccaatgccatgaagaacggcatgtgtaaaaaaccaaacccagtatggatcgcttaacgcaattaagatgaaaaatagacccccgcttccaacgataaagaaaaaagcggataactttgaccgctttaaaaccgacaaaacatatagccatataattgtcccaactataatgtatacgttcatttatctcgctccctgtgtttcttgcgtttcagtttgtccccagtcaatccggtcatcttgataacggatgctgccgcaattacgaagccggtgctggcaaggacgacgggaccggtactaccaccagtggcttttaattcgccattccatagattactattagctaacgttaccgtcgaatctgaggtggaatctgacggtaatgcatctagatcactaaacgggatctggcactcaagcgcaattgaattcaccttgctatgattaccattaccatctacctgatcaatggtgattccaaccacataagcaccatcctcaataaccttgtcaacacccgttgctttatcataaatatcaactgaaacagcttttttctctcccggttgtagagtcatcgaagcgtgattattcagcgtaatttcatatgtcttcccgttaacactcaattcataaccacttgcttgtaaattagagtaaccatcagcctgtgttccactactgtttgctccaagcttgggtgccattgatacataaaagtaggcgttcttatcatccgttaccaaagctgatggcttaatgttgtctccatcattggtgattgccatatcggtttttgtaatgtcattccaatcatcaagatccccatccatcttaatattcagatttccagagacattgttattttccgccaaactcgtatcagtatctgttttatccgtagatgattgtgagaaaacatctgaaatagcattgtcgctactatatgtgcttgcttgatttaccgcattagatacctcatcaccgctactttctgaagttgcattactaaatggtgtggaaaggctaatatcttctgctgttactgttcccgaaccaatattaggattagacacatttgtaacaccattattacctgaaactcccaaagtcgaaaataatgcatccatcttaatcgtataaatgccattatcattggtaacatatgccgtaccaacatttttaatatctgcatagctgttagcgacgtcataagcattaactgaaacagcttgtgtcattccagctaccggtaatgtactgtcaaagtgcaatacatacgtttttccatcaacctgtaaagaataagaatcgttaaaattattctctttggtggtcacatatacataagcacttgtactgtccaccacacacttaagcgtcttatcagcactatacccagttaaggtttgagtattgtcccaaatattcgaatctgcgctaaacgtctgagtttgtgcactacttgacgaactactcagtaaactctcagcagagctactcaggacacgatccaacgggctactgttagcatcactgctacttgacgaggagctcgacgaccctgatccggctgaatcgttgacactactcgaggaagatgagctactcgaactagaggaactgcttgacgacgaactgcttgacgacgaactactgccagagctagatgacgaactcatgctactggagctcgtcgaactaccactgtccgtcatttgattgttgtttgcataggcaacattagtggtcagagtgaccacttccaagcatgataccaatgctaaaattgattttttcattctaattccccgcttttttacatacctagcatctcacaccaggtcatctcaataccctatcttttttccccagtatacagagcaaacgttcccaacgatatagcttaacccgatttgttacatatacgtaatgttgtacttatgacactagtataacgacaatttactcaaaagataatagactcagcctattttgtggaaaaaaatagaagaaatccaaagatttcttctatcaatcacaatttaaatgttacttacttttcagaaattgaagcaattcctggtaatgtcttaccttcaagatattcaagtgaagcaccaccaccagttgaaatgtgagtgagactatcggcaacgcctaattgttgaacggcagcagttgaatctccaccaccaacaatggttgttgcatcgcttaaagtacccaagaatttaccaatttcaagtgttccgttggcaaagttgctcatttcgaacacacccattggtccgttccaaacaaccgtcttagcatccttcaaaacatctttaaacaagtcaactgacttaggtccaatatcaagggccatgtaaccatcaggaatatcattatccacgatcttgctttcagcatcgttattgaattccttcgcaatcacagaatcgattggcaatactaacttatcgccggccttttccatgatttccttggccaaatcaattttgtcttcttcgaccaatgagttaccaatcttaatgcccttagcagcgtagaacgtataagtcattccaccaccaacgatcactttatcagccttgctgagtaagttgttgattacaccaatcttatcagaaacctttgcaccaccaagaatggcaacaaatgggtgaactgggttatcaacagcgttaccgataaacttgatttccttttccattaagaaaccagcagcggcttggtccatgtttgaagcaattcccacgtttgatgcgtgtgaacgatgagcagtcccaaaggcgtcgttaacaaaaacgtcgccaagcgatgcccagtatttgcccaattcaggatcattctttgattcacgcttaacattctcaccatcaacaacgtcttcataacgagtattttccatcaccaatacatcgccattgttcatattatcaatagcatcttcaagctgtttgccttctgttacaggaacaaaagtcactggcttatcgagaaggtttgaaagacgttcagcaactggacgcattgataatgcaggcttgtcttcttccttcttgatccggccaagatgtgataacaggatggcacggccaccatgttccattacatacttgattgttgggagtgcagcaacgattcggttatcgttaccaatcacaccgtctttgattggcacattgaaatcaacgcgcattaaaacttttttgccttctaattcaaggtcttcaacagttaatttagccattgtatctctcctataattaatcgatgtttgatattaaaaaagtgagaggagttctcctcctcccacctaggtgaaactaatctaaattaaagtgtagcaaagtgtaacaaagtacggatcatgttgcttgtgaagccgtattcgttgtcataccaagcaacagtcttaactaattgagtgtccccaacagttgtaacttctgtttgtgaaggatcgaatactgagccgtgtgtgttaccaatgatatcgcttgatacgatttcatcttcagtgtaaccaaaggcatcgttgctgtctgaagccttcttcattgaagcattgatttcatcaacagtaaccttcttgtccataactgaaactaattcagtcaatgaaccgtcaacaacagcaacacgttgtgcgtgtccttgtaacttaccgttcaattctgggataactaagccaatagccttagcagcaccagttgaatgaggaatagtgttgacactagctgtacggttgttacgcatcttcttgccacgaggtccatcaagaatcatttgagttgatgtgaaggcgtggatagtcgtcatagtaccagctttgataccaaagtctttgttcaagaagtatgccattggtgccaagcagttagttgtgcatgaaccagcagaaacaatcttgtcgtctgaatcaaggatgtctaagttaacacctggaacaacggtcttgatgtcaccagctggtgcagaaatcaagacacgctttgcgccggcgttaaggtgagcttgtgacttttcttttgaagtgtagaaaccagtacattcaaggacaaagtcaacgccgtcattcttaacccaaggaatatcgttagcatcgcgttctgcgtaaactgggtattcttttccgtcaacaacgattccattatcagtggcgctaacttcgccagggaaggcaccgtgtgttgagtcatacttgagtaagtatgccaacattgaaggtgttgttaagtcgttgattgcgaccacttcaatatcatttgactctgcgcccaattcgtggatgcggcggaaagctaaacgaccaatacggccgaaaccattaataccaatttttacagtcatactgcaatttcctcctttaggaaaataagttttagtttaaaaacgtacttgttaagtatatcacgtcatcacaaaatataacaggtgcagccaaaaaaatccataaactactcaccaacaatatccgtacggcgttccaacagcaagtacaattaacaccacgtatataatatatgaaaaaacggcattagtaaaatatattactcaaatttggcaaaattatcgttcaaattataatttttagttactttattggaattttattggcttagtgtaatttaactcttgtattttcatgtattattcggtatcatattactttgttaggcgcccttagtgtaatggatcgcacgtgagattccggttcttgagatcggggttcgactccccgggggcgcattgaaagttttgcaagccatatgcttcggtatatggtttttttgtacactcgaaaccaaaaaacatgctgacaaccttcgtatccgttgtcagcatgttctgctttaatctgtttgataggtaatttgatcaaaattatcattttgatgttgtttaacgaacgcggtcgcctcgcgattaatccgcttcaaatcgacgccctgttgtcgggccgcaaagaggcacccacaatagcattgccgataaacatcatattccgcacacatttgaacggagcgacgatacccaccccgttttttaaaatcgcttggtaaataagaaacatcatacatatgttgaacatcgagtcctaatcgattaatgatctgggcatttttatggggactgatggtgagtgcactgccgaagtaatcaaactgccattcttgagctttctgagccacgcgatcaagtcgatagttgtaacacagttgacaccgtgcgccaccctctggtgcgtcttttaaatcacgaacaacttccaaccacttgctaggttcgtatgtcgcactaacaaacgtcacctggtttccagtttgtgcattaaaatctgtaataaattgctcctgaaccaacttgcgccgctcgtactccattcgtggatgaatattaggattatcatagtacaccgttacatccgcaaactgcgttaaatattccaacgtatacgtactacatggtgcacaacaactatggagtaatattttgggtcgccgcgcttcatcttgccatttttgaactaatttttgcaagaccagatcataattgattttctgtcccttttcaaacatcccctgaatttgctcgtattcaagcacaccatcatctcccaagttcaactttaattttaattatacacgatcgctaaacacctatctaacccatcgcgtaactaaaagcacaaatcaccaaattattctggactttttcaaatgatgatcgccaaccgaaaaaagcccatttttcaattacttgggttgttcatggtcgctataatactcgggtcgtgctgacgtcacggggtgttgtgccaaccactcacaaatttcacctgctaatttgtcactcattggtgctgaggccgcaatttgattttgtgtaatttgattaacatgcacccccgccaaaatcgtggcacttccaatcaggtgggcttgaattcgttgcgcaattcggcgagaaataaaatcatccttgtgaaaccggccatcgtgactcgggtaccgaacggtttcaattttagtctgttttgtcagtgtagttacgaccccaatatgcggattatcgccacccgttactgtaattaatagatccatgccaatttggcgtaaatcagcagtgatcgtgtaattttcctgggtcgttgtaaatcgtgcagtcgccatacaatcatcctccatacttatgcgtttaggctttcagtaactttcatttgtataaaatcggcggaaacttgtaacttagcaagttcatctttcgttaagtctaactgaacgggggcaacaatcccatcagcgccaataatggctgggtaggataagtatgtcgcatattcaggacgaaaatttgaaacaactaattgactatgcgcgtccgttaaaatcgcattcatcaatcgaactgccgcagttgcaatcccgtagttcgtatattttttggcatggaagacccgatcgccacctaaaatcgattcttgcttaattgattccaagtcaagtccccgcatctgtgcaacttgcgtcatcggccgccctaaaacacggaccgttgaccaagcagtaaattgcgaattgccatgttcgccgaggttgtatccggtgattgatcgtggatcaaggcccaaggctgtcgaaacggcccgcttcatgcgtgcagaatccaataatgtcccagtgccaatcacgtgcttttgcggcaacccagttacttcttgaaaaatagaagtaatcacatctactggattcgagataacaatcatttttccgtgaaatccactcgccttaatcttctcggcaacagaacgggcagcctgtcgcgtaaatggcaactccgcaaaccgatcatcatcagtattatcttgtaattgaatgttacccactgcagagataacgatatcggcatctgcaagcgcagcgtagtcattaaccttaatcttggtatagtgtggtaaattcgccatagcatcctgaaaatcagtagcttcagcgatcaccttcgcttcattggtatcaattagtacgagttcatccgcaaaatggtcggcaataatatagtgtgcaaccgtcgcgccaacgtgtccaattccaataattgcaacttttcttggcatcctcaacatcccttcaagttcaattaacttctatttttttaaaattagaggtatttctcaattttttctaacaaaaaagcccttcaccgaggtgaaaggcataaacatcattacttagcaggtttttgctttgcccatgctcgtaatgcttcaattttcttttcttttttggcgcgatcgtacttaggagctaccggacggcgtccttgtacaccatgtggatgtgctttacgcatatgaatatgcctccttctacttcctcttcattaataatcaacattccaattatatcggtctgccctcgataaatcaaccttttttaaaatccagcgtcattctcatcaaattatgatctataccaatttataaattatattttaaatttgtttaatcaaaaggctttacaatgtataccaatatcattataatgaatctgttgttaagttactgatccttaacgaaaaccacgggaggtgcacgatgtcagaaaatgataccagttcactcaaccagttagacgctttgaaagacttttatgcacatgatgatcgcgaagagctcgatcaatgcagtgttcaaaaagaactatcttggttaagcgaatcactcaatcaataaattaaacactaaagtatagcaacctacgcttatcatcttgactggattacgcagcgtaccgattattttaaagttgctatgctttttttgtgccctcatatggtagacggcactcaaatccattataatctagacgaggtcatcatgtttcatctgtgatgcgcgagatttgagataaatcatttgacctttattgaccaacgcgttaaactacatttacacgtttagcaaacgtcctaatcaagtgctaaaaggaggcaacatttatgaatttagtaccaacagtcattgaacagtcatcacgtggtgaacgcgcctacgatatctattcacgactattaaaagatcgtatcatcatgctttctggtccaattgaagatgacatggcgaactcaatcgtcgcacaacttctcttcttggatgcccaagactcaactaaggacatttatctctatattaactctcctggtggcgttgtcacatctgggatggccatttacgataccatgaacttcattaaatcagatgttcaaacaatcgtgattggtatggccgcttcgatggccagtgtcttggtttcttcaggagccaaaggcaaacgttttggtttgccacactcacaagttctcattcaccaaccatctggtggtgcccaaggacaacaaactgaaatcgaaattgctgcaactgaaattttgaagactcgtaagatgatcaaccaaattttagctgacaattccggtcaatcagttgaaaaactacaagaagatactgaacgtgatcactatttaactgctcaagaagccgttgattatggattacttgatggtatcatgtcaagtaacgatcttaaaaaataatgatcaccatctaaataagccatgactctcaaaaagagtcatggcttattttttaggctgaaatttccgcatttggatccgtacgcaacttctcagcataggcattaatttttctcaatcgatggttaacaccagacttggaaatgggaccaccaggaatcagttcccctagttcctttaggctcacttcttgatgttgcagtcgcgtctcggcaatctcccgcagcttaggaggaaggacccccaacccaactgttgaatcaattaactgaatgttttcaatctgcttatttgaagccgtcgcaactttgtccatattggcattttcacagttcaccagtcggttaaccgaattacgcatatcccgcataatccgcacatcctcaaaccggagcatgccgctcgttgctccaattagtgacagaaaatcggcaatcttttcggcttccttgaggtagacaataaacccgctgcgccggctcgttacccgcgcattcaggttatacttgttcatcatttccgcaatcatcgtattatgttcttcatataatgaatagatttcaagatggtatcgtgacgtttccggattgttaacagacccgccagctaaaaatgcgccccgcaaatacgagcgaatcataccatcgtcactgagcaattcaagcggtacatgctccttaatctgtaacccttgcaagattcccaaatcatcgagaatctcagccgcatcataccgcagccgtaccacgtacagattgttcttctttaatttcatttttcgtcgcaccaccagctcactttcagcctggtaaaaatctttcaacaattgatagattcgacgggcaatggctggattctcggtttgtacattcaatactaactgatgattagcaatatttaaactgccgttcatccgaataagggccatcaactcggctttggcgttgttgagatggacttgcagccccgttagttcttttttaacttcacttgcgtatgacatctcatcatcccctaatcatgcgattgttggagtcgattcatgagttcttcaacgactttttcgctgtcatgaaacgccccattatcctgtaacttcaaaaaattagttgaaattacgcatacatcttgttttcgtaatccttgaaaatcatggcgaacaggcttagatagttcattccaccgctgaaaatccatgtaatcttcagggaccggttcggtattgactaaaatcgtattcacaaaattatgaccgagatgacgatttaaaatacgcacatgatcggcatcagataggttatctgtttcacccttttgcgtcatgatattacaaatataaatgacttccgccttagtctgacaaactgctcgacccacattttcaatcatcaaattcggtaaaatgctggtaaagagactaccaggtccaattacaatttggtcagcgttcataatggcctcaattacttctggcacggctgccggttggtgcccatcctgatcatcagatggtgttatccacacacgctcgatcggcttatgcgccgcggtaatttcagattcaccactcaacgtcgttccatccttgaactcggcattgagtactagaggttcattcgtcaccggatagacgtggccttgaatgttcatcatctgtgaaagttcttgaaccgccccaaaaattccggaatgcatctcagacaaagccgcaattatcaaatttccaatggcgtggcccgctaaaaacttatcagaactttcaaaccggtactgaaaaacatctaattctagttgcggcaagtcagacaacgcaactaacacgttccgaatatctccaggcggtaccacgttaatataatttcgtagaattccggatgagccaccgtcatcagcgaccgtcacaacggccgtgatatcgacgtttttattgtgtaacccccgcaagatgacggggagacctgtcccaccaccgatcacaacgactcggggttgtcttcttttatttttcatgaccggttggtagtctcctttctctttgcaacgtcccggtgggtaacgtttacgacgtattgctcacgaacgtcctgtgcaatttgattggcaattgcaaccgaccggtgttgaccacccgtacagccaattgcgattgtaagatttgtttttccttccttaacatagcccggaaggatattcaaaattaaactcttaaattgatcgtaaaattgttgtgcgcggggctgtgcaaaaacataatcacgcactggctgatcttcacccgtcaacgcctttaactcggggatataatacggatttggcaaaaagcggacgtccatcacaatatccgcatcaagcggtagtccatacttaaacccaaacgacatcacttccacatgaaatgtcgtcgcatgatcctgattaaaaaactccccgattcgttgtcgcaagcttcgtggtgtcagattggacgtatcaattgtgatcgttgcccgatcccggatctcactcaacatatcacgttctttgataatgcctgacaagacccgtccctgtggtgccagtgggtgtgcccgccgcgtttctttatatcgtgaaacgagttcttcatcacttgcttcaagaaataagatctgcaacgccgtatcgggtcggttcttcaacttatccaacgttggcactaccaagtcatagaatccttttgaacgaagatccataacgagtgcgaccttcgaaatatccccatcttcttcaataatgtctaagaaccgtaccatcaaattcggcaacatgttatccacaacaaaataacctaaatcttcaaaactttgcacagcgacggttttaccggcaccgctcattcccgttacaattacgacttgtagtttttttgccacaattttgcctcccgaattaactcattcgttccattgtatcataccaggcgtgtcatttctcattaacacccatttaaatcaaaaaaactaaaaaaataagagtggaaaaaaaggcggtctgacttcgagcatagcctagaaaaccgaatgattcatattttgaatcgtttggttttcgtagctaagcggagaagtcagcctttttccccgatttcggctattaaagttcggagacagaaagaggctgggagtttttccccagcctctatgactcgaaatcgttttagttgtgctcattaattaattgctgtgcccgtactaagttttgtttaatttgtgcaaacccggttccaccgagtgagttacgtcgctcaacagcaaccttactctccaaatcatgatacacatcttcttcaatcagtggtgaaattttttgatattcagccaacgtgatgtcttgcaatcgtttaccagtctgtaagccttccagcactaacttaccaacaatttcatgtgcttgccgaaatggaattcccttgctggccaagtaatcggctaactcagtggcgttagaaaaatcattttgtgtcgcctgctccatcttttccttatggatatgcgcggttgccaacatttctgcaaagattttcagactaggcataacggtcttaactgtatcaaaaacgccttccttatcctcttgcaaatccttattataggccagtggtaacgacttcataaccgttaacaaccccatcaggtttccaatcacccgaccactcttaccacgaattaactctgccatatcgggattcttcttttgcggcataattgaactacctgtcgaatactgatcggataattctaaatagttaaactcataactacaccaaagaataatctcctcacaaaaccgcgacagatgcatcatcataatggccgaattactcagaaattcgagcgcaaaatcacgatcagacaccgcgtctaaactgttgtgatagacatcgccaaagcccaattcttgtgcactaaattctcgatcaattggaaacgtcgtaccagctaaggcagctgcccccaacggtaaaatatcagtatgttttaaattgaactggaaccgctcaacatctcgctggaacatatcaaaataggctaacaagtagtgtgcatacgaaattggttgtgcatgctgtaaatgcgtgtatccgggcataatggtttccacattatcttttgccaggtcaaccaatacctgctgtaaatgcgttaattcatgaattacctgaggaatttggttcttgacgtagagatgaaaatcagttgccacttgatcatttcgacttcgcgcggtgtgtaacttaccagcaacggggccaatttggtcagttaaaatcttttccagattcaaatgaatatcttcattttcaaccgaaaattctagtttgcccgcgtgtaattgttgcacaaggctctccaaaccagccacaattttatcagcatccgctgctgataaaataccagtttgcttgagcatcttaacgtgtgccaatgatccttgtaagtcttcatcagctaattcttgatcaaatggaattgacgcaccaaattcgtcaacccagtgagcggctttttgggtaaaccgaccaccccataatttctcagtactcatagattaaatgccgtccttttcctgttttgccttctcttgaacctgtgcgtaaacctgtgttggtaggccccaaagcttaataaagccaacagcagcttgttgatcaaattcatcagcagacgtgtacgttgccaaattcttattataaagtgaatttgccgatttccgtccttgcgtaatgacattacccttgaagagtttcaaacgaacggttccattcacaaccttttgggtatcctttaagaacgcaatcatggctgacatgagcggtgagaaccataatgcattgtaaatggtgtccgccagcttttgttcgataatgggcttaaagtgcgctaaatcccgttcgaatgtcagatcttccaaatctttatgagcgtgcatcaatacggctgctgctggtgcctcatagacttcacgagacttgatgccaactaaccggttttcaatgtgatcaattcgtccaataccgtgtttgccagctaatgcctcgatcttaataattaaatcagataaggcatactttgtcccattcagcgcaactggcacaccctgttcgaaatcaattgtaatttcatcgggttcgtcaggtgtattttcgagcgcattggtcaaatcgaatgcatcttccggtgcagcagcccaaggatcttctaggacgccacattcattagcacgtccccacaggttttgatcaattgagtatgggctatccaaatcgatcggaacgggtacattgtgttccttcgcatattcgatttcttcttcccgtgaccagtgccagtcacgaatcggtgcttcaatttttaattccggtgctaaagcatgaatggcgacttcaaaacgaacctgatcgtttccttttccagtacagccatgggccactgccgtagccccctcctgcttcgcaatttctaccaacttctttgaaatcaatggccgtgatagtgctgaaagcaatggataaatgccttcgtataacgtatgaccttgaagtgcgattaatgcatattcattcgcaaattcttcacgtgcgtcgatcacatatgctttggttgcgccaactttcaacgctttatcatgaacgaagccgtaatctttgcctttttcaccgacattgatacaaactgctacaacgtcataacccttgtccttcaaccatggaatcgctactgatgtatctaacccgcctgaataggctaaaactactttttcatttgccataattacttgctcccttattggtcatttattatgtttcatatattagcattggttttattaaaaagcaagtatttatacactattttcaataaaaaagttatttttattcagttaacaggatgaattggattttattttgaataaaatcgcaaaaaaataccgcgaaaacgaatgttttcacggcttctttggctattcctatttatacgaggacccgtttaaatggatctgaagaaatcttttctgacaaaatcttctttgcccattcctgtgcggaaaatagtgaatggtcacgatagttaccacagctctcgatcgttgttccttgaacatctgaccacttagcagtggaaataaattcaagtgacgatttcagcgctttagcaacttccgtggtatcatgctcaccccacataattaaatggaaccctgtccggcaaccgaatggtgagcagtcaattacgccatccatccgatcccgcaacaatccagcaagcatatgttcaatggtgtgcagtcctgcagtaggaatcgcattttcgtttggttggactaatcgtaaatcaaagtttgaaattttatcaccctgtgggccttcttcaaccgtgatcaatcgtacgtatggtgctaatacctttgtatgatctaactgaaagctttctacctttgccaaaataatcactccttaaaatattttacgtgactcattctaccactattgagactcacaatcatgattttgcttgtcgctgcttatcccgttccaaaattggtttaagatattggcctgtgtaactttcactcacttcaccaacagtttccggtgttccagtggccacaatttgcccgccgcctgcaccgccttccggtcctaaatcgatcaaccagtctgccgatttgatgacatccaagttatgttcaatgacaagcaccgtgttaccggcgtcgactagtcgttgcaaaacgtccagcaaacgccgaatgtcatccgtgtgaagtcccgtcgttggttcatctaagatataaaaacttttaccggtagactgcttgtgcagttcggacgccaatttcatgcgttgtgcttccccaccggatagtgtggtagccggttgtcccattttgacatagcccagtcccacatcaacaatcgtttgcaacttacgcgtaatttttggaatggcagagaaaaattccaatgcctctttaaccgtcatatcaaggacgtcggcaatatttttacccttatattccacttccagcgtttctgaattatagcgtttgccatgacaaacctcacagggaacgtaaacatcgggtagaaagttcatttcaatcttcaaaatgccatccccgtgacaggcttcacagcgtccgcccttcacattaaaactaaatcggccctttgaatacccacgcattttggcagcattggtttgtgcaaaaagtccccgtatatcatcaaagacgccagtatacgttgccggattactgcgtggtgtccgaccaattggtgcctggtcaatatcaattactttttcgatgttttccacaccgcgaatagtcttgtacttaccaggtttctcagaattatgattcaatttttgtgctaatacccgtttaagaattgagttgaccagggttgatttacctgatccagataccccagtaaccgccacaaacttacctaatggaaaatcaacggtaattccctttaggttattttccgccgcaccagttagtgttaatttcttgccatttcccgctcgtcttgtttcagggacttcgataaatttcttccctgataaatactgacccgttagtgacttacgcgacctggccacctgtttcggcgttccggcagccattacttgaccaccattatcgcccgcaccaggaccgatatcgacgatataatccgcggcccgcatcgtatcttcatcatgttcaacgataattaaggtgttccccaaatcacgcattttctttaacgatgcaatcagacgatcattatctcgttgatgtaacccaattgaaggctcatctaagatatacatcacccctgataaatttgacccaatttgggtagccaaccgaattcgttgtgcttcaccaccggataaagttctagctgaacgacttagcgtcaggtattcgagacccacgttttgtaaaaactctaatcgatctacgatttccttgatgataggtcgagcaatgacttcattttgttccgataatgtgacctgtttaaagaaggggagttcgtcactcactggttcgtcggagatctggccaatatgcaatccgtcaattttgacacttagggcctgccgattgagccggtatccatgacaagtttgacaagttaactcagtcatatatttccgcatttgatcgcgagtgaaatccgagttggtttccttataacgtcgctcaacgttattcacaacaccttcgaaagtggcatccacatcacgaactccgccaaattcattttcatagtgaaaatgaaagggtgtttcaccgttcccatacagtaccattgattgttgtttttgtggcagatcttcaaatggcgtatccatgtcaatgtcattttgctcagcaaattggcggagcatttcaggataatactgtgacgaaatcgggttccaaggtagtaaagctccttcgttaagggtcttattacgatcaggaatcacgagatcttcgtccacttccaacttcatccccaggccttcacattcaggacaagcgcctaatggtgcattgaatgaaaacaaccgcggctccatttcaccaaccgtaaatccacaaattgggcaggcataatgctccgaaaaggccagggaatctccgccaataatatcagcagtcgcatatccatcacttaaccgcaaggccgcttcaaatgaatcgaataaccgtgaccgaatcccagatttcaccacgatccgatcaatcacaatatcaacactatgcttttgatttttattaagttctggtacctcatcaatgtcgtaaatctcaccatcaactcgaactcgaataaagccctcacgtttaattttttcgaaattcttcttttgaccgccctttttatcccggacgattggtgacagtatttgtagcttagttcgttcgggtagctctaggacccgatcgaccatttgttctggtgactgactcgtaatcggagtgccatcattaggacagattggcgttccaacccgtgcccaaagcaatcgcagataatcgttgatttcggtaaccgtcccaaccgtcgaacgcggatttttggatgtcgttttttgatcaatcgagatcgctggtgacaaaccgtcaatcgaatcgacatccggtttatccatttgccccagaaattgacgcgcatacgcagacagactctcaacgtaccgtcgttgtccctccgcatacaatgtatcaaacgccaacgaactcttaccagagccggataagccggttaccacaaccaatttatttttcggaatcgtcacatcaatattttgtagattatgtgcacgagccccgtgaattttaattttgtcgttaattgccaatcgatttttcctcctgatgttgaatcagttttaccattaatccatctgtgtcttcagttccatcactgtgtctcgaagagtggctgcttgttcaaagtccagccgtttagcagccgccttcatctgctcttcaagttggtgcaccatttccttttggtcatccttagccatatcggcaaagtcctgttccgtaaagtcatccttttgaccactatcatcggtttctttggtaaccgtaattgcctcacgtatgtccttcttaatggtgtgtggcgtaatatgatggtcctggttgtactgctcttgaatttcacgccgacgctgggtttcatccatcgccgcctgcatcgaatccgtaacatgatctgcgtacataatcacgtgcccattttcatttcgggctgcccgaccaattgtttgaatcagcgaccgttcattacgtaagaagccttccttatccgcatctaaaattgcaactaaggatacctcaggaacatctaacccttcccgcaacagattaattccaaccaagacatcaaatttgccaagacgtaagtcacggataatctcagttcgttccaacgtcttaatgtcactatgcaggtacttgaccttgagtcccagatcctttaagtaatcacttaaatcctcagacatttttttagtcaatgtcgtaataaagacccgttcattacgctcaatacgcgcattaatttcaccaactaaatcatcaatttgtcccatcaccggccgaacctcgatcgtagggtccaataaaccggttggtcgaataatttgttgcacaacatgatccgtttgctcttcttcgtacggaccaggagtggccgacatgtagatgatttgattaacatgttgctcaaactctttcaactttagtggccggttatccaacgcacttggtaagcgaaatccatagtctaccaacatttgctttcgtgatcggtcaccgttgtacatgcctcgaacctgtggcatcgtttgatgggattcatcaacaatcatcaaaaaatcctttggaaagaagtccagtagtgtatatggtggttcaccaggctggcgcccatccatatgccgagaatagttttcaattcctgatgtatatcccatttcacgaagcatttcaatgtcgtatgttgttcgctgtttaagtcgttgggcttccaatagctttccggaatcgtttaatacttttagacgatcttctagttccgcttcaattccgtcaatcgcctgctccatcatatcttcatttgtcatgaagtgagtggccgggaaaattgagacgtggtcacgatcaccgatgacttcacccgtcaaggcatctacttctcgaattcggtcaatctcatccccaaagaattcgattcgaagggcccgctcatctcgcgaggcgggaaagacttccacaacatccccatgtacacggaagcggccccgttgaaaatcaatatcattccgttcaaattgaatatcaactaaatcagtaagcaactgattgcgctcaatttccatgccgacccgtaatgacaaaacatgatcccgatattcacgtggatcccctaacccaaaaatactggaaaccgacgccacgacaatcacatcgttacgttccaaaagagagctcgtcgcggaatgccgtagtttatcaatttcatcgttaattgaagaatctttttcaatatacgtatcacttgaaggaacataggcctcgggttgatagtaatcatagtaactcacaaagtattcgacggcattattcgggaaaaattgcttaaattcaccgtatagttgtccagctaatgttttattatgcgacaaaatcaaggtcggtcgattaacattttttataacgttagaaattgtaaatgtttttcccgtcccagttgcaccaagcaagatttgagacttagtcccatcctcaagtccctttgttaattcctcaattgctttcggctgatcaccggttggctgatagggtgaaactaaatcaaacttacgatctggttgacgataaatcacaactgttacctcctcattgcgcgacactagcatagcaaaagaaacggtcctgtcattcaatcaacactttgaaaccgtctctatttttttaattattttaatcgttcacatgtccattcatactatcacacgaacatgcattcgtctagtcacttgcttactttgcttgattttcaacaatttggttcgtgatcgatcgcaactgatcccgatcaccggcactgtcttcaatcaaatcaggcaaaatttcatgcaagtaatattgcacactcgctaattcacgaaaatccatcattgtttttagactttcacgataaatatcaacgtacaccgtttctggattgcccttttgaatttcaccaaaggattcgtacattaaatcaattttatcagctaccgataaaatttttccttccagtgtgtcatctttactttcggaaaagcgccggcgataggccgcttgaaactcggcgggaatatcatcttcaatgaaattttcagtcattgattcttctacatcggctaacatttggcgtaattccggtgttgcatacttaaccggtgttttgatgtcgccaataaaccgttcagtgtaatcatgattcagtgctttttcgtacaatgctcgccaatcaacggtatgccccgcattctcttcaatatctccgagcatctgggctgcttgggcgactttaaacgagtgtgccgctaccgtatgcttttctaacttaaagtatccgggtgcccggttcatcatttccaaattacttaaactttttaaatattgatgcatccccattataaattcctcccagatacacaaatgtctgggacaccattatcccagacatctcatgtaattattatgcaataaattgagtgagtgctgcttcaaagtcggctaatttttggttagcagccgccaatgaatcggcattcgtcccaacataaaacttcaatttaggttccgtaccggatggccgaattgcaatccaggttccgtcatccaagatgtacttcaacacattagccaccggtaaggacaattcggtcgtcttaccattagtcgtagtggtttgctgactaaagtcttcggtcgtcaccacttgatgaccagcaaaggcggttggcgcttcttcccggaatttcttcatcaaggttttaatcttctcgggaccaccaacaccctcgtacaactgtgaaattgtcttttcacggaaataaccatattccttaaataactcttgcagcccatcgtacaacgtcttgccctggtggcggtagtaggctgccacttcagctaacaagaccaaagactgaatggcatccttatcatgtgcaaatggtttaaccaagtaaccataactttcctcaaagccaaacatgtaggtgtgttctccggtcgcctcaaaatgctcaatttgttgggcaatgtacttgaaacctgttaacacattgatcatttcaacaccgtagctattagcaatcttagtggcaaattcagttgaaacgatcgactttactacagcagcattggctggtaaatcgcccgcctgcttgtgtgcctccaaaatgtagtgtaacaggacagaagcaatttggttgccagttaacagttgatactcaccgtttggttggcgaacagccgtccccaaacgatccgcatcgggatcagtagcgattaaaacatcagcgtcaacttgcttgccaagcgcgatcgccaagtcaaatgcagctgcatcctctggattgggtttcgtaaccgttggaaagtcgccatcaggcttagcttgctgtggtacgatctcataattcgtgaaaccagcattttgcaatgccttttcacccaacatttgtccagttccgtgcaatggtgtaaagaccagcttcatatccttgccttcttcacgggctaggtcggcattgatggtgaccgtcttgacgttttctaagtaggcttgatcaatatcgtcaccaataatagtcatggtttggtcagccttcaattgtgcttcgtctgccaccggaatagcaaacaaatccgtggctttccgaacataacttgtaattaaatctgattccttcggtggcatttgaccaccatcttcgccatagatcttatacccgttatattcctttgggttatggctagcagtaatcatgataccagcatacgtcttcagatgacgaactgtgaaggacaactctggtgttgggcgtaagccttcaaacacaaagctcttaataccatgttggcccagtacccgtgctgcttcatgggcaaactcctgtgagtggtgccgtgaatcgaaactaattgcaacaccgcgatctttcacctgctgatccaacgtgtccataaaactggcaagcccttcagttgcctggcgcactgtgtagatattcattcgattaataccaggaccaagtaatccccgcattcctgccgtaccaaacgataatggtgcgtaaaaagcgtcttctaaccgatcatcctgaccagctagttgatcgagttcctgctttaatccagcttcaagatttgattcgtttaaccaagtttgataagtttctttccaactcacaactagtttcccccatccgtttcttttatctctctcagtataccgcactctatttttaggtgaaaggaaaaccaaaaaatagccccggtaagtttttaccggagctacttgtatttcttatgcacgcgctgtttgtgcttttaagctttcaatgtagttgaaaacaccctgtccagcgacaccaccgtcgccaacagccgttgtaatttgacgcaactttttatcacgaacatccccaattgcaaagatgccaggaaccttagttgccatctgagtatccgtttcaatccagccttgatcgtctaaaatgcctaagttttggaatggtgtggtcattggtaatacaccaacataaatgaagacgccgctcgcatcaagttgcgtttcttcaccagtttggttgttcttaactttgacgccggtcaccttttgctcgtcaccctcaatggcgacaacattactattccaaacaaaatccatcttatcgttggaaaatgcccgatcttgaataatcttctgagcacgtaattgatcgcgccggtgaataaccgttaccttatccgcaagttgggtcaagtaaaggccttcttcgatcgcggaatcaccaccaccaacaacgatcacatgtttatttttgaaaaaggcaccgtcgcagaccgcgcagtacgaaacaccacggccaccgtactgttcctcgccatcgacaccgagcttcttatattctgaacccgtaccaataatgatagccttcgtttcgtacgtttccatatcggtggttaccgtcttggttgcaccatggtcttcgattttttccaccgttccaaaggcgtattcggccccaaactgcgtggcactatcatacatttccttcgataaatcaggtcctaaaattgatttgaagccaggatagttttcgattgctgccgtgttattcatttgaccgccatacacaccccgatcaagcattaatactgataagtttgcacgtgatgcatatagtgccgctgtcattccaccggggcctgccccaatcacaatgacgtcataatttttggccataattcaagccctcctcattaatttcgataatgcgtataagatacactgaaacagctcgtttgtctaatgttttgtttcaaaaagtaagtgaatgttcttcattcgttttcacaaacaaaaaggtgtttcgcaaactcgaaacaccgtttagtttactgattattttgatcctcatcaaccaaccgggcactcaattgtttgagatactcacgtaattgatccttaacttcagggtgttttaacccatattcgatgttcgtttgaatccacccaaacttgttgccaacgtcatagcgggcacccttaaactcgcgggcaaaaacccgttgcgttttattcaacgtattaatggcatctgtcagttgaatttcgccacccttgcccggcgccgtcttttccagcacatcaaaaatttcgggcgtcagcaaatagcggccaataatggccagatcactgggtgcatcagccggattcggtttttcaacaaagttagcaacattgtaaagaccgggtttaaaaacgttagtcggattaatgacaccatattttgcggtatcttcatgtggcaccttcataacggccagcgtggaggccccagtatcacgataactatccatcagttggcgtgtaagtggtaccttatcctccatcagatcatccccaagcatcactacgaagggttcatcaccaataaacgccttagcagttagtacagcatcccccaatccgcgtggatgagattgacgaatgaaatataaattaatatccgttgtttcctgcaccattttaagcatggcatctttacgcttttgttccaagttggattccaactcaggattagaatcaaaatgatcttcgattgaacgcttgctctttccatcaacaaccacaatatcttcgattcccgatttacgagcctcttcaacaataaattgaattgttggcttatctacaattggtagcatttctttggcaagtgctttagtcgctggtaaaaaacgggttccaagtccagcggctggaataacggcctttcttacttttttcatcgtgttgctaattcctttcgtctcttataaataaatgtcctattcaacttcagaagttacttcacgttgcattaatccgttaatcgccgttttgacgttggctccctcatacaaaacctgataaatggcctccgtaattggcattgaaacgttacgttgccggctcagttcgtaggccgctttagttgtatagaccccttcaatgaccatccccatgtcatccatcacttctttaagtgattttccctgaccaagttggttgccagctcgccaattccgcgagttcacgctcgtcgcggtcacaattaaatctccaacacctgacaatccgatgaaggtaaatggattagcgccaaaagccacccctaagcgccgaatttctgttaatccacgcgtaattagtgcggccttcgcattgtcatggtaacctaacccgttaataatgccggccccaatcgcaataatgtttttcagcgctgcgccgaattcggcaccgataacatcgtcatttgtgtatactcggaaataatcgttactaaatagttgttgcaccttttcagcaccggcaacatcattgcaggccgctgtgacagaagtcagatcccgtcgagcaacgtcttcagcgtggcttggtcctgatagaacaacaatgccagagcggttttctggttgaatctcttcagcaagcatttctgatggacgtttataagtctgttgctccagccctttagttgcatgcacaatcaatgacttctggcccagttcgttcaatagttggccgagtcggcctccgacctcccgaattgctttagttggtaccacaaccaataccacgtcggcacccgcaactgccgatttcatgtcactagtagctttcaaggctgtcgaataggtaaaatctttgatgtaccgagggtttacgtgctcttcgttcaattgacgtacttgctcttccttatgtgaccagagcatcacgtcgtgaccattttctgctaataaattggctaagatactcccccaggagccggcccctagcactgctactttttccgtcataatgacttaatcccctttcacaaccttcaacgatttatcttggcactatctaaataccatgggtgagaccgtgttttgcgacgaacaccccatatgatgatggcaccaacaaacagcaccaccgataataactgtgaaacccgtaatgtattgccaatcatcaagctatccgtccgcattccttcaataaagaagcggcctgccgaataccaaatcaagtacgtgaggaaaatctctccacgcttgaaaagatgtttacgatggcggatcaacataatcacaataaagcctaggaggtcccagcatgattcgtataaaaatgtgggaattcgataatgcccaccaatatacatttgattaataattaaatttggtaaatgtaagctcatcaagaaagccttactggtaattttaccgaaggcttcttgattcataaagttcccccaccggcccattgcttgagccaaaataaccgttggtgcaaccacatctagcatggtccacatcgaaatatgattgtaccggcagaagaaatacatcaccgcaaacgcaccgataagtgagccatagatggcaataccaccatcccagacggcaataatttcaccggtgtgttgtgaataataaggccactcaaaaatgacatagtacgcccgtgcactgataattgcgatcggcaacgcccacaaaatgtaatcataaaaatgatcaggatcaatgcctcgacgttgtccttcacgaacagacaacgtcaatgccaccaacacggcgcaggcaataatcacaccgtaccaatgaatttcgatcggtcctaatcgaagcgcgatcgggtttagagcagccatcacagtatttgaaaacataaaaagttagtccttcttcgaattttcttgaatcaaccgattcagattatcatcaaatgtttcggttgcgtcatatcccatcgtttgagcacgatagttcatggccgccgattcaatgataattgctaagtttcgaccagttttaactggaattgcgacacgtggtaccaccacatctaaaatttgttgggtatctccccgatcaccgagacggtcaaactgaacatcaggcgcccaagtttctaggtgcacgataagatcgacatcgtcttcttgcataaccgcgcccgcaccatatagggtcatgacatcgatgatcccgatcccacgaatttccatcaagtgctccaaaatagcgggtgctgatccgaccagtgtttgttcatcctgtgcataaacttcaactcggtcatctgcaactagtcggtgcccccgtcgaactaattccagcgcagtttcgcttttcccgacaccagaatcaccggtgatcagtacgccaacaccattgatatcgaccagaaccccatggacagattcccgcttagccaacttaccactcaggtaaaatgtcatattacttaaaattctagaagaagttaacttggtccctaaaataggaattttggtttcttcagccgcttgcttcagctcttcaggcactggtaaatcggtcgacaccacgaaggttggtgtttctggtgcacacattttacgcatgaccatcagcaattcatcgtgagtcatatttttggcaaatgacgtctccgtaattcctaacaactgaattcgtggtgctggataatacttaaagtatcccgtgagttcgagtccaggacgtgagatatcgctagtagtcactgggcgatctaggtaatcctcaccctgtagtaccttcatgcgtacgttttttactaagtctgctaccgttactgaatttgccaaaataatctcctccttaccaaccacctagttagccacgtcggttaacaaaatgactggaaataattgcattacatactgaaatgataattgcgacaataattgacacgccaaatgacgaaaaatgaaaattattagcgcccacaaagtacgatgttaattgcaacataactgcattaagaataatactaaatagccccagtgtcattaccgtgatgggcagtgacagtagaaacaaaatcggccgtactagtgcgttcaagacggctaatacaagacttgccaaaaaggccgccccgattccggtgacataaaatgcaccgctttgagataggaaccctgcaattgcaatgaatagcaccgtgttgacgcagattctcgtccaaaaccccattaattacttatcctccttatcgtcgttttcatctacatcgtgcagaactttccgtcccgactgccccttatcgggcgtcgattgatgattaccaaaatttgaaaagaagcttgtccaacttgttttattgggatccgcaggcattaaaatggccagtagaagatacactaaaatccctggaaatccacgtagtagtacggctaatatcacaaaagcgacccgcaggtagtttgcattgattccaaaatagtcacctaggccccccatgacgcccgcaatcattcgattacttgctgagcgggttaaccgctttttttgtcttgatcccatacttattccacctttaatttactaggtttatcttactgttttaccgtcacaaaggcaaccgaaagcgatatttttaaattgatctcaactatttgtaactggtcttgaaaacaaaaagatcgttatttttttcaaaataggcgacctttaaattaattattctggatttttttgactcaaccgccattgaaggtaagcatcaatgaacggatctaaattaccatccattacggcatttccatcatgggtctcgtaattcgttcggtgatccttaaccatcgtgtaaggatgaaagacgtatgaccgaatctgtgatccccacccaatatccatctgttctccttgaattgccgcccgctgtttagctttcttttcttcctctaactggtacagcttagatttcaacatgttcattgcggtctcccggttttgcagctgtgaccgttgagcctgtgacgaaaccacaattcccgttggtaaatgggtgatccggacagctgatgacgtcttgtttatgtgttgaccacccgccccactggaacgaaaaacatctacccgcaaatcgtcactgttgacttcaatctccgtcgtgttatccaattctggcatcacatccacagaagcaaacgaggtatggcgccgaccggccgcatcaaatggtgaaattcgaactagccgatgaacccccttctccgagcgcaagtatccgtacgcattgtgcccattgacaaggaccgttacacttttaattccggcttcatcaccagcctcataatcagcgacttcaacttgaaattggtgttgtccagcccaacgtgtatacatccgcagcaacatttcaccccagtcctgcgattcggttccaccagcaccggggtgaatttctaaaatcgcattgttggcatcataaggttcgtccagcaactgttccagtcggtactgctccaactgctcacccacccgttcaagatcatggtcaaactgtcgttgcatatcttcatcgggctcctcttggagtaggcttaatgtcacttctagatcttcaacaccatcactaaggtgaacaaaattatcccgcttagcctttaattgattcgtcgtttcgatcagttgttgtgctttttcaccattatcccaaaacccaggctcagccatttgtgcttcgctttcggcaattcgttcatctaacgcatcgaggtcaaagcgacctcccgaagttagcaacttcttgttgcatatcttctattgtttttttgacttcactcagttccataatttcctccatttaaagcaacaaaaaggcgtagaaagattcctccccctatgcctctttattcaaactaccgtgcaacattttgtcgaatttccgacttcataaacaggcgggtagcttcgtactcaatatctgcaatcatttcttcaaacatgtggaatccagcagtttgatattcaactagcggatttagttggccatatccacgtagtccaactgactgccggaattgatccattgcgtcgatgtgatcggtccaatgtgaatcaaccacccgcaaaacaactactttttcaaactccagcatttgggccggatcataaagctgtttttgcttctcggcatagatcttctccgcaaagcccatcatcttatcaagcatttcatcacgagaaagacccttcaaatcattttcggtcaactcaccgggtttagttaataccgcttctgcaaacgcaataatatcaaccaagttccattctgcttggctccccagcgtatgcatgtcaatcgtccgcttgattgtccgcttcaccattggcatcagaacgtctttcaaggattgcttttcagtaattatctgttgccgttccttgtaaataatttcacgctgctcacgcataacatcatcatattgtaaaacgttcttccgagaatcatagttatttccttcaacccgcttttgagctgattcaacttgccgagaaagaaggcgactcttaatgactgcatcctcatcgtcaacgttcatgcgttccaagaaggctttaatccgatcgccaccaaagcgacgcattaaatcatcctctagagacaggtagaattgtgaaattcccggatccccttgacggccagaacggccacgcagttggttatcaatccgtcgtgattcatgacgttcagtcccaatcacggctaatccgccggcttcaaccacgccagggcctaatttaatatcagttccccgaccagccatgttggtggcgattgtaacggcacccttttgaccggcatttttaacaatttcggcttctcgagcatggttcttggcattcaaaacaacgtgaggaatattttcttcgtccaacaagttggccaaatattctgacgtttccacggctacggtccccactaaaatcggttgtcccttttcatgaagatctttaatccgcttcgtaacagccgcgaacttactctttaaggttggataaagcagatccggttcatccacccgcgcaaccggcttgttagtcggaatagcaatcgtttccatgttgtaaatttcacggaattcttcttgttccgttttagcagtccccgtcatcccggctaacttcttatacatccggaataagttttgataggtaatgttcgccatcgttttgttttcttcttgaatttcaacgtgttccttggcttcaatcgcctgatgtaatccatcggagaaacgacgaccttccatgatccgtccggtaaacgaatccacgatcaaaacttccccatttgaaaccacataatccttgtcagcaagcatgatgtaattagcgcggagggcttgatctaaatggtgggttaaagccgtattatcagtatcgtataggttttgcagattgaaatacttttcgcccttttcaatccccttatcggttaatgaaaccgtctttgactcccaatcaatcttatagtcgtcttcttcttttaatgttttaacaaaccgatcagttcgttggtacaactgtgacgttcccgttccgggaccagaaatgatcagtggtgtccgggcttcatcaatcaaaatggagtccacttcatcgatgatcgcaaagttaagatcccgttgtacctgatcttctttataaacagccatattatcacgaaggtagtcgaacccgatttcactattggtggaatacgtaatatcacaggcatacgccgcacgcttttcatctggtgtactttcggcaaggttaacgccgacactacagcccaaccaattgtatagttcacccatttcggttgcatcccgttgtgataagtattcattcacggtaatgacgtgggcgcctttgccactaattgcgttcaaatagatcggcatcgtcgccgtcagtgttttcccttcaccggttttcatttcagcaatgttaccttcatgtagcacaatgccccccatgatctgcacgtggaagggatacaagcctaagacacgcttagcaccttcccgactagctgcaaatgcttctggtaagaggtcatctaacgtttctccttgctggtaacgttgacgaaattcatctgtttttgcttgtaactgttcatcgctcaattttgccatctggtcagcaaatgcttcaaccttgttggcaattttattgatgcggcgtaattcatggcgatcgctttcgatccattttttaagtatgtttgccatctattaatcccttctacacagttcgtatctcttaaaatagctcatatgacgcttgattttaatttattttacagtatcaaattgtattctatcattatttgtgatcaatgaaaacaaacaagtccataaaaatcaatgtaagcgggccctaaaaaagctcgaagcgatcaatcgccccgagccctattacatgattaacttagttttcgcttgcttcgatcagaccataacggccgtcgttgcgccggtacacaatgctagtaccgttagtttctgcatcttcgaatacgaagaagtcatggcctaacatatccatctgtaaaatagcttcttcattgtccattggcttcaaagatacctgtttcgttctaacgatcttcagttcttcgtcattaccgtgttcttcggtttgctcgttaggcgtaaactcaagatttttatatcccttttcacgggatttacggttaatcttcgttttatatttccgaatctggcgttccagcttatccgtaaccagatcagcactactgtacatatcaggtgaagtttcttcggcccgcaaagtcagatatggtaatggaatcgtaacttcgaccttggcgttcttattggagtaaacctttaaattaatatgtgccgttgcttcgacactattttcaaagtatttttccagtttgctaatcctcttagttacataatcgcgaattgaatctgtaacctcgatgttttcaccacgaatgttgaacttaagcatagaacatctctcccttcagtacaagtatccacttgtctgataaactaaggatcgctattgcatttatccttacatttattatagattagtttgcatttataaacaatgaaaaagcaaacgatttcacaaattatttagcgtgccaacgttatactttcaatttgactggggtgatacgaccggcatagtgctgccgcgtgatacaacgttcgtccggttgtgtacacgtcatcaactaataacacccttttcccattaatgggtgtctgtgccaatgccgcccccaccatttcaaatggttgcttggtagccaatcgctcctgccgatttttatgtgactgtcgttcttgtttatgatgggcgcgcgtttcaattagtggtttccagtcacaatgagacaacatccccgttacttgattgaagccccgttctttccaagtggccggagtgaccggaattggcacgataacatcggcactaacagtggcaatcatcgcctgtaatggcgcggcaaacacttgtcgtaaccggtagtctcccacaaacttgtactgctgcataaaatcatgaagtgcttcattgtaatgcagtaaactccggttaacgagtaagaaccccgtttgttgctgccattcttgacactgcccacatagttcagtggtcgtttgtggatgcccacagccgcgacatgctgcgcctgtaatccattcaaatcgtccccagcatacttgacagacctgatgatcttgaactggctgccaagccaataactgtttcaatgtcaactcatttttgatgccactaccacatagtaagcacttcatcgttgtagtcttcgcccctttcgattaacaaatttaatctgttgctgtgccccagttacgttttgggcagcactgcccacccaaaataagacatctccggtcgggcgagataccgagcgccccgcgcggcccgcaatttgaaccagcgccgcggtcgaaaaaacagcatcgtccgccccaagaacaagcacatcaatctctggaaaagtaaccccccgctctaaaatagaagtcgttactaaaaagtcaatttgctcgtctcgcatcgcttggaccttagccaggcgatgatcatccgcagcatgcaccgtcgtcaccggaattcccagttgccgttctaaaacggtttgaatcggcgccaagtctgcaacgtgtggcacaaataacaaaaagcgctgatgtgaattaagtcgtttcttcatggctccaatcagcgactgcggcaatcgttgccgacctaatttagtacgccatttgggcactagacgaactttgatttcgggcaacaaatggccgtgataacgaagtggcaaataactaattgtgagttgtttccgccgcacccgttgtagcaaagcttttcccggcgtagctgttaagtataggcaaccaccgtccggtttaatcgcctgttgtgtggcaaaatataactgtggattactcgcatatggaaacgcatcaacttcatcaacaatcaaattgtcaaaagcgtggtaaaatcttagtagttggtgtgtcgtacaaattgttaattgccgataggtatagggttcggtttgtcggccgtgtagtaagcaaatttgttggtgaccaaacgcgcgttgcaatcgtggatacaactctaagcatacgtccactcgtggtgaagctaaggccagtcgctcaccgcgccgaatagccgctgcaagcgcacgaaacagcatttctgttttaccggctcccgtcaccgcccacagtaggtgttcttgatggtgtgctaaacactggtcaacttccctagcacacgcttcttggagcggagataacgttccctcccaagtgagtggctgacgatctgacggaaactggttgggctcaggaagatgataaaaactggccagggttgaaacacgtccaagtgtcaggcactgtgggcaaaagaattggccgcgaggtaacagcgcctcagttttgttggtcaccgtgttacaccgcaagcatcgaacgtcgtggtcctgaattgtcatcgttgccatctcttcaacttgctgtgggggcacaaactcggctggtagctcttgtcgtagtagtcgacgaccataaagtaattcttccattcttgttcacctctaatgacaagatacgataattaacacccatttcattttaaaaggagtcattatgaatcagccttacttaaccatcgcagacaatcacacatttgaacaagttattaaaaaatcccgcttcatttgttcactaggtcgagtttcatcagaggcggaagccaaacaattcctcgcaacgatttctcagcaacatgttaaagctaaccataactgttttgcatacctattgggcgaccacgatgaagttcaacgcgagagtgataacggtgaaccaagtgggaccgccggtgtgccaatcttgcaagctctccaacacacgggcgttcacgacacaattgccgttgttacgcgctattttggcgggattaaattaggcaccggtggcctaattcgggcctacaacggaaccgccgccgcggcaattcacgaagttggcctcattcagcggattttacaggatactgtcatcatccaagtgccatatcatctgcacgatcaagttgtctatgcactagcacaggatcagattgctgtgcacgatcagcagtacggcgttgacgtaacgatgactatttttgtcaatcatgatcaacgtgacgtcatcatttcaaatttgaccaaccagtttcacaatcaactcaccattcaaattggggatccccgattcaacgaagtcccctaccagccggaaaattaaaaagtgtccgcatcccttgcaaaactgcttgggtgcgaacacttttttactattcttttagatggtaattataggttgaaacaataatattttcacgtgaattcaataacgttcgaagccgcaaactcgtctggttatgcaacgccatttgccatggtcgtcgtggcacgaattgcggtaccaaaacggtcgtcgaataattacgggccgttgcccgcttagcgatgacgtcaacaaaccgtaacgtcggtgtcgcaattgaccggtacgatgaatgaatatcaacaaaccgaacatcgggaaattcagccttaaattcgttcgctgttttatgctctttccccggattttcatcgaaggaaacgtgcatggcgatgacgtaatccccaattgaacgggcatagttgatggccccggccgttacccgtgtcacgttgctaaccagcacaatgacagtagcaccctcaaagtccttaatctgaacttgtgttttaccagcgacccgtaattggcgggccaccttctcgtagtgctcatgaatcttgtggaacatgtacaacaggatgggcatgataatcaagtaaggccaaacgttggctaaatgttgccagaacaagaaaacaactagcgataacgaaattaacgcgcccactaagttaatcagcgacttaccaaaccaccaaccatcgcgcgttcggaaccaatgaataatcattcccgactgtgatagtgtgaatggcacaaagaccccaacagcatagagcggaattaacagcgttgttttcccatggaaaataaagatcagggcaacagcccccaacgctaacacgataatcccgttcgaatacccgagtcgatcaccacgatccataaaggcatggggcataaacttgtccttggccaagttgaaggccaaaattgggaacgccgagaaacctgtatttgctgcaaccgccaaaatcatggccgttgatagttgcaagagatagtagccaacgccatgaccaccgaagaccgttgagccaatctgtgacagcacggtgacgtgaccattcggaataattcctaagtaataactcaggaaggtgaccccagcgaagaagctggcaagaatcaaacacataataaccaatgtgttagccgcatttttcgcacgtggtcgattaaagtttggcaccgcgttactaatggcttccaccccggtcaatgaagatgacccagctgaaaacgcccgaataaagagtaccgcggacattccagaaacagcactcccaacggctgcgggggcatgatactggatatggccggtaacaatgttaaagaagccccaaacgatcataataatcatcatgatcacgaaaaaatagactggaattgtcaaaaaattagcactttcactcattccacgtaggttcattgccataattaagaaaacaatgaccaccgagataatcactgaatgcttgtacagtgcaggaaccgccgagactatcgcttcagttgccgacgtcgtcgatacggcaacggtcaacatgtaatcgaccagcaacgagccccctgcgacgagtccaccatcacgcccccaattggtactggcaaccacgtaggcgcccccaccacttgggtaagcatgaataatttgtcgataagatagtgtaattgcaagcaacaaaattaaaacaacggcagcaattggcaatgaataccacagcgctgcagcagacaacgttactaacaccgtcgtaatttgttcagtaccataggccactgatgataacgcgtcagatgataacaacgctaatgctttaaatttagttagatgttggccgccttcatcaagcgtctttaaaggcttgccaattagcaagcgtttcagatagcgccacataattattctcccctcaattaaaaaacaatcatcagtcattgtactacattcaaattttgaatactaccacagatttaatctctttcgaaaacaaagttcaaccctttacccctcaaaaacagaaaaaagcctgagtacaaaactcagactttctccaactacttactatcttaattacatcattccgcccataccggcaccagcagctggtgcagcaggtgctggattatcttctggtttgtcggcaacaacggcttcggtcgtcaacaataatgcagaaacggaagctgcgttttgaagagctgaacgcgttaccttagttggatcaacaattccggcagcaaccatgtcttcaaattcgttcgttgcggcattgtaaccaatgcctggtttttcattcttcaagtgttcaacaatcactgagccttcaaagccggcattttcagcaatttggcgaactggttcttctagtgcgcgcttaacaatcttaacaccggtagcttcgtcgccttcggcttcaacagcagccacgtcgttaatggcattaacaagtgctgtaccaccaccagacacaaagccttcttcgacagcggcacgagtagcatttaaagcatcttcaatccgatacttcttttctttcagttcagtttcggttgcggcaccgacacgaacaactgccacaccgccggccaacttagccaagcgttcttgtaatttttctttgtcaaagtctgaagtcgtttcagcaatttgacccttcaacaaatcaacacgttcttgaatttgttctttggcaccagcaccttcaacgatcgtggtgttttcctttgtcacagtaaccttgttagcttgaccaagttgagccacagttgtgtccttcaagttcaaaccaaggtcatcggtaatgacagtcccaccagtaaggatggcaatatcttcgagttgtgccttccgacgatcaccgaaaccaggtgccttaacagcaaccacgttgaatgtgccacgcatcttgttcaaaacaagggttggtaaggcttcaccagtaatatcatcggcaataattagaagtgaacgactttgttcaacaactgattgtagcaatggcaaaatgtcttgaatgttaccgatcttcttgtccgtgatcaaaatgtatgggttgtcgaggtcagcttccatcttatcgttatcagttaccatgtattgtgacatgtaaccacgatcaaattgcattccttcaacaacgtccaaggttgtatccacaccacgagattcttcgatagtaatgacaccgtcgttaccaactttttccatggcattagcgattaatgcgccaacttctgggttagcagctgaaatcgatgcgatttgtgcaatgtcgtcctttgtcttgacgtcgtgtgacatcttatggagggcatcaacagcagccttagttgctttttcgatcccgcgacggattccaacagggttagcaccagccgtgacgttcttcattccttcgttgacaatcgcctgtgtcaaaacagttgcggttgtcgttccgtcaccagcgatatcgttagtctttgaagcaacttctgaaactaacttggcacccatgttttcaaagtggtcttccaagtcgatggctttagcgatggtcaccccatcattagtgatcgttggtgaaccatatgattgttcaaggacaacgttacgtccctttggtccaattgtggttttaacagtgtttgctaatttatcaacacccttaagcatctgtgcccgagcgtcttcagaaaactttaattcctttgccataatttatttcacctcatagatattgtttaaattaacgtttaagattaattagatctgattgggtcttattcgcccaaactagtcgacgattgcgacaatgtctttttcatggacaaccaggtacttaaccccggcgtattccacttcactgccggcatacttatcaaataagacgcggtcgccttccttaactgaaggagcaagcttttcaccgttatcaaggacacggccctcaccaacggcaactactttagcagtagttggcttttcttgagcattcgatgctaatacaatcccaccgactgttttttcctcttcttgttcagcttctagaacaacgcgatctcctaatggttttaacacgtctatccctccatcaattttaatatttttagcactcgaacacttcaagtgctaatcacaaaatctactatatcattttctgaaccaaatgcaagaaataaccacttaaaaaaacgaggttttcgttgatgtgcgaaaaccccgttatggcaatcttattctgattttttatcgtccgatgatccataatgatcgatgaaataaattaacgtttggagttcgttggtcaaatcgacattttgaacccgcacgcttgctggtactgctaatcggagcggcgtaaagttcatgatcccccgaattccgacttcaaccagttggtccgtgaccgtctgggcagtttcggagggcaccgtcaaaataacaacatcaatttgttgttccttgagttgcttgctcatctccgacattgcgtacacgggtacgccactttgaaccgtgttaataatatcatcattaacatcaaacgcggcgctaatccgcatattaccattttgatgaaaattaaaattaaggagcgcgtggcccaagttaccaaccccgactagggcaacgttcgtcaatttatcttggttcaaaatatttttgaaaaagtccaagaggtccttaacatcgtacccgtaacctcgcttacctaattcaccaaaatatgaaaaatcacgacgtatcgtggccgaatcaacctgaatagcttctgaaagttccgttgatgacacacgttgtttattcgagctcaataaaatatttaaataacgatagtaaatcggcaaccgcttggccgttgcccggggaatcttgcgatctgtcattttttctccttcttcccaactactttgtgaatcccagtcccttactcattctagcataatttaatacattgtgaaacgattttcaaaacaaagcgtggtttcaaagcggaattgcatcaatttgtgctacaattctacttatactaaataaaggaataaatcaatgctactattacaaactaacaacgtggcgcgccggtttggcgccgaaacattatttcataaaattaactttcaaattcaagatcgtggacgagtggcgctcgttggccggaacggagccggtaaaacgacactgctcaaaatcattgcggggatcaacccgcccgatgatggggatgtctcgatgcgcaaagattgtcaaattggttacctggcacaagaccagggactcagtagcgatcaaaccatatgggatgaaatgaatgccgtttttgccaagctgcaccaacaagaacgtcaaattcaacaactcgaacaacaaattagcagtctcgatccccaagctgctaactaccaagatgttttaaatacctacgatcaagttcaaaatgccttttctcaaaacggcggttatacctatgaagctaaaattaaaagtgtgctccacgggtttcattttgaagcggatcgctaccaaaccgtcattaataccctttctggtggtcaaaaaacacaaattgcactcgcaaagctcctgctccaagaacccgatctcctcattttggatgaaccgactaaccacttggacatgcaggtactcgcctggctcgaagattacctgaaaagttacgatggtgctttactgctggtttctcatgaccgttactttctagatcgtatcgtcaatgaagttttcgatctcgaaaatcaaacattaactcattattcaggtaactactctgcctttaccactcataagcaagaacgcctaaaagcggaatggaaacaatacgaaaaacaacaaaccgagattaataagttagaagactttgttaaccgcaatatcgtgcgggcttcaaccacgaaacgcgctcaggcacgacgtaaacaactggagaaaatggatcgccttgatcgtccagaggtggatgactcgtctatccatttcactttcagtgccgatcatcctagcggcaatattgttttggatgttgcggatgccaccatcggttatccagacaaaatcttggcccatccggtaaactttgaaatccgaaaacaccaacgcgttgccatcattggccctaacggtgtcggaaaatcgacgttgcttaaatctattttaaataagatttcgttgcttggtggtcatgttaaaactggtgccaatgttcaaattggttattacgatcaagagcaacaagttttacatccgcaaaagaccgtccttgaagaagtctgggatgattatcccaccgtcgatgaaaaggatattcgttccttgctgggcagttttctctttgtcggggatgacgtttttaaaccggttagcgccctcagtggtggtgagaaggcacgccttcaattaaccaagctatcatttgaacacgctaattttctcattttagacgaacccaccaaccatctggatattgatagtcgtgaagttttggaacaggcaatcaatgaattcgatggtaccgttctcttcgtatcgcatgaccgctacttcattaatcaagtcgcaaccgatattttggcactcgatcagactggtgcgcaacattttgttggtaactacgacgattacctgatcgaactagctaagcaagctggagcagcagatgataccgtaacccccaccgtctccgttgaaaaacagcacgcccaaaaatctttccaacagagtaaggagcaacaaaaacaactccgaaagctggcacgtgtcgttgaggaatacgaaactcaaatgaatgaactagagactaggcaaaccgccattgaaaccgaaatggcacaacccgaactcgcttccgatggtgtcaaattggctgatctacaaaaggaactcgatcacttgaccgctcaacttggtcaagttgaagaggattggacaacagcagctgaatcacttgaaacatttcaagaagaacttaatcaataatttaaagcggtcgtacgcccatctccattagtcaggagatatggcgtacgaccgcttttcagttactatttacttttaattaaaacgataatcccggcatggcattcaaactcatatcggcacgctgaccctttcgataggccacttcccccgccgctccaatcattgccgcgttatcaccgcatagttttaagggcgcctttatcaaggttaccgttggaaattgccgcgttacatctgcttcaagccgctcccggaggccttgattggcagccacacccccagctaaaattaattgcttaactgggtactgttgcagcgccttgagcgtcttttccactaatacatctaccacactttgttggaagctggccgctaagtcattacgatcaagggtttcaccacgttgttcagcattatgaaatgtattgataaatgcactctttaaaccgctaaaactaaagtcatagttgtggtctttctccatcgcacgcggaaaatgaaatgtatcgtggcccgcgtgagcccactcatcgatcgttttccccgctggatatgaaacgcctaggacgcggccaattttatcgtaggcctctccggccgcgtcatcacgcgtttcgccaagaatttcaaaactgtattcgtccttcatgtagacaatctcagtatgcccaccggaaacgagtagcgccatctgaggaaaaacaaattcattcacaaaccgtgcagcataaatgtggcccgccatatgattaacaggaaccaacggtaagtggtgcgcccaggcaaccgctttggcggcagatacccccactaatagtgaaccaactaatcccggtccatacgtgatagcaaccgcctttaaatcatcataggttacgttggcttgatctagggcttcatccaaacaccgtgtgatctgctcaatatgatggcgactggccacttctggcacaacaccaccaaaacgttgatgactgtcgatttgagtggcaataatattagacaaaattttatgaccatcttctactacggacacactggtctcgtcacagcttgattcaaacgctaaaattaaatttctgctcgccaactttattcatttcccttcaagtagtttaaattaagttgcatatctaatgcatcctcacggtcaccaaaatagtaattctttttaacctttcccggtaaaaagcccatttttttgtagagtcgttgtgcatcaacgttactgactcggacttctaagctcattacttccatatcgagtaacaccgccttacgcatcatcttacggattaagaaacgaccaattccgtgactttgaaattccggaactactgcaatattggtaatatgagcttcatttttagtatagctaaacgagcaccccgcaaaagccaccaggcggtcatttttacgtacgaccaaatacaaccgatccttggttcggcgaatctcctgactaaaggcactttcattccaaggcgtcgcaccgtagacctgttgctcaacctgtaaaatttcgggaatatccgtaatctgcgcgtgggcaataaagtatgtctctccattaattttttccaccgcgtttttaaaccgcatgacatctgcaattttttggcgctgttgttgccgttgattgtttaaaaaccactgcttaaacttctcgaacatatgattgttttaactctcctgggtgctttttttgccaattggcttccgcttccgtaattctaagatagtccggaacaaactcatcaagttgtattaccggctgggcgctacgccccaagatggccaaatcatacgctgaaggaatcgcgtagttcgctggtaatcgcgtaatgagtgaatgggcgggcgattgtgcaacctgttcatcaaattgtgcatcgaactccccaaccattgaaactgcttcttggcgttcttcgaccaattgtaacagggcttcaaagctcatatgttgttgcgccagccactcgttcatttgaccttgttgtacctgatatccagccgcaaacacattatttcgacgagcattgaaaatcacaatggttgggcggcctgcctgcaactgcgctacatgagcaccaatgaccttcaaactcgaaacaccaactaaatcaatctgcaacgtatcagcaagtgttttagccgtcgtgaccgcaatccgaacaccggtataggatccgggacccttagcaactacaatccgatctagatcagctggttgccatcccgcaatagccaccaatttttcaatagtgggcatcacatagatactatgatttttggtcaaattgagcgtggttgtcgcgatcaattgatcatcatccgtgattgcgatgcttagcggatgatttgaggtatcaattgctaaaattttcatgtttctcgtcccttcaactcaggtctatcattatttatccgttctatttcgagccagtattcatattaacacaatcaccgacgcaatcaatattttaatccgtttcccgaaactaaaaaagccgtccgaatttttttaattcgaaacgacttgttgaattatattatgcctgccgatcgtcatagccgtttggatgggttgaatgccattgccaagcggtcttaataatatcgtgaacgtcgtcaaattgtggtttccagccaagaatttcacgggcattcttactttcagctaccaacgaatccggatcaccgggacgccgtggtgctaattttgctggaattggttgaccagtcacttcacgcgctgcttctaacatctgcttatttgaaaaaccagttgacgaaccgagattaaatgcccgactgtcgtttccttcagcaagatacttcaaagcaaggatatgagcatctgccaaatccatcacatgaacgtaatcacgtacattagtcccatccggcgtatcataatcatcgccgaaaatgcttaactcatcgcgctttccttgagctacttgcatgataataggaacaaggtgtgtttcaggaccatgatcttcaccaatcgttccatctggcttagccccagcaacgttaaagtaacgcaatgcaacgaagcgaatgccataggcgacatccgcccaatgcatcattttttccatcagtaacttactttccccgtatgggttaattggttcctgtggatcagtttccttgattggaattgattctggcacaccatatgtggcagcagttgatgagaagacaatcttcttcacatcatgatcatgcatggcctcaagtaaggtaatcatgccacccgtattgttatcaaaatacttaagtggtttttccattgattctggtacgatagaaaatgctgcaaaatgaacaactgcatcaatgtcttcactatcaaatactgaatctagaaattttcgatcacgcacatccccttcataaaacttagcctgtgcgttaattgcctttctgtgccccgttgataaattatctactacgacaacgtcttgtccttgttcaactaagcgagcaaccatatgagaaccaatataaccagccccgcctgctactaaaattgacatactatccctccaaccaattgataacaccagtgtaccacaaaaagcaagttatgcgttttcattccaccaacaatttgcttgagcgtgcaattcttgattgacgaggatttgatgtttagtcatgacttgtccctgatcactgcttattgccggcgtaacctgactggttactagatcgccataacgcacttcacgctcgtatttaatcgacattttggttagcgtatgggtcttcaagaaatcagcatccagcgcatccaacatccaatcgaaatagtgggcattattaacatgcagattcgcatcgatatcaaagtagcgtacctggtactgcttttgcgtcaccgcttcttcagtctgaatctcatccggtcgatgcaaccggggaatgcgttttacgggtgccgaatgatacggatagatgacttcatccggaattctaaccatctttcgggtggccatgtccatgaagacaaacaccccattaatgtgggccaactcattacccgccagatccttaatccaaaattcacgaaacgcaaaatacttattgtacgacgttgcacgggtccccagtaggacctgctctccaatctttggaaaatggtcaacaaaaatatcatagctagtgatcacccagccaccaccaacttctttcacagccgcctcaccaattttaagtgcttctgactgcgaaccagatgccaatacggccaagttaatcagcattccgagggtcaaatagcccttggggtcacactcgtagtatgtaatttggtgctgcatttcaaactcgttgtcctttaagaccattttttcaccccttatagttcatggtagtctcgataaacgtcttgccgattcaggccattttgtttcgccacttctttaatcgcagcattcacaggctttccggcttcaatcagtcgatcaatctgttcattgatcggcaacgcgatctccggactagctgataaaacctgatcgaaaccggccaccatgatgacaaattcaccacgaatttgggtatcctgcgtccattgtttgatctcacccagcgtcccccgaataaattcttcgtatttcttcgttagttcacgagccaaaacaacttgatggtcatcaccaaaaacgctcgccatattactaattgttttcttcaaccgatgcggtgcctcgtaaaaaatcatcgtctcttgatgctgctttagggcttgcaactcatcgacttgcaaactattcttacgatctaaaaagccgtaaaagtaaaacggctgtggcactaatcccgatgcgattaagccggtcaagccagcattagcccctggcagtggcacaacggcaatttgggcggccacacaagccgccactaattccttgccgggatcggaaattgacggcattccagcatcactcacctgagcaattgtggtaccagcttgcattttctcgatgagttgtggaatccgttgcgcagtattatgttcgtgaaaactaatttgttttgtctcaatttcaaaatgattcaatagtttttgcgtattgcgcgtatcttccgacgcaattaaatcaacttgttttaacgtttcaacggcccggtaggtcatgtcacccaagttgccaatcggggttggcaccaagtatagacaacccgtggctgttttttcaaagcttttctgtgactgcatattttcctccgaaacggctaattaccacggcgaccaaagattgcatccaagcaaaacgtgcacgattcatggtgatccaaccgtttaccatagtattcgttgcacacatgaaatccctgttcgtacaacttttgcaggttttgccgggaagtcgaaagttcattagattctgattcttggtgactttcagtgataatttcgtgtagatgttcgttttcaattgaaagttccgcattttcctccaggacttccgtaatctgaagctgcaactgttccattctatccaacaaatcctttgtttgccgggtaacccgttcaaaatgatcatagatctgactcttatctaacttttcactcatttcacacctccgaaccaccactaagttcattaatgattttaatcgttagttcttctacaatattctgaaacccaatattttgatcaagcgctcgtctggtctgcaacgtcagctgggcggctcccgtaatgacagcacccgaatacttctgcccaattttctcaatggttcgcgccgccattttgaaactcacacgctcggtgttttggttcaccgacatcatggtgtcccgccataccaacatcaacatgtctagaattgtttgctggtgatcccggttatcggcaaccggcataatttgctgaccaacggcaatgaacgcccgcatatcaccaattgcaaccagccgataccagtccaaaaccgcagtctgagcctgctttagccaatcattttccatccactgctggaccatctcaagcgaattagtcaatccacttgcgacatcaatcacttcacgatcaataccgttagctgacaacagctgtttaaactccgccagcggcagtggtggaaattcaatcacctgcgttcgcgattgaaccgtcggtaaaatcgcccctttgtttgtggtgattaagaacgccacaaaactactggttggctcttctaaaaacttcagcaagctattagcagcactagttgtcattttatcggcttcttggacgataaacactttttgattaccttccacggcacttttactgaattctgatttcaaaaaccgaatttgatctactttaatctgtcgaccatccggtgcaaccataatcacatccggatgaattcggtgtttgatccgttggcactcttcacaggttccatctggatttccctgatcatccacatgcagacaaaaaagacgcattgccacccattgggctaactgtgttttccccgcaccagatggtcccactagcagataagcatgcgctaattcttgttgaccgatcgccgccttaaatcgcgccacaattggttgttgcaacgtcacttcatgttcttcttgcgtacttgtcatctcgatcacactctaaaattgatgaaattgttcaactggcaagacaaacaccgttgcgccaccaacctgaacctcgaccggatatgaagccgatgcatccattgacgcatccattcccacttgaggggtcataaactgaccacgtgaatgtgatgtcgttttgataatatccaagacttcttcaacccgttcatcgtcgacaccaactaaaaacgtcgtatttccagaccgtaaaaagccgccggtactcgataacttcgttgcacgaatattagcctcaataaacgcgttacttaatacgttactgtccttatcctggacaattgcaatgatcattttcatcacttatcactcccaacgtttgacttaattaaaacagattcggatatttttgcaagattgtttttttcaccatcgagattacaacgtctaatggctgactggcatcaatcagcttaattcgctgcggataagcctgttgtagatgcaaatatgactgccttacccgttgatgaaattcaagttgttccacatcgagacggttgatctctcccgtccggtgttccataatccggcgaatgccttcttccgacttaatatccaagtagatggttaagtctggttctagtccatcaatcgcaaactggttcatattccaaacctctcgttcaccaatttctcgacccgcgccttgatatgcgattgagctgtcaacatatcgatcacataacaccacttggccttgatcaagcgccggaataatctgttccactaagtgttgtcgacgtgctgcggcatataacagggcttcagttctcgcatccatttgggtgtttttaggatccaagatgatctgccgaatagcctctgaaatcgaattaccacccggttccctcgttagcatcagttggttgcctagcttggcttgcaactcatcacctaaaattttgatcacactcgttttgccggcgccatcggggccttcaaatgaaataaacttccctgccatgttattctcccaactacattactgtttaacagatatatttcgttccaactgaccatgcacccgtcgccggcgcgcttcacgaaacaggtacaaaaacttttgttcctgtaacttagtttgcatcacaagttcagtattgacatcactttcgtaaaccgccagttgtgtttctttcgcatgatcccagtcggccttcaccgcatagattaaatctaataactgttgatcgtaagtctcttttacttttcgtgcccgctttttaaacatccgttatctccctagatctctgtacgtccttcaacggccttatataatgtcatttcatcggcataatcaatatcggcaccgaccgccaagccatgggccaatcgcgtcactttaatccccgctggtttgatcagccgtgaaaggtacatcgcggttgcttcaccctcagttgaggcattagtggccacaataacttctttgacttcatcgttagtttgcaaacgcgtcagcaaagatgaaatattaatatcttctgggcccgttccttcaattggcgatagcaccccatgtaacacatgatacaggccgtggtattccttcattttttccattgagataacgtctttggactcttcaaccactaaaatcgtactctggtcgcgctgcttgtcgcgacaaattgagcaaggatcttcttccgtcaaattgccacaaatactacaaaaatgcagatcacgtttcgcggctaataatgatttagcaaaattggtcacatcatcactatccatgctaaccgtataaaaagctagtcgggcagctgttttggcaccaatccctggtaatttcatataactatcaatcaattgtgcaattggttctggatactgcatctaactaccttcttctacattcctggaacgcctttagtgtactttcccatcgtttgctgtgttgcattgtcgatctttgataggccatcattaacagcagccaatactaaatcctgtagcatatcaacatcatccggatcaacagcttctgggttgattgttaaatctttcaacttcttatcacctgtaaatgttgctttaaccatatcgtctggtgcaacccccacaaattcttgggcgttcaaagtttcttgttccgccatcatctgtttttgcatcttttgtgcctgcttcatcatttgttgcatatttcccataccacgcatcataattaatttccacctttactttttattagtcgtctttaacttctaccaagtcatcaccgaaaaacttctttgcttcatctaccattttatcatcgatcggttcttctgtgccgggattgtcatcgtcttcatcatttctttttaattggccttcttttgcagcgtcagaatggtcacccaagtgatgttgatcgataaaatcacggcgaatcgttggccattgctccttgggaacaaacacaacggtccgttccgacccactcaatcgattcaagtctgcttccatatcatcttcaagtgactgatcatcggctgccttttgatatagcaaactatattcaaaggccacaatcaccccgtcgtgacttgctgctaccggttgcgaaacatgcagcaatgcccgctgaggcacagataacatgttcaacatgtcatcccacagatcacgaagattgaccaaatcatccttcgttgccgcctccaagattggataaaccttagtcaggttaacctgaacctgacgggtagtagcctttttctttggcgttcgttccgtcgtctcgttacgcccagttgctggttcctgttgcagttgcttaacaaccttttgtagctcttgaacttgttgctgtaacgcagtcacatccggcgcaggttcagttggcgcaaccacgggcgtcgccgtttgggcactgaccgtttcaccggtcagttgcgctaatttgaccgtcaacacttcgaggtaaacgtccggatgggtcgtaaagcgcatttcctgttgaatatcattcaattgatcaatcatcaggtaaattttttcgggactggccaactttgtcaatgtttcaaattgtgctttactcatccccgtacttgtcagatcaaccatttcaggtgcttcttgataaagaagtaaatcacgcgcaaatgaaatcaaatcttcaataaagcgttgtccatctttaccttcatccaggatggcctgcattgtttccaacgccgccgcactttcatgttggttgatttgggtgaagtatttttgcagtaagtctttcgtcacactaccggttacgagcaacgcattatctaacgtcacttcattatcactaaatgataatacctgatccaagatacttagggcgtcacgcattccaccctcggccgcatttgcaatcacccaaagtgcctgttcatcatactcgacctgcttttcacccaaaatgaatttcatgcgctgaaaactatcatcagcagaaattcggcgaaaatcgaatcgttgagttcgtgaaatgatcgtcaacggaattttatggggttctgttgtcgccaaaataaaaaccacgttagccggtggctcttccaaagtttttaaaagggcattaaaagcccccgtcgagagcatgtgaacttcatcaataatatagactttgtaatctgcctgagttggcgcatacttggccttatcccgaatatcacgaatctcttcgacaccattattggacgcagcatcaatttcaataacatcgttcatttgccccgcagtaatttcacgacaggattcacattcattacatggttcaccatctttaagatgatgacagttaattgctttcgcaaatattttagcagctgacgttttacccgttccccgtggaccggtaaacaggtatgcatgactcgtttggtgggtcatcaatgcgtttttgagtgtggttgtgataacaccctgtcccacaatttcatcaaaacgctgtggccgccacacgcgatatagggcctgataactcatgtgattactcctttttaataacgtctattattcgtaatattacccatttaaattcaatatgcatttaatattatcacatttttgaacaactctgaattaaaaactaagctatgaaaaaggaccggcaacaatctgtgattgttccgatcccgttattaacaataaaacttaaggcacaagctacatcaaacttagtgctgcttccttccggacctgacacaattcgtaagcataaccttgccttaaggccttgcggcaataactatcatactatatttgttttgaaaaagctagtcatcacttcgacaatcttttcgcagctcttcttttttgacgaattgcccgaaaaaactgtttaagtaactggctgcacgcctcttccattaaccctgattcaactcgaacctgatgattaaatcggtcatcgtttaataaatgatacaaactatcaaccgtccctgctttgggatctttggcagcatagtagaccgcctcaagacgggcattaacaattgcgccactacacatcatgcaaggctccagcgtcacaaataactggcagtcttccaaccgccagctatgcaacgcctcacacgcttccgtaatggctaacatttcagcatggtaggtcacatcctggaatcgttcacgcatgttatggccccgtccgatgatttgaccatcatggaccaccaccgcgccgattggcacttcaccaaccgttttggccatcttggcttcttcaatcgccgcaatcatgaacgtccgcttttgttgttctgttagcattaactatctatttcctttacgcttttcaaaatatagtagcctttatttcgttgtacgacttcgcaattaccaaaagtttgcgtcattaacttctttgcggacggtgcaccctgctttttttgtagtacaacccataacgtgccgttattaatcaagtgatcattagcactggtaataaaccggtcaacaactgatttccctgctcgtaccggtgggttcgtgacgattgcagcgtactgatccgtcacatgctcgtatccatcggatgcaaaaatttgaacattttcaatctgatttaatcccgcattttcgcgtgccagtgccatcgcaagttcgttaacatctaccatatcaacatttcgattcgaatacttcttagcaagtgctaggccgattggcccataaccacatcctaaatcaaggatcttaccctcaggtaattgatcagtctcgaagcattcaatcattgttcgactaccaaaatcaactgtgtgttttgaaaaaacaccgttatcagtcacaaactgaaatgattgattcagtaattcaaaggaccacgtttttttgtcgtgtaaaacatctggattttgtgtataataatgattgttcaattgatttatctccatttcctagtagttccatcatatcgtattacggaaagaaaaaaaataaaaaaacttggcaattacaaaaagccgtcttatcacaatatatagtagtcaatgttaaagacaccacaagatagtgtgccttcagcattgatttttttatttggcgctgtatactaatagtcagtaatcaaagtaagtgaaggtgaatcacatgggaaagataactgtattttcaaaaaacaactgcattcaatgcaaaatgacaaagcgtttcttaacggaacacaatgtcgacttcgtggaacacaacatcgatgaacaacctgaatacattgacggcctaaagcaggaagggtttcaagcaactcctgttatcaaattagccgatggacatgcattttctggtttccgtccggatgttttgagaaaactagcaatgtaattgcttggggctgaggcaaatccaatttgtgctcagcccttcttattttgtcaggaatcatcgtttaagaaagtgagtgaaaaatttgtcattaaaaaatttgggtaaggttacctattacgatctcaacaacgaaatcaacattcctgttgataaccaaatcccgttgaacaaagatcaagaagcactggccgccttcattcaagaaaacgtccaaccaaataccaaaaagtttgcaacgttacaagaacgattcgattttttaatcgcacataactatattgagcgcgaattcattgaacaatacgactttagttttatcgaaaaactatatcagtaccttaaagatcaagattttcacttcaagtcatttatggctgcttataaattctatgcgcaatacgccctcaaaaccgacgataatgaattttaccttgaaaacttcattgaccgtgtggcgatgaatgccctttactttgctaacggcaacgaacaacttgccttagatttagcaaacgaaatcattcatcaacgctatcaacccgcaaccccttcattcttaaatgccggccgtaaacgtcgtggcgaactcgttagctgttttttaattcaatcaactgacgacatgaatacgattggccggaccattaactccgcgctccaactatcccgaattggtggaggagtgggtatcaatctcagcaatttacgtggtgctggtgaccccattaaaggaatcgaaggtgcagctagtggcgtcgttcccgtcatgaaattgttagaggatagtttttcttactctaaccagcttggtcagcgacaaggtgctggtgtggtttacctgagtgtcttccatcccgacattattcaattcttgtcggctaagaaggaaaacgctgatgaaaagattcggcttaaaaccctatcacttggcgtaacagttcctgataaattctatgaactaactcagaaaaatgaagacatgtacctcttcagtccttacgatgttgaacgtgaataccatacgccattctcatatgtcgatatcactgcggaatacgataatatggtagccaacgaccaaattcacaagcaaaaaattaacgctcgtgagttggaagatgaaattagcaagttacaacaggaatctggctacccgtacatcgttaatattgacactgccaaccgggataatcctatcgatggtaaaatcgtgatgagtaacctctgttccgaaattatgcaggttcaaacgcccgccaccgtcgataatgaacagcattatcaacagatgggaattgacgttagctgtaacttgggctcgaccaacatcgttaaccagatggcttctccagactttggtcactcaattgaagcgatggtccgtgccctcaccttcgtaaccgatacctctaacatcgacgtcgttccaaccatccaaaatgggaatcatctgtcacactcgatcggattaggggccatgggcttacacagctacttcgccaagaaccacatgacctatggttccaaggaagccgttgaatttaccggagtttacttcatgctcttaaactactggacgctcaaagcttctaatgatattgcccgtgaacgtcaagaaactttccacaactttgacaagagtgattacgccaatggatcgtacttcgataagtatctgacaaccgattttggaccacaatcagataaggttaagaccctcttcaatggtatctttattccaacggcggcagattgggctaccttaaaggacaacgttatgaaagacggtctttataatcaaaaccggttggctgtggcaccaaatggctcaatttcctatatcaatgatacaacttcaagcttacatccgatcatcaatcgaattgaagaacgtcaagaaaagaaaattggtaaaatttactatccagcaccatacctatcaaacgacacaattccatactaccaatcagcctacgatatcgatatgcgtaaagtaatcaatatctatgctgcggcccaagagcacgttgatcagtcattgagtttaacactctttatgcgttcaacaatccccgaaggactctacgaatggaaagacggtcgaactaacaaaatgacgactagagacctcaacattcttcgtcattacgcctataataagggtataaaatccatttattatattagaacctttacagatgaccaggatgaaattggtgccaaccaatgcgaaagctgcgttatctaagttaaagagaggaagacaccatggcaaaaaattataaagcaattaactggaaccaagtttcggacgccattgataaggcgacttgggaaaagctgacagaacaattttggttagacacacggatcccagtttccaacgatttaggtgattggcggacacttgataccgatcatcaatggctagtcggccatgtttttggtggtttaaccctattagataccgttcaatccgaacaaggaatggccgctcttcggcaaaacgttcaaacaccccacgaaacggcagtattgaacaacattcaattcatggaatctgttcatgccaagagttattcaactattttctcaaccttgaatacccccgacgaaattgatgaaatttttcagtggtccgactcagaagaattccttcaaaataaggcggttaaaattgccggaatgtatatggacaatgaagttgatccactcaagaaaaaggtcgctaacgtcttcttagagacgttcctcttctactccggcttcttcacccctctctattatcttggtcataacaagctaaacaacgttgccgaaatcattaagctgatcttacgcgacgaatctgtgcatggaacctatattgggtataaattccaggttggtatgaagcaattaagcgaaaagaaacagcaagatatgaaggattggatgtacaacttcttatacgaactgtatgataacgaagaaaaatacactcatattctatacgaccaagtgggctggacggaagaggttctcactttcatccggtataacgccaataaagcgctcatgaaccttggtcaagatccactcttccccgatacctcagccgacgtcaatccgatcgtcatgaacggtatttcgacatctacggccaatcatgatttcttctcccaagttggtaacggctatcggcttggcgaagttgaagccatggaagatagtgattacacgattagtgatccaaacgattaatttacaatagctagtcttaaaaagacagacttcaattaagaagcctgtctttttttacctttcaaacaataaaaaaactgttttggatcgtaatgatccaaaacagttttttaaactgacgaaattacttgattgtaacagttgcgccagcttcttcaagcttagccttgatttcgttagcttcgtcttccttaacgtcttccttgatagctgaaggagcgttgtcaacaagacccttagcatccttaagacccaagccagtgatttcacgaactgccttgatagccttaacctttgcgctacctgctgaagttaattcaacagtgaatgaatccttagcagcagcaccgtcggcacctgcagcacctgcagctgcaactggagcagcagctgaaacgtcgaattcttcttcgattgccttaacaaggtcgctaaggtctgagattgaagcttcttttaatgaagcgatgattgaatctttatcaaaagccattttattttcctccaatagttggtttaactgtttgtttaaatattaagcagctggttcgtcgttttctttgtcaataacagcgttaatggcataagcaacgttgcgaactggtgcttgcaatgttgataacaacattgagagtaagtcttcgcgacttggtaatgtagcaaattcgttaatcttgtcaaggtcagcgattttcttttccaagaaaccacccttgatttcaagagcatcgaattgatctgcatacttcttcaagatcttagctggggcgattgggtcttcgtcagagaaggccacggctgaaggaccattaaagacgtcattcatttcaccataaccagcagcttcagcagcccgtgtcaacaccttgtttttgataacagacattgaaacaccggcttcacgtaattcggcacgtagattggttacttgttcaacagtcaatccacggtagtcaactacgattgctgattcagcattcttgaaacgttctgcagtttctgatactaattgtgcttttgtagcaattgttgcttcactcacagatatacacctcctatattatttgtaagataggatttctcataaaaaaatccctatgtccaccaagacatagagaaaaaatttaacttcctcggcaggttatttgaggcgcaagcgccacctgagtcttaggtgaatatttaattgaactaaaacagtataacagcctgacgagaaaagtcaagatttagaacgaagctaaatcaaggttgatacttgggccaaatgttgatgccaatgaaacatgcttgatgtatgttccacgaactgctgcaggacgggccttagcaacaatttcttcaatggtcttcaagttttcaactaacttagcatcatcaaatgatactttaccagcaggtacatgaacgttaccgtcacgatcagtccggtaagtaaccttaccagcttttgattcagaaacggcttttgtaacatccattgtaaccgtaccagtcttagggtttggcattaagcccttaggtcccaagacacggcctaaacgaccaacttgtgccatcatatcaggcgttgcaattgcaacgtcgaaatctagccaaccgtcttgaatccgagcaaccaaatcatcgtcgccaacaacatcggcaccggcagcttgcgcgtccttagccttgtcgcctttggcaaatacaatcacagtttgttccttaccagtaccatttggtaaaacaacggcaccacgtaattgttggtcagcctgctttgtatcaacgtttaggttaaatgcaatttcaagagttgcatcaaactttgcgaaatcaatttcttttaccaagctaactgcttcgtcaacgctgtataacttttcagcatcaactttcttagcagcatcttggtactttttacctcttttttgagccatctgtgttttcctccttgcaaatgtggtcgaacggagttacctcccacttggtacattcacttttatgaagtacccgaccgctacgttaattagccttcgacaacgaagcccatactacgtgcagtaccttcaatcatgcgcatagctgattcaacattagctgcgtttagatcttgcatcttagttttagcgatttcttccacttgtgccgatgtaactgtggcaactttcttagtgttaggttcgccagaaccgtgttcaacaccagcggccttctttaatagtactgaagcaggtggggtcttagtaatgaagtcgaatgaacgatcttcatatacactgatcacaactggaataagcatacctgcttgatcggcagtacgtgcattaaattcctttgtgaatcccataatattaattcctgcttgacccagcgctggtccaaccggcggtgctggggttgccttaccggcaggaatttgtaacttaacaacattagctactttttttgccacgagacaaaacctccttaagtccgtgttgtggtaatgatggagccttagatttgctcctcccacgtatatgtcgatgacataccttgaaataatatcataaaaaaagcatggagacaagactccatgcaaatattattaaactaatttgtcaacctggtcaaaatctaactcggttgaagtctcacggccaaacatttcgatgttaaccttcaacttcatcttttcattatcaatttcggtgatcttaccagttaaatcagcaaaagccccttcaacgatcttaacagtttcgccaacttcaacgtcgagatcctcatgacgcgcactcatacctaatcgacgcaaaaccagttcgacttcgtctggtaacaatggtgttggttttgagcctccaccatgggacccaacgaatccagtaacacctggtgtgttccgtacgatataccaagcctgatccgtcatgaccatttcaactagaacgtagccagggaaagtcttttcaatcttatccttagctttaccatctttaacctcacgaacctcttcttccggaacgactactcgaaaaatgaagtcttccattcccattgattgggcccgtgattctaagttactcttaactcgattttcataaccagaatacgtatgtaaaacgtaccattgtttttcagttgattccacgattaaatctcctaagcttttacctttaatttcatcaaaataaaaaaacctcgcgcaaacgaagttccaacaaaatcagtatatcaaactttagttcatttgactacgattatctaacaaaagcgagtaacccagcttcgattaaccagtcaaataacgcaaaaaataagatgaagaaaattgtcaacgaaagaacaatcgtggtatcacgacgattttcacgtgcagttggccaaacgactaacttcatttccttgccaacatttttaaaaaaacgaaataaatgcatgagacaacctcctaatactacctagtctcctgatgcaacgtatacttttgacagtgtttgcaaaattttttaacttctaagcgttcctgtcgatccgaattagcggcgatggtgtaatttcgtgacccacaaacagaacaagctaacgcgatctttttttgtgtcaacactccacccccatagtcctaggtatcttatcacgaattaaaacagcttgtcaattgaacgcttgtgaatggtcattaaattctaaatcgcatcatccaaatagttcgttaagcttcttgcgacaccgatcaagtgcactcgtgacctttctaacatcacactctagctgatctgcaacttcttgtgcattacagccttgatggattaaagcaaaaattcgtcgttcaaattttgaacacgtcgatagaaattcatgaatactttcctgacatattgtccaatcatcaggtggacaactgccaggatcggccagctcatctgtaaatgattcgtgatcaatgttgatccgttgatcgactttaatgcgtttagcggcattttcatggcggatcagatcataggcatgattacgaagattcaatttaaaaaaataacaaaaagcaacacctcgtgatttattgtaacttcgaatcgtacgccacatgacaacacgagcttcttgctcccagtcctcatcatcgacatcctgaaaataatattgtcgcttcatctttcgaataagtggtaaataacgaccatacagtactttaaagctatccggtacgtgtgccttaatatcatctaatagtttctcatctgtcagatattctcccaaaaggttagtcattttttaactcgctttccaagactaagtaaaacgctttacttatctgttttctacaaatatacgtgataatctgaacagatcaagcaaacgtatgtttatattggtataaaaccgaaaaaagtcgatcaatcattaagttataattagcattataaaaattatatgggaaaaatgatcaattgctcatgattctgccatcatttacagggttaaaagatcgaggatattaactaacttgccacaaaaaaacaagattcatattcgaatcctgctctcttagcgcttataatggtcgtcttgaattgaatccttggtaaattaatagactggcagcaacactcgcatttaagctttgaacatgaccgaccattggaattgtcaacatttcatcgaccgttttcttcattagtgttgaaattcccttaccttcattcccgatcaccaaggctacagctcccgttgcatcccaatgccgatagtccgtgccgttcatatcggttccaaataaccaaacgccacgtttttgaagttccttagcggtctgcactaaattagtaacccgtgctacgggaacatgttcgatcgcccccgttgaggttttcgcaacaactgaagtcaatcctacggcacgtcgttttggaataataaccccatgaacaccggcggcatcggccgttcgaagaatcgaacccaagttgtgtggatcttccaattcatctaaaatcaggaaaaatggcgcttcatcttttgccgccgcccgatcaaataggtcatcaattgttgcatattcgaacgctgcgacggcgaggacaactccctgatggttttgatggttggtcattaaatcgagtttactctttggaacgcttgaaaccactaacccccgttgcttcgccaatttaataatatcgccaattgtgtctgatttaaggccctcttgaataaatgctttattgatctcttgatctgatttcagcgccgccacgactgggtgacgccccataataaaatcagtcgattcgttagttgttggtttcatctttttccgttctccttgcttcaacctgttcaatacaccactgggacaactgggcaagccgatctgtctgttcactgagcttcaagtaccccatcaatgcttcaaaccctgttgatacgcgatacgttaagaccgacgtgtgcttagcgtgggtatgactatttgcattgcgcccccgcttgtagtattcccactcttcatccgttaatagttgatcttcttccattaaggcgatcaaagctgcttgagccttcgcggacacatagtgggttgccaaatggtgtaacttagtgggctttgtcagcccttgttcaattaaatgctgtcgtatatatacctcgtaggcagcatctcctagatatgctagggcaattccattaacctgcttaaaatccatttctgccatgctattcctttctataacgcgttccttgcggcgtatcttcaaggacgatcccttgcgcctttaaatcgtctcgaatctgatcgcttaatgcaaaatcatggtccttgcgcgcttgattacgttgctcaattaacgccttgatcttgtcatcatccaaagactggtccgtttcaaggataattccaaatacgctcattaagtgtgccatcgtttcctgtaattcggtcaccgatacttgttgaaccgtcgcttgctgtgcgtagacattacttaccttaaccaactcatacacggcggcaattgcattttgtgcattaaaatcatcgtccatggcctgcttaaattcagcaaccaagcccaaaacttgttgatgaatttgatcatcactgccagcctgagcatctttttgtcgatacgttaaattatcataggcggtctgaatccgttgcaagttgttggtcgcgtccgtaatattcttttgactatactgaattggccgccggtattgggtagtggccatcaaaaatcgtaaaatttgaggatcaagggttttgataatatcatggacggttacaaagtttcctagtgacttgctcatcttttcgttgtcgtcaccaacggtcacaaagccattgtgcatccaatagcgggcaaacgtctttcccgttttagcttcgctttgggcaatttcgttttcgtgatgtggaaacgcaagatcttgtcccccgccatgaatatcaaaagtatcaccgagatacttggttgacataaccgagcactcaatgtgccagcctggtcgtcccggcccccacggcgaatcccaactaatttcaccaggtttagcggccttccatagcgcaaaatcaattggatcttccttcttattaaactctgcttcatcaacgtgctgactggcgccgacttccagatcatcaattgactggtctgaaagctcaccatagtgcttaaatttacgggcccgataataaacgtcgcccgcgacggcgtaggcgtagcctttatcaattaaatcagacacaaaggtaataatttctggaatattttcggttgcccggggatgctttgtcgctggttcaatattaacagctgttgtatcctccataaaagcctcaatatacttatcagctagttcgggaaccgtaattccctgttcatgtgccgccttaatcatcttatcgtccacgtcagtaaaatttgagacgtaattaacttgataaccactaaactcgaagtaccgtcgaatcgtatcaaacgcaattgcacttcgggcattaccaatgtgaatgtagttgtaaaccgttggaccacagacatacatgttaacaaccccatcattcaggggatgaaaatcttctttttgtcgtgtgagagtattgtacacttttagcattatcaaggctccttctcgtcgaatttcgtcaagctatcgcccacgccgaacccgacagtcttatcttaaaatcagtatcactattttaccacactgccccaacttcatctgatcgatctcatgattccgttgattttgttgccgaattagttaacattaaaaaaaacgtcacattttattcacaaactcgtgctactattaccacagtagcaaggaagatgatttcctgttacacaaacctatatttttcaattactcctcccaatagtaaccgaaaaataagttacgaaatccccccaagattttcgtaatactcctcaaaagatggcttccccgccatctttttttgtataatcaatttatgaacataactcaataatgggggcattactaatggttacacctaatagtattgaaacaccaaatgatggttttctaaacgtccaagcacttgatccgtcaattattgtcgacttaaaatacgcaacacccaataatttcaccggatctcgaatttatgattttaacactgcaattgcacgggctggcaccgttcgcaaattgacacaggccagtcacttactcaaacaacagggatttcgtctcaagatttgggatgcctatcgtcccgtatcggcgcaacaaaaactatttgacgtcaccccagacccaacatgggtggcccaaccggatccgaacttcagtcatcaaaagggggttacgtttgatctaaccctctgcgaactggatggtactgaaatccccatgcagagtagttttgatgacttttcagaaaaggcaacccgtcattatcgccgtaagccctatcaggaacataattaccgtctcttagacacggcgatgcgccaagctggttttgtcggatacgaaaacgaatggtgggattatcgagatacagatatggatacctatggccccgcccaagccgatccagatgattatcaactttcgtaaaaaacaagtcatgactggcaataaccgccaatcatgacttatttttttatcttatttttttaactcatcgatcatttgcttcaaatacttcagtgtttgttcgtacccgattaattcgatactttctggcaactctggtccgtgcatctcatgggtcactgcaatccggattggcatccaaagcttccgtcccttaatcttagtatccttttgaatactcttaatggttttcaaaatttgaacggtattcaagtaatccagcttttgaattcgttgatagaattcttcaatgaccgtcaatgctgtttcttcttgcatttcagcccgtgcatcatcatcaatatctgcacgttcctcaaagaatggttgtgctaacggcacaatttcacgagcataactgatttcacgcttgaaaatactgatgagcttacgtgtccattcaagcttttcagcgttaggctgtttttcaagtaatccagcttcgatcaattgtggcaaagctaaatcaaacacggcatcttcatcggcattcttcatgtattggttattaatccattcaagcttcttgccatcaaatgcagctggtgatttactcagccggttttcatcatacatcttgatgaattccttacgcgtaaagatttcatcttccccaactggtgaccagccaagtagcacaatgaagtttagcatggcgtcaggtaagtagcctagttcacgatactgttcaataaactgtaagactgattcatcccgtttgctgagtttcttgccagtttcggtattgataattaagctcatatggccaaattgtggtgcttcccagccaaaggcttcgtagatcattaattgtttaggcgtgttcgcaacatggtcatcaccacggaatacgtggctaatcttcattaaatgatcgtcaacgaccacggcgaagttataggtcggcataccatcccgtttttgaatgacaaaatcgccaccaattgtattggcatcaaatgaaatatcacccttaactaagtcatgccaagcatacgtttcatccggaacacggaaccgaacaaccggctgtaacccttttgcttcggcatccgcttgagcctgcttaatctcatcggcactcatgcctttgtattcatactcgtagtgtggcatgatttttttggctttttgtgcttctcgatcggcctccagttcgtcctcagtcttatatgacttgtaggcttttccttcatccaaaagttgttgaattaacttaacgtaaatatctttacgttctgattgacggtaagggccaaaatcaccgccaacatcaggaccttcgtcccaatcgagtcccaaccacttcaagttatcgagctgactgcgttcaccatcggcgatgttacgtttagtgtccgtatcctcaatccgaatgataaacttacccttgttgtgacgggcaaataagtagttaaacaatgctgttcgagcgttcccaatgtgtaaatgtcctgtcggacttggagcatagcgcacccgaatgttatttttagccaaaattttacgcctctttcattaataatctcaaaagttgtcatttatagtgtacaggtcttgtaagtaaatttaaagtctatttactttttgtcgtcatttcttttggtgtcaccctcatggtgatcattaattccccgtggagaatgaactggtcttgcaaaaatcatccgaccggcatccgtttgtaaggcactcgtcacctcaacttcaatgtggtcattcatgtagtaacgaccatcttcgacaaccaccatcgtgccatcatccaaataggcaacgccttgctgccgctcggttccttttttaacaaccatgacattcagcgtttcaccaggaatgacccgtggtttcagggcctttgccaagccattaatgttcataacttcaacattttgaaactggatcaccttattaaggttgtaatcattcgtcacaatgacgccatcgacttccttagccaagcgaatcagtttactatccacttctggaatatcttcgaagtccccttcatacatttcaacgggaacgactttttcgctttgcagcttatttaaaatatccaacccacgtcgaccacgaactcgcttaatgctatcactagaatccgcaatgtattgtagttcatacaagacaaaattaggaactaatagggttccctcaataaatcccgttttgacaatatcgtagattcgaccatcaatcaaaatattagtatctaaaattttataatggtgatagtttgcatcctgtttggccataacccggccatccttgctgcctcgtgaacgacggagctgaaataaattacgccactcgtccaatcttgttgttccaatccgaaagccaaagtacccaaataatagcatcaaaatcactggtaccacgttatcgagcactggcacatgtgagttccatagcggggttgacaccagcaccgcaaggactaacccaacaatggtcaacaaacttccaaagaacagataaactggactttgcttggttaagtaagcttcaactttgtttacaaaccgatcgacggagctggcaagaagataggataatagcaaaaacacaacagcgccgataaccaggtcacttgcaaacaagagtgttccagtcagttgaatattaaatgcattccacaaaagcggcaaatagtaaaacccaacagccgcaccaacaatggcaaacgcaattctaattacatgctttttcatgtcgtttttcctccctctttttaatttaaggctcgttttaaagcctctgacaatgtcgccactccgacaacatcaatgccggtcggtggttgccaaccttgcaaattatttttcggaatgaagatgcgcttaaatcctaatttctcagcttctgccacccgttgctcaatacgattaacccgtcggatttcaccggtcaacccgacttcaccaacgaatgcgtcagtcggttgcgtgccctgatcgcgataactggaggcaatgctcattgcaatcgctaaatcaatcgccggttcgtccagtttaactccgccagcagctttcagataagcatcttgattttgtagcatcaaattagcacgcttttccagcaccgccatcaatagtgatacccggttacggttcagccccgttgccgttcgctgagcattaccaaaaacggtgggcgtaatgagtgcctgaatttccactaggatcggccgcgtgccttccattgaaacaacaatggccgatccagtcgcgttctttagccgttcctctaggaaaatttccgatggatttgcgacctctgctaagccttcctctcgcatttcgaaaataccaagttcgtttgtcgaaccaaaccgatttttcactgatcgcaagattcggtaggtatggtgtaaatcaccctcaaagtaaagaacggtatccaccatgtgctccaaaattttaggtcccgcaattgcaccgcccttggtgacatgccccacaatgaagatagtaattccgttgctcttaccaatctgcatcaaatctgctgtcacttcgcggatttgggacacactcccgattgccgaactcacatctggttccgacatagtttgaaccgaatcaatcacgacgtagtctggtttaacatcttcaatcgtttgcttgatcgcgcccatatcggtttcgggatagacgtaaaaggcatccccactaacattcagccgatcagcacgcatcttgatctgcgtcgcactttcttccccagagacataaagaacggtccccccaaccttgttcagttggccggaaacctgtagcagtaacgtggacttgccaattcctgggtcaccaccaattaagattaacgatccgggaacaattcctcccccgagcacccgatccagctcacgaatcttggtctgtgtgcgcggcgtttggcccattttgatctctttaatcttagttggtttagtcttaacgcctgctaagctaacccgactgctgcttgtcggtgtcgctgattgcaccttttcttcgaccaaactattccattcaccgcagttcggacaacgtccaaggtaccgtgaggaactataaccgcaattttgacaaacatactgtatttttgcctttgccattttcgacctccattccgtttaaaattattgtagcacacctgttaattaattctgttgataacgactaactcggcttactttttcgtcgagccaaatccacccttccgttcactagttggttgctcatcattatcagctaataagtagggaataaagattccttgaccgattcgttcacccttcttaatgaccacatctttaaccccaaaattaagtagttggaagaaaatttccccttcattactgtcattatcgtagtaatcagcatccacaattcccaccccattagggagtacgagtcgccgcttcaaaggattgcttgaccgattagccagcattaaaaattcattttctttcatatatgacttaattccggtgggcactaaaaatggctttaaaacctgattggccgcctcgtaatcttcatcatgcaattcttcatgatgaagtaatccccgaataattttgacgaaattaaacttccaaatcgatggcaacacgaaatcttccgaacattcaaaatcgtatccagccgcctgtttcgtctgccgcttaggtaaattaagctgctgatccttttttcctgaaactactgcaaacccacgttccatcttatccacctcgttttttagttaactgcctaattataaaatactgctcccttttttgatactagtatcccttcccaattgcaaaaattaagggaaaatctagaattatatttcatcatttcttttttcttcataaatagcaacatcgcatcctaacaatgcgagttgcagtggggtcatactgaccaaagctggcacttttccgccacgtctgatttgcttatcaagcgcctcaaattatcattgttcgtctaattatagttatcgtctaattgcaattgccgctggtcattatccatagtattcttatgtcgattaggagtttttattttagcaccaaagtttatattggaagcgtttttattcaaacgcattactaatgttactagtgggaggaattagttatgaagaataaaagcaaaaatatcattgccactttagggactacgctgttagtaggatgtgtaacattaccggtttacgcgcaatctacgactgattctttaagcaatagccaaagtatttccaacgcagccactcaaacaagctctgcaaatatggcatctaacgatttatccagtagtgcttccagcaccagtccatctgctggaactaccgtcacgactgatagttccgagactgatccgaaaactacccctgttattcaaacatggtcaatatcggataacagaagtacgagctcgaacatcccgcaaccgaatacttttgaggtgccagacgaaacgaacgtagaaaaattaaaacagcttgatgttcctggatttaagatagatctcgaagcttcttacttttttgaaatcgaccaacagtatagttacagcaaagttttgaacggagtcgggatcaccaatttagatgaacttatatcagcattaaaccagcgaccgatatatgccgttgacggcggtattctcaaaatgcataccgttctcataccaaatcctgaatccattgacatcagttatgttgatagaagcaccggcaaaatactggcaagcacccaagttcaaacaaaatttggatacactgaaaccatcgagcataaatcatttgatgggtatgatctagagcccaaccagcccaccacttatcacgtagtcggtgatggtgaaggaaccaataaggtgactgtttattacacggcaaagacaacatcaggaagtaattcgagtgcgccatctgaacatgagcatgctacagcgacctcaaccaccgttccagcagctactacttcgacggattccaaaacttctggcaataataccaataccctaacaactagcaatgcgcccaaagaaaatgtctcagttgcagtgacacatcaccatctaatcaaaagtaatgattcaaaattacctcaaacttctaataggacagaaaattgggtaaccggcattggcctattcctgatcggcgtgcttggcttggcgagtgtccaactgtatgttaaaaagaaccgtgaaaaaactacccgataagatataaataacaaaagtacctttgaaaatttcaagggtacttttatttttgtcaccgtattcagttatcaaattttttctgtaacgttatacccttcatttaaccaataatgacttaatgcagtcactaacctatagtttaggctgaaacgtttgatacatctgtatttcgtgatagtatatcaccattaaggaaaaagtttacatttaatgcacaatatttgtgaggaggaattcaaatgaattttcagcatgaaaacaaccgaatttatacaacagaccaagatggtaccctgttaggtgaaattgtttttccaaatgtccccgatgtcgctgataccgtcgttgtcgaacgcacatttgtcaatccaattatgcgtggacaaggtttagccgcccagttagtagaacaattttatcaatatgccaaacagcagggactgcatgttcaactcctatgcccatacgcgaaaaaagcctttgatcaaaatcccgactatcaacaactgcttgaccgttaatttgattgcggtcacctcacaagttgactacaatggaagttaactactaaaggagtgatttttttgagccatgcaataacaaatgaacaacttacaggatttcaacaagatctcgctaaacggcctgaagcaccggtcaatgaacgtaccgttactaaaaatgggattcttgctagtagctatgactggcatgcagttagtgagtcgacacctgttttttcgattgatttagataccggcgacgtcgctaaccaaaaacaatctggtcgctgttggatgtttgccgctctcaataccatgcggcacgatatggccaaccgcctaggccttaaaaagtttgaactatcacaggcgtacaccttcttttgggataagttcgaaaaggccaactacttttacgaaaatgtgttaaaaactgctgatcaaccagctgacagccgtgaagttgcttggctgatgacgacaccccaacaagatggcggccaatgggatatgttgtgcgcccttattgaaaaatatgggattgttccgcaatccgcaatgcccgaaacctataattcatctaagtccaatgaaattaacacggcattaaataaaaagctacggcaaaacgcgatcgaattacgacaattggtcgctgatcatgctactgatgacgatattgatgctgcccgtaatcaaatgctcaacgatgtgtatcggatgttagtttacagtttcggccaaccaccactaacatttgacttcgaatatcgcgatgctgacaaacatttccatcgtgataccgacctcacaccaaaacaattttatgatcaatacgtcggctggaacctcaccgactacgtctcaatcatcaacgccccgacggctgacaaaccctataatcaaacctacaccgttgacatgttagggaatgttgtcgatggccgtgcggttaaacatcttaacgttacaatggcggattttaaaaagctggccattgcgcagcttcaagccggtgaaagtgtttggtttggttgtgatgtcggtcaaagttctgatcgtcaaaaaggaatcatggacctcaacatctacggtcaagacgatttatttgccactagctttaagatgagtaaagcacagcgcctcgactacggagaaagtatgatgacgcatgccatggtgcttaccggtgtcgatctcgttgatggtcaaccaaccaagtggaaggttgaaaattcatggggaccaaaagtcggggaaaaaggatatttcgtcatgtctgacgcctggatggatgaatattgttaccagattgtggtcaacaaacaatttctaccagccaacttggctcaggctcaggctacagaaccaaccgtccttaaaccatgggatccgatgggagcccttgcataataacgtcaacaaaaatggtaccaaagcccagtgctttggtaccattttttctatgcagtttgtgcggtcaacgttttctttgtggatgccgctaattctttttgcttcttgatctctgctaagtgaacttcatgggttaagaagcgatgcgttttggcatcgtacccatgcttttgtcctagtttaaccaagtatccgttaatgtagtctacctctgttttacggtagttatgcatatcttggtacatggaaggataatgtaacggattggccacccggctcacatacttaacactttctaattcttcctgccggctattgatcatcttgacgccatcccgttcacaggcgtcatatgcttcgtcaatcaactgtaacgacatttcttcgaaaccttcataatcggcaaactcacccatcgtcatttcaaacatggtgcataaggtgttcacaaccgagttaaataccaccttggccaacaatgttccccgaaaattggtcgttaagttgggatggaactgggctttgtctaactcatcaaccacttgatgggtaaactcatcaggcttttcagtatagttggccagattcatcgttcctgcaccacgcttaccgataaaatcaacatcaccaggcccgttcagaaccgtcgcaactagggccgttcccgctaacaccttgtcaggcttgaagtagtttaataacttatccacatgtcccataccattcatgcatgtcatcgcatattgatgcggcttaaagaagtgtgcgcaccgttccaatactcccgccagctgcatctgtttagtgaaaaagatataacagtctggatcaccttggtaatcctctggatattgcatcgtcatcttaactaaatgacggccttgaccgtcgcgtgaaacataaacgccaccctgacgacgtactgcctcaacctgtggcttccaaggatcaacaaaatcgacttcatttcctgcatcacgtaataataaaccgtagcgtaaccccatggcacctgaaccaacaactgtaaatttcatatgtattcgcgctcctctatgtgtgttcctatgtaaaccaaatatgtatgtgtgtccgatcaattacttaaattaagttaaatgattaagacacctattattctaaacccaaaatgtgaaatgtcaaatgtttttctcattatattctaatttatctcacttgagcctcccctcatgcccgttattttccctcttttaaccaatcaaaaaagttgaaccacccattctcaggataatccaactccactcatttacgttaattcaatttttttcatgacgttcagttgcgcatcaaaatcatacataatgggggccccattggcaatttcaacggtattaatttgatcgtctggaatttcatccaaatacttaacaagtgcccgcaacgtactaccatgggccacaatgagctggttatgcccagccaacaatcgtggtgcaatttgatcgatccagtatggtagtagccgttcctctgtcatttgcagactttcactgagtgggaccgaaacaccaatccgatcataacggcggtcatggtcaggctccgtcaactgcggcggtaaatctcgataacctcgacgccacttgccgacctgttgcgtaccaaatctctgcttggcgacgtctttattcatccctcgcaatgcgccatagtggcgttcgttaagacgccacgtcttatgaatgggcacatataactggtccaactgatcacaaatcaaattggccgtcacaattgcgcgctgtaaataagacgtatgcacgtcatcaaattcaatgtgatgttgcaaaatggcctgggccgcctgatgggcctgagcaatcccattttgtgtcaacggcacatcggaccatcccgtaaaaatgttatcacgatttgcctgactttcaccatgtcgtgtaatgactagctttaccatgtgatcctccctctcatgcccttaatcataacgcatttattaaaggttgagcaagcatcattgatgatcgctaataactttcaactttagttccagcattcgcgccgtacacaatcgtttgcacctttttggcgattttagcaatcttcggaaatccactaaatccactctgaccatgaccatgcgtcataatcactaaaatgtaacgttgtccatttggcatcgtgacaatggcggcatcattgtttgtatcattcaggaatccgaccttgtcttgtaccgtagtccccttattagccgcggcgaccccggttgggataccagttcgataaacttgttctcccattaatttcaaaattttacttcgatcagattggttagtgaagacgccggttcctttagctagatctttcagtaatagttccaaactgtaactcgtagttgtcgcatcctgcccagaaacgaaaacaggtgaataccatccctgtgttttaatgaacgcatcaatcgtgctcattccatagctcgtcaactgactctcggcgtagtcattttcactatttacaatcatagaataaaacccgttcgtatttgtcgtattccacgtaaagttaccatttaatttttgcttcatcagaaacgccgtaataaatagtttatatgtgctggcagctgtttgtgcggtatgagcgttggattccacctctaagctcccttccttgtagacatccgcatatttactcttagacgccgtactgccactagtcgcacccaagttgtagaaactcacactaacggtaccatctttagttaccgaattgagataatttgtcaaatttttcttaatgactgtttgccgtcgtttgacggcttgcgacgtcgtattcgtactacttttcgccgttttagtgccgcttccactgaaatgatgccataaaaaaatggaacataatccaatggctaaaataataatcatatattttttgagttgtcttactattgtgtttttcatcatgtcattcatgctacagacgaaatattgcatttctgatgattttatgtggcctcaaaatgaataaaatatgatttttttatttttatggacatcccgatacgccatatgtacgcaaaaaaagccaaccccactgaggagttgacttcataattagcttatattaacgaggcattacgtaatatgatggtgtgtagtacttcattgaagtaaccttaacaacatcgccggtcttaggtgcatgagtaaatgttccgtcaccgtttgaaatacctacgtgatatggtgcactgtcactaccgaagaatacaagcgcccctttaggtgcactgtaaacgttgtagttgtgagcgccggtagtttgttgcgtgtaagttgtccgaccgttaacacggcttccgtagacacgttgaacaagacctgagcagtctaagttaccgtagctgtatgcttggccaaggtatgcgttccagttgccagttgcagtacttgctgaagtagcggctggtgctgtactttgttgtgtactacgtgcaactgtggtgctgctactctgcgtagttgcagatgcttgaactgtaccagtttgagtagttgttgatgattgagttgcggctgattgcgttgttgcagctgagctagcagcaacacttgaagtagctgcagaactagtagcaactgctgaacttgctacgactgctgagctggtagcaacagcactagaagcagttgctgaactggcaactgttgcactagtagcagttgtcgatgttacggcagtgctggctgctgaagtcgcaactgctgagctagctgctgaaactgaaccagtttgaacaccggggatgttaaggctttggccggcaacgattaagtttgcgtcggctaacttgtttgccttgataattgaatcaattgagacatgatacttttgtgaatatgcccaaacagtatcacctgattgaatttgtaatgagtcggcttgagcaacttgtgtgcccccaacaaataaggctgcggcacccaaagtcccaattaaagtttttttcgctgctgatttaatgatgatcactcctgtgtgttttttatgtgttttagtttttattaataatttacgaaagtaattgtatcgctataagattgcagtttcgtcgcactataattacatttaattacaaatattacattaaagttacaaaaaagcagctatcatgcatggttacgcggttcttaataaaaaaaagataagcaaaatttcacatttttttgcttatcttcatcaaatattctaacttttagtcttttttgtcttttttttgaagatcttcttaagatcaaatcgctaatattgcagtttagtaacaattattcgacacgcatcttacctgcctcacgtcgtttattacccataaaggtgacgactgagccaaagatgataatcacgatgccaatcacggtagtcaccgcaattttgtcaccaatcaagagtgccgcaaaaataggggctaatcctggtttgataaagaacaccagtgaagccgtcgaaacattcgacgtctccattgccaaaaagtaaaacgcaaaaccaccaccggtaacacaaacgcccacaaaaaatagaaaccagaaataatgtaaattcacattcgtaaatagtggaatcgcactgaactgcttcaaccacccgatatgtgagaatgcccgcgcaatcccaggaatattggtaatttctaccagcgccaataattctgctgacccaacaaggaacgtaaagcaggtcatgacaataccattgtatccccgacgaacagacccgtatcgtgaaataatactgtacaggccaaaggtcaacgcggaaataatagctagcgtcaatcccagcggatccgttaaattcgccgggttaacaatcaccaacaagcccacaatcgagataatgaccgcaattaagttggcccgtccaagacgttcatgcaaaatcaaaaatgagaaaataagtgcaaaaacagggttcgcactaaacacaactgcgaccgtcgaagcttgcgtgtacccaatcgacagttgaaaaagtgtcatactgaccactagacacataaacccagtgagcgcgaataatcctaaatcccgccaatgaatcatcatcccctgaattcttaatgtccgaattgcaaatggtagaagcaccaccccaccaataaagaatcgaattaaattaatctgaattggattaaaagcgtctcccactgatttcaacgcaatttccattaaactaaaaaatattgtcgacaacgcaatatacaaccctgttttcttcacaacaatctccttctctaaactaacgacttaataatgaccattaagatgggcacaacaatgatgctcagcagcgttgtctccgtgaccatgatcgccgcataatccgcgtcggcatcatagagcttggaaaccactggtgcattggtcattacgggcattgcagcctgcaaaatgaagacctgcttcatcagtgtatccatggagcttggcaacacaagaagtgccattagcaccggtgcacagatgaaccgcccgaacaaaattcccagcgcatcacgatcaattcgtaagcgcgaaattcccgcattagaaaccgcgatcccaataaataacatcgacattggaatcgtcaaaccacccacatagttcagatcactcataataaacgaaggcagcttaatatgtaggacaacaaaaattattccgactacaaatcccatgaggggcggtgaaaaaatctttttcaacgtcgcaataatattaattttggcactgcccatcccatctcgctggatcagccaaacccctaacgtccaaaaaaacgttgtgttggccatatagtacaccagcacgtaggggagcgaacggtcgccaaacagtgcgaggttgatcggtagtcccacaaacaccgtgttagagttaaaaaacatcgactgaaagaggcccttatgctccgacttgatatggatggttcgcgtaatcaggagtgaaaacacgaataaaatcaacattgaaatgacgggataccgtaaatccggcaacaacgtttttaactcgttagctgtaaaatccttcatgatcgttgtcaccatgtaggcaggtaatgcaatttgcgttaccaacttggaaatcatgcgggtggatttttcatcaaaccatccccgctcgtttaatatgtaaccaatggccaccatgactaaaatgatgaaaacaccggaaacactagaaagaaaaactgccatctctaggcctcctaaaatatgtaatacaagaattatagcacacgaataaatggcgtaaagtgccggaatccggtgctacgcccgcttccaataaaaaaagcggttacatcgtaaccacctcatagtcgccgccattgcgccaaaaattgaataaatttatgttgtcgttgttgcaccaattgttgaccactcacagtatcaagctgttccaaatgctgctgtaaggcacgccgaagatgactaattagctggtcatcttcagcaatgatctgatcaaccaatcctaatttttttagagcagtggccgtcataggcagatcatcactaatatcatgatccgtcgtcacaatggccgcaactgcctcgggtgaggcaacggaaaaaagggcgttttcaagcatcaaaatacggttggcattagcaaacgccagcgccccaccactatgtccttcacccagaaaaacggccacattcggaactgtcagttgtcccatagtatcaatcatgtcggcaattgcctgactctgtccgtgattttcagacgacacactcgcgtcagctcctggagtatcgatcaagctaatgaccggccgattaaatcgctgagcagcaagtactaaccggcgtgctttccgatagccactactggccaccatgccaccgttgaatcgttgtcgttcctgcggactctgcccacgattgatcgcaagaaccgtcaccggtcgtctggcaagaaggccaattccagcaaccaaagcgtgatcgtcaccggttacccgatcaccatgaatttcaacaaaattagttaaaatactgttaatgacatcgttagccgagatatggtcaactgctcgaattttgtttaattgatctttaagcaaaatgtggccccctttggtgtagtaatagaaggttaccaagatagtctcgtatgtctggccgactcacttgatcatcaattaagccctttgtatacaggtcatctgccaattgaaaatgatctggtaactgctcatgccccgtcgcactaataacacgaggaccagcaaatccaatctgagcctgtttttctgcaatcacaatgtcgtttttaaacgcaaagctagctgaaaccccacccattgtgggatctgtcaacacactaatcgatacctgctcctgacgatcaaactgctgcttagtcgccaaaatggtattcatctgcatcaacgaaaagattccctcttgcattcgtgcaccacctgatgcgataaacaaaataaggggtaactgtcgctgaccagcgacttgataaagttgccgtaactgtgcgccaaccgtcgtattcaacgtgcccatcatgaagtgactgtccatcaccccaatcatcgtcgcatacccctgaatggttccctgaccggtcacaatggcctcatctaacccacttcgctgttgatttttcgttaatttttcgtcataacctgtaattttaagccgattttgcgaccgtgctgacggtaacggctggaacgaacctgcatccacagtaatcgccaagcggtcctgcgcacttaatcgttggtaccgtccgcaccgaggacactgtttaatttgtccccattccagctggttgacatgtgcttggcagtaaggacacttactccaggttccctcagttggcaaatgacttgtcattttttaacctctcatctaatgtctgcaccgaaaacttgccgttaagataccaattagtggctacaatttgacgtagtaacgtcaggttggtggccaccccggtcacctcaacctgtgctaacgtggcctgcattttctcgaccgcttgtcggtgagtgggggctaccacaataatcttagctaggagtgcatcgtaataggttggtacctgatcaccactcgcatagccggtgtcaactcgcacatcccttggaaattcaaacttggtcaaccgattctcaccggtcgctcccgtcatgttcaaccgacattcaatcgcgaccccctgcccctcaggcacttgatgcccgagacgtgcttcccgacttgccagttgtaactgtaacatcacgatatctaatccagttgtggtttcggtaaccccgtgttcaacttgcaaacgtgtattcatttcaagaaagtaaaatcgatcctcactgaacaaaaattctacggttccgagtccttggtaacccacgccatccagtaaccgatggaccgcaaccaccaattcacgacgttgagcagccgtaataaacgacgccgggctttcttcgatcactttttgtcgccgaatctgcattgtacagtctcgatcaccgagcactaagatacggccatcctgatcgccaatcacttgcacttcaatatggcgggcatttttaagcactttttctaagtaaatcgcggtacttccaaacgccgaatcagtctctcgcttggcaaccattagttgcgattccaactcatcaggatgattaacaatgcgaattcccttaccgccgccaccctgactagccttgattagtaacggataccccatcttacgagctgactgttggagttgctcaatatcttcaagaacataggtccccggaataatggcgataccacgacttgccgcaaattttcgggccgctgccttgtctcccattaaagaaatgagctttggttgggggcccagccaggtaatcccgcattgcgcgcacatttgtgcaaacaacgcatcttctgctaaaaagccgtatcccggatgaacagcatccacgtgcgcgagaatccccgccatcaagatgccttcccgattcaggtatgactctgaagaagctgccggcccaatacagtaagcttcatcggccatctggacaaattgagctgctcgatcggccgtggaatagaccgcaacggttcgaatattcagttgtcgacaactagccataatccgacaggcgatttcgccacgattcgcaattaatattttcttgaacatgacgcctatgctccctcacgaatctcgatcaacggttgatcatactccacggtctgcccatcttcgcaaagaacccgttccactacaccgctagcgggactggtcacttcattaaacaacttcatactttcgatttgaccaactgtcatccccgtctcaacgcgttgtccgacttgtaacggttcttcattaacatgaaaaataccaatcatgggactcttgaccacaatgacatccccacgggtctgcttttgctgcgtaaactgactggtcgtgtcaggccgctccagttccagttcaaaatcatccagcttaattttggcatggacaaagtctaacgctgctaaatccgtaatcaattgttttaattgttgttcgttcatgacatactcctacaatttgatgaccatacttccataatctaatccagccccaaaaccacttagcaaaataagttgagtctggtctgcagagggcgtcagccgggccagcgtcagcggaatccccgcagaagacgtgttcccgtaacgctccaccgtatgcataaatcgatcaaagggaaggttaagtttttgacaaatcgtctcaataattcgcaaattagcctggtggcagatcactttatccagttggtcgggattaatttgtgccgctgctaacatggttcggatctgctgaggaaccgtatttgtcgcaaattcaaaaacagcgcggccatcctggtaaaacgcgtcggttgtcggataattatcaccggcaatcgtcgtcaatggctgaatctgaccactatgaatcgtggcagcttgacgaccatccgattgaattttttcggtcactaaaaattcttcttctggattctctgtacgggtcaaaatgacaccgcccgcagcatcgccaaaaaataccgctgaggtccggtctgtaaagtccatcatcttggaattaacttcggcactaatgatcatcgcgtgccggaacgtgccgccagccatcatcttatccgcaatactcatcgcaaatacaaaccctgcacatgctgcgctgatatcaaaagctaccgcgttatccgcccctaattttccctggacaatacaagccgttgatggcgtcaaggcatccggcgtaatcgtcgatacaatgagtaagtcaatttgatctgcctctagcttcgcctgttgcagtaattgacgtcctaccgcggttgccaaatcagacgtgttttcaccatccatagcgtagtgccgtgtgtgaatgcccgtatgtgacacaatccagtcatcactggtcggcatcaccgcagccagttcgtcgtttgtaacaacccgctgtggaacgtatccagcagtagcactaatttttgcaaaggccatcgtattccctactttctcgtgaattaaaccaccctattttagccgagtgatcatcaaaatactagcaaataacatttaaaaaagcattaaaaaagagtctggtgaaatcaccaaacccttcagtaagtatgcggcgaagaggacttgaacctccacggtcataattgaccacaagatccttaatcttgcgcgtctgccagttccgccaccgccgcatcaacgaataatatcatagcaaattattcgttacttgacaagcctattttacaaatcaatgttaatttctgttaattttccaccacaacggccacaaacataacgcttagtgttcaaatgacggcttcgtgtaaaccgcatatgacagttttgacactcataaatcacatgtcgttgtactgttgccactgatggtgcatatcgtaacccaccgacttgttgcaacaactgtttgaaagcggcacttcgatgatggtaatcagcccccatgaggtgtaaatggtaatgacatagctcgtgcaaaaccactttttttaaattttcttcgtcgaactgactcaacatcaagggattaatgtcaatgtggtggtccgctaaatgatagcgtccacccgtcgtttttaaccgccgattaaaaaatatttgatgactaaaggaacgatgaaaatactgttgtgaccattgtttcgttcgtttctccaactcttcgttagtcatttccaaccggtttcttaggtgccaccatcgttagctgaattcgttgccgatcaaggtcaacggattccacccatacctcaacgatatcccctacggccaccactttgcttgggtcagaaacgaatttttgacttagtttcgagacgtgcaccaagccgtcatgcttcacgccaatatcaacaaacgccccaaaatcgaccacgttacgcacagtgccttctagttgcataccggtttttaaatcttcaatcgtcaagacatcctgccgcagtagcggtgccggcatgtcatcacgaaggtcccgacctggggcctgtaaactcgccttaatatccatcaaggtttcttttcccaatccagtcgccgtcatcaattggacactatctagtgccttgattttttggctctcagatggctgccccaatcgatctggttggacatccgccatctgcatcatttgcttagcagcactataactttctggatggacatctgtattatctagcggattcttaccgtcgataatgcgtaagaagcccactgcttgttcatatgccttaggtccgagacgagggacctttttcagttgcgcacgagattcataacggccgttttcatcccgatacttcacgatatttaccgcgattgtcttggaaagtcccgaaatatgggtcaaaagctgataactggcagtattcaagttcaccccgacttggttgaccgcccgttcaacgaccgcgtctagctcctgacttaaatttttggctggtagatcatgttggtattgaccaaccccgacagactctggattaattttaaccaattcggctaacggatcttgcaggcggcgcccaatactgatcgcactccgttgttcaacgtgtaagtcagggaattcatcacgagcttcctgactcgccgaataaaccgaagcccccgcttcattgacgatcacatagtagaccggtcgctgaatttgtccgagtgtctccgccacaaattgctcggattcacgactcgcagtcccgtttccaatcgcaatcatttccacctgataacgctcaattaattgtttcaactcaccctgtgccgcatcccgttttttctgtggtgcaggcttatgaggataaatcaccgccttatctaaaaacttgccgttttgatcaataacagccaatttacagcccgtgcggtaggcaggatcaaatcctaacaccactttgcccttcattggcgcctgcattaataagtgatacagattttcaccaaacacctcaatagccttttcctgcgcatcctgagtgagcgtatgtcgtaattctcgttcgattgaaggcccaataaatcgtttataggcatcctcgtaggctgcctgcacaaaggacacggccgctccctgtgcccgatgtccaatcaaccggaaccgtaaatagttcaaaattggcgtttcgtcaatttgaattttgacgttcaaaaccttttctttttcgccacggttaattgcgagaatttgatatgaagacagttttgacagctgttcttcaaattcatagtactgctcataaacccccatttcgtcctgttcctgaccctttttcttgatgctggttaccagcttaccgtgctgcatcgtgaaattacgaacccagttacgaatggtggccacttcactaaacgtttcggccaaaatttcatgagcgccgtccaatgcatcttgggcagtggcaacttccttttctggtgctacgtattgactggcctgagccgttaggttacccggcttaaatgccattagccacgcagctaacggttcaagcccgcgttgcttggcaagcatcgcctttgtctgccgtttttgcttatagggtaagtacagatcttcaacgtcttgaatcttgtcagcctgtgtaatttgtgcctttagtttttcagatagttttccctgttcagcaatgctatttaaaacggcctgtttacgatcttgtaaagtcgtcacccgtttatattcattttggatagctaaaatttggacttcatccaaactaccggtggcctctttacgataccgggcaataaacggaatcgtattgccctgatctaatagatcaagtactgcattcacttgatgatttgaaatatcgtttagttggtgcttaactaacttcactaattgttcttccataacctaaattctcctacctatttaaacacaccggcggagcatttctcgttgaaaaatgctccgcacgtttaagttctattgccaccactcatcgtaaacactgatcggtaagtgacgtttatgttgcgttcttgtataccacgcttcaattttttgtgctgcctgctcgtcaatttcgcgtccttctaaataatcatcgatttgatcatacttaacgccgagtgcgacttcatcgggcagtgctggacgatcgtcttccaagtcagcagttgggaccttgatatacagattttcgggtgcttgtaaagcttgcagtaattgccgcccttggcgcttattcagtcgccaaagaggcgtgatatcggcaccaccgtcaccaaacttcgtgtaaaatccggtcacagcttctgctgcgtgatctgttccaaccactgcaccccgcgtttgcccggcaatgccatactgagcaatcatccgttgacgtgccttaatgttccccttattaaaatcgctaacggttacttgattagcttctaaggcggtcaccatcgcatcggcagccggcttaatgtctacccgcatcacctggtcagcattcataaacgcaatggcttgcatcgcatctgattcatctgcttgattgccatacggtaatcgcaccgcaataaactgatacgcttcgtctccagttcgttctcggagccccgtcgctgccaactgtgctagctttccagctagggttgagtcttgtccaccagaaattcccagtaccaacgttttgagacccgttttacgcaaataatcctgcataaacgtcacacttcggtcaatttctgcctgcacatcaatcgttggttgcacctttaatgccttaataatcgtttgttgtaatggtcgcatagttcgtcctccttaaaatttcagttggttaacgtaattgcgaacccgatgtaaaatcgtcatcttattatcataacaagcttgtgagagatcgacaggatagatttgtggattcaaatcacgcttatattcatcccaaagacgatctaaatgttgcttagacgattcacgaatctcggtcagcgttggcactttatacaccaattttccctgtgcataaattggctgtaataccggccgtgcctcaaagttgaccaccgtcttattaatgtacgtgtagtctgggttaaacatatagagatctttctcttgccggggatcctcgtcaaggagcgtaatgtagtcgccctccgatttaccatcagctttatcagtaattcgccatacctgctttttgcctggtgttgagaccttgacagcgttacttgaaaccttaatcgtatcgaccatctgaccgttagcgtcctcaaacgaaaccagtttatacacggctcccaacgctggctgatcgtacgcggtgatcagttttgttccgacaccccagacatcaatctttgccttttgcatcttgaggttcataatcgtcttttcatcgagatcgtttgaagcatagattttcgcgttcgggaatccagcttcatcaagcatttcacgcacccgtttagaaatataggccatatcaccgctatcgattcgaactccctgaaaattaatctgatcgcccatttctttggcgacgcggatcgcattgggaaccccacttttgagagtatcaaatgtatctacaagaaagacgcagtcccggtgcgtttgtgcgtaggccttgaaagcatcgtaatcgttcatgtaggcctgaaccaacgcgtgggcatgggtaccactaatcggaataccgaataacttacccgctcgcacgttactcgtggcatcaaatccaccaatgtatgccgcccgggtgccccacacggccgcatccatctcctgtgctcggcgcgtaccaaattccaacacggggtcatcccccacaacggacttgatccgcgctgccttagtcgcaattagcgtttggtagttcacaatattaaggagggccgtctccaatagttggcccacaatcaatggtgcatcaacttgcatcatcggctcgttgttgaaaaccaactcaccttccactgcactattgattgccccttcaaacttgaagttacgtaaataatccaggaagccatcatcaaactgaccggtttgctttaaataagcaatgtcggcatccgaaaatttaagttgttccacgtattgaataacacgttccaacccggcaaaaattgcataaccgttgccaaatggcatctcccgaaaatataattcaaaaactgcccggcgattggctaatcccttctgccaatatgtctgcatcatactaagctcgtaggcatccgtatgaagcgttaagctatcgtctgggaactggtatgtcaatgtctttctcccctattcgtttacttttctagcacaaattcaaagcgactacccacgtactgtgtgtgggtgtattcaaacggtcggccattttgcaagtacgaaatctgccgtagccgaagtaaggcttccccccggcgaacattcagatattcagcaatcttttcggacgctgacattgccgacaccgtttgaattgcccgaccaggattcagcccggctttttcttccagtgttttataaaaagaactcgtgacttcttccttactaaaatcagcgattaaatctgcaggtactgccgtcacctcaaaacagatggggatgccacttccgtagcgcacccgttccattctgagtaccttcgtatctttagacagctgcaatcgctcaatttcactttgcgatggtgtcgtaatatggtaagaaatggtcttactcgacggcgttttgccagctgccttcatgagctcggtaaaactggtgaccccggacattttttcctggacctttcggttagccacaaacgtgcccgacccaacgtgccgctccaaaataccatcatccaccaatgtttgaattgcctgacgtagcgtcattcggctaaccttgaacaattcggccagctcacgttcagcaggaattcgttgtcccacctgccatttgccattttcaacatcttgttttatttgattatggatttgaatataaactggtgatgccatcacgccgctcccttcgtcaaccaaacatgtctactttatcttaattatcaaatcgccgaccatagctgtaaacccgttgcaactctagatccccatcaaatacgttcagatcagcatccttcccgatttcgagagttcctttgctgtccagtccaaattcaattgcctggttcacagacgacatgagcacggcctgggcaatcgaacaaccggtgaaacgaatgacgttcttaaaggcgtcatcaaaagtcagtactgaccccgcgaggttgcctgattctaatcgggcctgtttgtccttaacgatcaccttttgaccacccaattcactaataccttctggcatccccttggcccgcattgagtccgtcaccagatcaattttatgtggtcctttttgatcaaaggccagcttgatcatgtccggaacaatatggaaaccatcgcagatcaattcacagtatagatcgtcttcaagcattgcatgaccggttacccccggctcgcggtgcttaaattcacgctgggcgttgtacagatgagtcacgtgggttgcccgactactcaacatctgtgcccgcgtagcattgctatggcctaccgatggaacaatcccgtgggcaagacaatagtcttcaaattcccgtgccccatgatcttcaggcgcataggtaatcaatttaacccgattaccagatagccgattccattcatctaataactcaacgttaggatcctgaatatactttccaggttgggcacccttataaattgccgcaataaagggaccttccaagtgaacgccttgaatgacgggattcttttcagccgcctgcgccactccgaccatcgcatgggcaatattttcatttgattgcgtcatcgtggttggaaaaatactagtgattccttcatgaatcatccggttcaccatttgatcaatctggtcagcatccccgtccatggtatcaaacccgtagccaccatgggtgtgcacatcgataaagcccggaacaatgactcgaccattcacaaattcaacttggtcaccagcctgagctcgaaattcactcatcggtcccactgcttcgatttgttggtcaaaccgaataaacccatcatcgataacatctaatcctgtgtaaatcttggcatgctttaaaacaacactcaactttgatctctcctaatatgtctaaataattaaattaatttttgtttaccgtggcgtcaattcctttgacaaccgctgttgttaagccggcctcttccattgctagcaaaccggccaccgtactgccaccaggggaacaaaccgcatccacaaagtccattggtgtttcatccgtggcacgcaataccatttctgaagacccctgcacggtcatggccgcaattttcgtcgcatccttttttgtaagaccatactttactccggcgcgactgagggcatcgataaagtaatcaacgtaggctggcccacttccggcaatcgcactaaaaatggcaaatttatcttcggcctgccaactcacatcaccaattgcctcaaatagggccgttgcttgttccaaccgcgccccgctaagcgcatcattagcagccagcgccgtcatgccgacgttgccggcaacattaatgttcggtaatgatcgtaaaatcggtagcgccccgccaacttcctcaagatgggcaatggacatgccaccgacgattgaaattaacgtcttcccagctagttcggctttcacttcacgcaatactgcattcgcgtaatctggaatcactgctaaaacaaccacatcactattgacaaccacatcccgattggttgcacaagcactcaaatgatactgctgcgcaaatggttcataactggtcttgtgggcactatgaatcaaaatgttttcactagccacgtgtttagcattaatgagccccttaataattgcacggcccatctctccggcaccaataaatccaattttcatgctttgctttcctcctgcacctttgctcacgatgtaatttattaatttcccttaatgatacaacaaaaccatttctaccgctgtattttcagttaaaattatcgagaattcccaattttttaacgattctctactgtttcccggtttctaaaaaaagggcctgctgtgccgccattttgacataattcaccggttggttgtaccgtggatgaaagaacatatcagtaaaggccagatccacaatcgtattttgattttgaatggcaagtgaaacaatattaattgactgggtaacatcgtgctgacacctgatttgggccccgagaattttccaattatcggcgcgataaattaacgtgaccgttactcgagcatttttcgtcataaactgcggccgataccagccttgatacgtaatacttttcgctggaatttttaacaatcgggcccgatgctccgtgattccagtcatcgtataggtatgattaaagatgcttaacgccgtcgttccttgggttccacgactctcaatcggtgtcccacaaatatggtaagcaacaatctgggcctgccgaatggcatttgtcacctgtggtaaatactgaaattcccccgttgcgttttgatgactatttctatcatcaccagccgcataaacattaggatccgatgtttgcccatatttattggtgattatggccccgccccgatctagctcaacctgtccttgaaccaaattagagaccggcacaaaccctgtacaaacaattgctaaatcgcattcttttcgtaaattacgcgacaccaccgttagcgtatcgcgcgtctcggtaaaacttttcacgggttcgttcacacatacatgaaccccatgttgggtcagtaatttctgcacgcttcgcgccattggtcgatcgtagtagttatctaataaataactcgcactatggtaaagcgtaatatcatgccgttggcaaagggcctcggccagttctactccaatatagccacccccggcaatcacaattgaatgtgcatgctgaacagcaccggcaatatctttcgtcgattgataatccttgaccattaatacgcgatgattattaacgccgtagagtggcggcacgaccacagcagatccagtcgccatcaccaatttgtcataatgatcctcaaactgttcatttgtgattaaattttgcactaaaattgtcttcgtcgtcatatcaattttaaggacatcatgctgcatccgcatggttgccccagcgtgcgtgagcgtcgccacatccatattgaggagttcatcaattttcgttacctgctgactgagatacaagggcacgcccgccccgataaatgccagccgactgccacgttcataaacggtcacgtcaaccgtcggatctagcgccaatatttgaagtgcagcgaccgtgcccgcgtgtgtcgcccccacaataattactttcaccgtttcacttcccatcatcaatctcatttcttcctatatcatagcgctttttaaggtataatagagataattcattaacgacatgcgtttaaattgaggtggaattatcaatttgtcagaagaacaacccttataccgttattttgcacaaccaaaagttaattcatacctcagctctatcattgggtacgaattactactaaaagtttatacaccccatggatggcgaattccagacaattttaatctcattccgagccgcatcattgcgcagcgtctcgttgaagcaactgaaaaactggcctcaaaaattggtagtgtctccgtcaacctgagttcaattcagctgatcaatccactcatccgagaagccttgctccaagcgcaggccaacctccgccccgttcgccttgtaatcgaaatgatcgaggaaaaaaatggagtctcaattcatgatcaccgtgtgctcgccgccgtcaaagattttacagatcaaggtatgagcttttcaatcgatgatgtcgataccggtcaaaatacttgggacaatattcagcccttaattccctacgccacggaaatcaaatatgccttacaaaatcgccatgaacatcttgacgatcccgtcgttcgtgaacgactcatgctttgggcccaacggtgtaagcagcttaatatccacttaattgttgaaggaattgaggatcccgcagacgttgaatgggctgataccttaaaactagatttacgccaggggtatcactacggcaagccccatttggtgcgcttaaaagatagcgatccagactaatactaaagaatagactgagaaaaatgagcaaactttttctcagtctattcttttacacttaatttaatcgttgaaatcgtggtaacgatccctaatgatgtcccaacggcctcgtttttcagcctttttgttgctgcaaatattgtcgcgcggcttctaacatatcctgggtttgttggtttaaaagcggcggtagctgatcaaaaggaaagtatttaacacgcactgtttcgttggttgcatgatctagtgcttgacccccaacttggcgaaccaaaaacaaccccgtgatggtttgcgtgacatccccattgggataatgaacatcgccttcatcaaaaatatcaattcgattgacaattgcgacatcaacaccgctatcttccttatactcccgcacacaggcttgcgcgtatgtttcaccgtactccaaataaccacctggtaaactccaattaccagtgtccacacgctcattcaataggacttcttgccgagcattcactaaaatccccgcagccgtattcataatgattggccggtgtcccactaattttctgatttcatgcacataatcagccatatgctcaccccttcatccctatatcatagatactgcaataacatgtcggtcacttggcggcccgaatgcacaccagcaagatgattgacaatttggccgtttcgtttgattaagaccaggggaacgtgttgaatccccagagctgctgcaacttcaaaatggcggttaaccgtaattgacaaaaatttcacgcggttgtttagccgttgatcatccgccacgtcagccaaaatatgatccatggccgtacaaggggagcaaaaatccatccgaaaatcgatcactgccaagccatccttggttgcctttgcatacatttcatcactaattggtttgatcatttttgcaccgcctcctcacgttatgattagtatcaatctagcgcggacaacgggggatgtcaattatttttgagatgacgccgggcaacgaataaccgcgataccgcgacaatgaacgcgatcaatgataagaatgccgcaaaaataaacacgtgactaaaagcttgcataaaaacaacaccgaggtggggtgtgatgtgattaaccccggggagttgtgcaaacagcaacacggaggccatgctaatgccgatcgtcatcccgagtgttctagcaaaagaattaaacgagccggcaatgcctgataattgctgttcaaccgtccccatcgtgatggcattattcggggacaaaaagagggccattcccaagccattaatcatgaccggtaccaaaatgcgccagtaattgatcgtctgtgggtaactgacatacccaatttgcgaaatcaataacactaaaaggccaatgcaggtgagtacatttcgatccattcgatcggctagatatccggcaaacggggtaatcactagcatcgtggccgactgaacaatcataattaatccgctattgaaggctgaaatgcccacaaagctctgcaagtaaaacggcagtagaatattggacaccgcattcacgagcatgaccagaaataagacactgaccgataccataaatgcttggtttcgtaaaatacggggcgcaatccatggacttttcgagcgattgtcctgaataaacgatccgaccgtgatcaaaacgcccaccaatagtaagatggtacccccgagttcatggcgagtgtggctggtaaatagcatactactcaaaaagaagattaaaatgccgactgtaaataacccttggcccacccaattcgccgttcgtattttttccttgattgccagccaagactcacgtgggatgggcagagcatggcacccaaatagtagtattccgaggcccacggggacgttaaggagaaaaatccaacgccacgatgcgattgacaaaataaacccaccgatggccggaccagaaatcgcgccaatagaaataaatacagaaattgcagatagcgcctccgcacgattttggtccgtaaacttttccgatacaatgcccattgaattcgccataatcatcgcgataccgaccgattggatgacccttccgataattaatatcgtaaaggatggcgcaatcccgttaatcagtgacccgataataaatatcgcaccaccattgatgaaaatataatctttagataaaatatcaccaaagtgaccaaataaaactaagagtaccgtcgtcccaatgagtcccgcctgaaccacccacgtggctaaactatttgaaatattcaaactggttgaaatcttcggcaatgctaaattaatactagatcccgctaaacttgttaaaaatgaaaacatccctaaaacgattacggtctgtatccgttgtgtcttcatttacgatttacctccctaacatcactaaaactgctcggtattaccagatcagtaacaccgagcagttccttttaacttcctaaactgtggcaaatttctgagcagtgcggatcatatttgacacaaacccgtattcgttatcaaaccacgttgctgttttaacaatttgatgggttccacttgtggttacctctgtcagagttggatcgaataccccgccatgggtatcaccaataatgtcggatgagacaatttcttcatcgttccagccatatgattcgttatcaatcgtgtgagtttgcattgtctggttgatttgcgccgccgtcacaccatcagtctttaaaacggagactagctcgcaaaccgacccatcaatcaccgctacccgttgtgcatgcccttgcagatgtccgtcaagctcgggaatcactaggccaattgccttcgcagctcccgtagaatgggggattgtattcgctgatgcagtccggttcggccgtaatttgctactctttgggccatccaaaatcatctgagaactcgtaaaggcatgaataaccgtcatagtcccaacttcgataccaaaatcttgatttagccaataggccattggtgccaatgcattcgtcgtacatgacccggcagatacaattcgatcatcagccgttagcgtgtcatcattgacattgtatacaattgtcttaatcgggcctgctggtgccgagatcaatactttcttcactccggcatctaagtgggcctgcgatttttcttttgaagtgtagaaccctgtgcattccagaactagatcaacaccatcgttagccacccatggtatttcagcggcatcgcgttgcgcatatacccggtatgaccgcccatcaacaatgagggcatcatccgttgctgaaacatcgtacggaaccgtgccatgtgtcgtatcatgtttaaatagataagctaacatcgtgggcgtcgtcaaatcattaattgccgtcaccgtaatttcgctactattcaattccaagattcgtcgtagtgccaatcgaccaattcgaccaaaaccattaatcccaatttttaacatctcactacctccgtaaatcaaacgataagcatcatgaaattgcttacatattatcacaattacaattcagttgaaagccagttacctcaagtactgtacaacgcgccataaaagcgattcacaccgttcaatcgtgcatcaaaagagctccgtcaagcgataaacggaactctcaaccaaaagtaacggtcgttggcttgaccgatagtggcgcatgagactgtctccttgagagacgttgctatcttatcatttttctaacgactccacgtatgaatcaatgatggaaattccgcaattttaactgtttttcaaaatttaatcgaacaaaaataaggaatgccattgtagtttggcattccttatttctggttacatatttcttagctaagccattgctaacgtttcaagataatccccaacggctacccgtacttcatgtaataaaaatttctgactttccggtcgttcatagtctgaaaaaccagtagcggccaaggcatcatctgcacgctgctgtgattgttgatactgctttaaatcttgcttgtggtgaacaccgtactcgaaattctggtatccaaaccgccagccaccaagaacaatttcaaataaatcttctaaagttagtttactttttgctagatcatataagtcatcccagcactgcacctgattgcgtcgcacgatgggcgtcgaaatggtatcatccatcgtcatgaattcaacactgtcagcttggtttaaaaagctaattagttgatgaaataatcgattttcaacttcgttcatgttctgatcgtccactttaacggaaacgactggattagcggaaaaccgtagttcacgatcattactggcagcatggatgccgttacgcatccccgccacaaataaattcgcaagtggttccaaccactgatccacagcttgttgctctaaacttgtcgttaaactgcgcacctcattttccaatctcttcaattggacttgttcagaatcaaactgccgtccggcaggcccaaagaataagttcatgtcgttccctcctatagtgactcaatgatcaccggttcatttaataaatcgtctgctatcacaattatgccttaaataaaatggcccgtactggacgcctaaagggtctaatacaggtcgtcttcaagctacgaagtaggcaatattaaattaatttacataggaaattatagttcccccacttaacaaaatgtacttattttccattttttctccataaatcccattttttcccacatattctctaaaaaaataggattgattaagtttcctcaattctattaacagtcagacactgattttacgtatcccgatggaatcgtttttgaaaccttcatcgagagtgcccgtctaatgccattattaataccacacgagtcatgatcagcactttataaacgaaaaacgaggacaaaaaaacatcatccagaacttgaatgttaacattcaaatcctgaacgatgtcatgtcttaatataatatgcttatttaacagcatcctttaaggctttacctgctttaaaagctggtactttggtagcagcaatttcaatttctgcaccagtttgtgggttacgacccttacgagctgcacgttcacgaacttcgaaagtaccaaaaccgattaattgcactttttcgcccttagtcagtgcatcagttacccctgcaaaaactgcattgaaagctgcttctgcatccttttttgataatccagttgactgtgcaacttcttcgactaattctgctttgttggccatatcagagtcacgctcctgtttaatttattctgcatcttcatgctgcatttgctatggtaagctctaaacgccctgaaagcaaccatttcgtggatgaaaatcaataattttattaatatgtacaaaaaaattcgctatttaatgaaattaatcattaaacagcgaaattcgttaaggcgtaacgattgggctagctgggttcgaataaaacagaactaaagttcacctttttcatcctataagcactgatatatcaacgttttcttaatttcttcatagattagccaataaaaatggcgccttgaatggcgccattttatttttttaaattgacgttcattgcttacctatgatgatatttgcaccttatttagttaaataatgagtaaaaaacaagttctattaaatagaagggatcttttattactatgaataaacacaaatattcgctaaagcacttgtatgttggaaccaacgtagaatgcaaacaccctgtgaagatacaaactgactcgctaggcttaacattcagtgagcttaattcttgcacacagtacacaatcgaaacaatttccactaagaaaattatacttgtttcgtttgatcaaaattttatcaaacactatctgccatgcgatacttttgacttactttttgcactcaatgcccacctcttacgactagtctagtcttcattctcaagtaaatcgattaatttaagcaccatctctgaaacattttttcttttagtatcagacaaagcagtaagtttatttatcaactccacggtatacgggtccacctctggctcatcaaacaaatctttgatgttaagtcctagagcttctgccacaccctctaactttaaaacgtgtgaatctttcgcagtacccagttctagtcgtgaaatataactgtctgaaacacccgcagcttcggctaattctgcaatcgttaatccttgtgctatgcgatgctgatggataatcttaccgattaactcaaacatgcaataacctcctgtactgtgtctttataagtaaacgataaataactttcttatttatctacatagcacataagcattatttgttcgcttaaaatatttcttttatgacgtattagtgtataattctcaatatatattagtttaaatttaatttactatacggggagatagttcaaacatgaaaacaaataaaatcgtatctttaactgctgctgctacattagctggggttgctggggcaaccttaacagccaatgctgacaccaatgcatcttctacatccactacaacacctgttatttcagatgctgcttctgttttaccggccgatcaaaaggctgcggctcaatcgcaagtcgatgctgctagttctactgtggctagtgcccaatctgactacaataccgcttcacaagctaattcaacggcccaagccagtgctaattcggccagtgacgccttaagcagtgccaacaacacgctctcagacgcccagaccagcgaatccgccgctgaagctactgcttcgcaagcaacgccagaaaatatcgctgctaagtcggatgccatctcaaatgctcaaagcacggttgccagtgaccaagttgtagctagttccgccgctactcaaaccagtgctgcacaatcagatgtaaattcaacttctgacgccgcaacttcagccagtgatgccgttaccgcgcaacaaagttcagtgacttcagcatctaatgccgtttccagtgcaactgataatttaaacagtgctaagaattctgcttcggatgccgctaaaaatgtaagtgccgctagtgatgccgttcaatcagacaccaaagcaacctcaactgcgcaaacaaatgttaactcagcaagctcagaattaaattcagccagtgatgcaactgtcgctgcttcaaatgctgctaagaacgattcaactgttgctgctctctccgatgcacaaaagaacgtcgccagtgcaactgcggcaaatgattcagcaacttcagcggttaacgctcaacaaaagaccgtcaatagtgattctgacgcggtttcaaatgctcagacggctttgaataatgccgatggcacgaaattagctcaatcagctgctgctttgagttctgctgtggctaaggactcgacagctgtccaaactaatactaaggccgtcagtgatgcgacagttgctaataccagtgctcaaagcgtcttaaccgctgctgaagctgcgagccaaaaagctgatgcgtcagttacaacggctcaaaatggtgtcaccactgctcaatcaaatgtgactgctgctcaaaaggacgttgatgctacgaacagttcaatttccgctttggaaaaccaagctacagcttcaactaagaactcgcttaaggtgcctgctggatatactgcagacttattaaccagcggtaacagcgacgctattgaaaacattgctaagaatggtatgaaccaaaattatgttactgaaaatgctgctgataaaaacgtaacttacaagatttctgatttaagtaacttacctaacgatgtacgtgttgaattatcacaatttgcggcacgtgttgttaacagtgttcgtgaacaaatgggtattgttgatgctaaagttactcaaggcatcgtaaatgcttctgaaaatgttgctaaggggtacgattcagacaactggaacatcatggatggtacagaagcacatagtaatcatgatatgactcaattatctaatgccgctaccgctaatggattaagcaccctaggtgaagcaatgagtgctggttatattcaacagttaacttatacccaatcagatactaatttagtaactctggatcaattgaaagaatcaatttacaacacgattcgtgacatgttgtttgatgatgccacatcgctctggggacattctcaatcattgacaagtgccaactcaggatggtcattacctaccgaaacagttatgggtctatccattgataactttggtcaaattcacattaacatgactgatactgctagttttgctggaacggatgttgcaattgtggctgacgccaccaagtacgacgctactgaatacccagtcagcaccgactcgtcagccacacaaactcaactcgctactttgaagaccacattagcttcacaacaaagcaagttgaccacggctaagacggccttagctacgcaacaacaaaatctgaagacggctcagtcaaatcagaccgcggcaaagaaatcattgtcagatgcgcaaactgctgctgataaagccgctatcacgctgaagaccagtcaatcaaatttggccacttcaaagacccaattggccaacgaccaaaaggaactcaccaatacgtccgccgcattagctaccgctacgaaagatacggcgactaaacaggccgcattaaccgctgctaaagatcaactcgctaaagataccgctacgctaaatactttgaagtccacagcttcagcaaccagcgctgatttaacgaaggccaatcaagcattgaccaatgcccaaaataacgcctccgctgccgctaaggctctagccaccgctcaacaaaatcaagcggatgctcaggctaagttggatcaggccaaaagttcattaaaagctacccaagttcaggctgctaaagatgctcaggctttgacggatgcccaagctgctgcaaagaccgcaaacgaaaatgtcacggctaagcaagccgctttggacgccgctaaccagaccctccaaagtgcccagtcaacattagctgatttgcaagccgctgcggacaaggccaacagcgccctaactgctgcgaagaaggtcttggttgatgccacatcaacgcaaaagagtgccgatgatcaagtggccgccgatcaagcgaaagtcgatcaactcaagcaagaattgagcgatctggaaaatgccccagctaaccttgctaaggcccaacaggcggtcaccgatgcgcaatctgccgttaacgccgcccaaagcgcttacgacttggctaaatctaacgcggacgcaaccgctgaaacgttggcaaccgctaaggacgtgcttgatcaagcccaagcgcaactcgacagtgcgaacaccttgttggctcgttggacgcggaccaatgatttgtataaccaattcaagacattggccgccgaagcccccgctaaagttgctgctcgtaaagccgctgaagaggctgctgtaaaagcagccgaacaacaggccgaaaagaatgcttctcaaacaagttctaagaacaattccggttctgctgtgactgatagtcaaggaaacgtggtctcacgtgctagctataaagctgcccaatcaagtgacttcacctcaccagtcgctggttcatcgaatgccatttctggtaacacggcaaactcgacttcatcaactaagttgccgcaaactggtaaccaaaatgaagcaggactcgttggcctcggcattgcctcgattatgatgatgtttggcttgagcagcgtatctaagaagaaacgtgtttaatatttgaatttaaaaaaaaggcacttccgaaaaggaagtgcctttttttacttatcctaatttttcgccgagttcatatcgagttgacatgtctgcaaactgataatcaaattcactccaatcagggaatttacctgcaagccatttatatacaatgtcctcaggaatatctccacgactgcttgcccatccaactacggaagccattgcattatgccgattcccctcttcgaaggttaacccctttttatcagcgtaactttccaacatcttatcatagccagttttaataggaatcaccttgtcactagtactttctgcttcgtcactagtattttctacctccgctgccagttcttcggcatatttcttcataacccattgttcctgaatactttgcgtgacgacatcaaataaatacaacgattcatcagaaacatcatttaaaatggaaggatcagtcattgtgattacttttccgcttcgataaatttcaatattcttttttaagaatgttccctgaaaagacttacgtttatcgcaaatgcgatgaaactcatgtacatcattccgatcaacactgaagtagtgacgtcccgtaccagaaattgacttctcagaaactaatccacgtaattcttttaatccaatcaaatcacttgagatatcaccgtcgtcgacatccattacaattaatggtacatccttgtcaaggttaagtccaatttcatatttatagccatcatttcgtttgttcatataatctttctcaacacaaacttctttgtaactagctagactgcgatttctttcatctgagtcaaagctgccagttaagggacgaataatctgaccattgaagtacatgggtttcttttgtaaaccgctgtgcgtactatcactactttcaatccgactcaaacaccattttctgaatgaatcatcaaaaaattttgatttcttttttggatgatccttcgatccttccacaaggatttcatattttttttgctgccaactcgccagtagttgctttttatcgagaccatgcataaaatctgacgacagactacctggtttcatgttttttaaatcaatgcgatgtacattgctctttgaagtatgttttcgaaccggatcaatcacaggtttattcggatctttcccatacattgcattgaagcgtttaaacaaagctgcaagtagcttataaaacttaggtgcacatgcttcaagtagttgtgcattagttagtgaattagtcgaaatacgttcaccaatctctgacaacatgggggcaacagtgcgattcggaaacgcagataaaatctcttttttcgaatgatagccggtaccaagtgattccactgctgctttcaatccgtcaatttcatcggatgtactttcactcatgacttcagcggtgtaggactcttcccaatggcacagctgaaccctcccagcttgatctgtgtggtcgtacacgtaagcaacctgatttagaacttgttgtaagaaagacatggcctcttccaagtcatcctttgcaaatggtgatgttttcaacttgtcgacgtggatcataacgaatcgacgtgaagaaccgttaggcaagacatcttgttcattcgttgtcataattaaaggttgggttcgagcaacatcataggcgggaagatatttcttattcacatgccaagtggctgttgtggcaatgtttcgagctaagctatcacgcctttttaaatctgaacttttcagctcatcccaaagaattaaggatgtcgattcaatgctgcgaactttatcaccgtttgttaaatcatcccatgaactaattggcaaataatcaagtcgatcatcaagttttccaagtaatattgacatagcagactttccaaccccttctttgtccgattgcaggattggaacgacggaaaagttatctggcctcttggggtatctagttgcttgataccattgaaagagcatggtgaggtatccgagtgtgcttacaatcggtttttcaaccttgaaaaagtgactcaatacaaatggtaatcgatccttatgatcccattcgttcggacgaaaagcattgggattcggacaagtcgagtaactcacacttgcaatctttttcaattcagaatacacaaccgttgaatcccaacttttattaggtttcgcaagtgcgtaccgatgcagacatgcagttattaaccgatctaattgatcggaatcaatagagtgcagttttccattattcagcgtgatatatagtgccccatctgatgttgaatggaacgaatacatcgttgacaagataatagcgaattgctgagttgtcttacgaacgaaaacatcaccattgggggtaacgattgggtcgaaagtattatccagcgaccggaacatttcaattggaattttaaccgaaaaattcattggttgctcggattcactggcaaatccctgatcttcaccttttttactcgcttttttaaaaataaactcagtcatattatgacctcccattgtattttcagccttaaaaattaaagcttggcgctattatgcaccccacgatggatgatctcctaggacgcgttccgtatgaaatcttctttatatgtcgccattagtagccaaaatcaaaggaaacaactaatttaacgaacataatttttatttttacagttatatacatacaatggatgaaccaactgaaactcgggtgtactgctataaactcaggtattcatccgcgaaaagctactaatatcaactgtttcatgataggtgtgaagggttgaatgacgaaagccatcataactttactttgtcacgggtactacgaacaaaatcataagatctgattgctaagtttatgctcttatttcattcatcccttcatgaaacatgtctaagtaccgctacatcaacttatttttcagtgaaaccatataatttcgtggattcatcagtattcatatacattcacttttattttgttcgtattaaatttcaaattcatcgtcaaaatccttttgatttttcgaactgttatttacattgtcgtatcgatattcatccacaataccactatatattttactatacgtttgaaaatcgtatttatacaaccgatgtccaatctttgcattcatagtgtctatcacttcgtttttatatgcgtcgtaaaaatgttgcttcctatcaatggtgttttctcgatgatctagtctgttacttcgtttcataaacgcgttaactactgattgtgtaaataatttaacggactcaccaattgataaattttttgatgtatctcgattgggttcaaaatcaccttgaaatatgtttttagccttttctgaggcgctactaagttcttgtcgtgtcagtttttctgtcctatgaaatttatcttctctttgctgaagccttaattcgcgttgttttaactcgtcttctcgattggtgagttgctgctgtttcaactcatttgttttatgttgatcatcaagcacctgctgatcatgttgttttttcaactgccattccatcttttccttttctaacagtttacgcgcgttacggaaaatcgttagtgctgtatctgtgatccaagaaaacgattgggacttcaaatattttatcttttcgccattggcctgcaacgcattagatgtatgtttaccgtctttgtgttcagtaggttgtagcttaaccacaaattcgatcagttcatctttaacttcttttttattcgcttgaaagtctttttggcccttttcaaggatccacttttgttcattattttttcgttcatcacatttgacttgctgggcttcatgatcgagttctttcattcgtttcttgtaattccgttcattctgtttatcacgcttatactgctcaggtgtccgttgaactccgtctgaatggcccttaatgcgcttataatcaaacccatgttcattcattacctgaacagtatatttttcaagtgcgttcaattccagatcgtggtacatgccttttacgatagttgtcttgttcgttaagactcgatgcccacttttgttaatgtatgatcccttaattgatcgtcctttatccgttttataattatcccaacgattattccaatcggattcatactgtggtaacagcttaccgtctgatgtgactgcatcttcaccatataagtacttctgcactaagttttgtttaacctgtgtggtatcgaatgtcctattgccatagcgatcttttccaacatgtagttctgaagactgtaagtgttgagtgccttgctcatcactatctatttccgcaactaaaacatttttatgcagactgcgatattcatttgaattgaaatacctaataaagctttcacgttcggcttgtcgatacttattcaatgaattagcactctgcttttttacatattcgtaaacgtcaatattgctcaaatataacaacgtcgaggtaatggggatgccattattatgtttcaacaaattaatttgaatacttgcgtctttacgacgatcatcacttttgccaactagattattagcgagtcccttgcgaatcatctttgtccgattaaatagatacccattccaattaccatatcgcttattcgcttgggacttatatggatattgtgcatcatgagcttttacgccagtatcatctaaaaatcctaagcgaagcatcatttctttcgcatttttcgatgggggtaacatattatcatggtacgtttttagcactgtaatatccggtacacttgaattatcaaaccgccgccagtaatgttcacccttatgccgtgcaacatgtgcgtcaagtaaatcttgatcagacgatttgtaaccacttgaatttgtcatcatcgattttacttccattcgaaacatctccatttcaatttagttgtttccataaaatgcttcctattcggtcgcattttattaaattgaatagctggttcaaattctaaagcctgttattcgccccttaatttaatcataaagatctagaacgagtccacgattggtggaggcccaaaacgtaaattctttgatacatattatcccgtatgtggtagtaagtaacttactaccacacgggctcttcgaggaccggttgcaccggacggcagcctagcagctggcaacctattcgttcatgagtttcatctcatgaactcaccaaatcgtcgcaatgtccggatttgcattctgcaaactggtcaaagctcctcaccaatcgccacgagctgaccgtcaattactttagtaattggactccattcttcgaatggtcaaccgttcgctcattaccaaatatcatattatttctaatatgatatctgccctcaaaaaccaaagtactcgattcgcccagctaaagtcattttggcctcccacgcgcggtacctgaaaatcatctacaagatttaaaatataaatacaatctgtagattgtatagaaaaacaaaaaggaagttgataacaatgaagttaccaccaacgattgaaatcaataaaaatattcagacattagtcccagtattcgaaattgggagtgtcaatctcgaaatgtccgatcttttggaagaacgtttgtttaactcacatgatgaatttatgcgcttcgcagataatgctactgtaacaaaatttttcccacagttaacaggtatcaacgatgaattcgtgaaaactccgttagaacgccaatgggcactcaacgattttgaagaaattatcgtctcctccggactcgaacgactggcacagatgctatatacacgcgacctcagcaaccttaccctgaccgactgtgtaattctgtcccgtttgtcacttcttccttcacaagacccgttccatttggccgcatctgaattatttcaggctcttggtaatgctttagcaaatgaaaccaataaaaatatttcagatggttaggatcatccgaaatattaataaatcgcaagagctgtaaagccgttataaacggcttagatcaaacatggctttaaaaaaatgtaaaggatctgaaaattatggcaattacggttaatgatttacaaattggagatattatcacagcgcctcaaaccacaagcgttcaaatcgacacgattggaatctgctggtcagaatttgaaagtaatgtgaaatacaaaatcaccggaataaacccgaaggagattcacctgatcgacaaacaagaagatggtatccaacggaatgttccagttgacactcaacactttctgttagcaattgacagcgccgacttgatggttaattctcgataattgataacatgcaaaactcacaaaaaaaaaggagaaataaacttatgtcaaccgaatatgatattttaaattttgtaaagaacttaaaaagtgatggttacaaaatgtctgaaaagaatattgaagaattgaatgaactttcaaagaatttggaatacatgttcaattctcatttatataacgtacttaatgcggtctacactcctggtgaagaattggattatatcgatccctttgaggaattgacccacgatatttacatggaaatgcttaaagtacggtttttagttcatcagattaaaggtgaggatgattatctttggaacatgtagctacggtcataaaatgtccctaaccactaatccttaatagtcattttggtacggcatacgcgttatgtgatttagatcttcccttgctatacttgggttaaacaagcaaaggaaggtcttttattatggatcaaatcaagatcacactaacagatcaacaattaactcaaattatcaatggaaccaccaaagcaatcacgaaacagctttcgcttgatgtcgacaattacttcggacaaaaacgttatatgaataaaaaagaagcttgcaagtatttggaggtttcggctgggacattgtcaaaatgggtttcagaaggcttacccgaaattcgatatggcaaaagcgttcgctatgatccaaccgatcttaataattttatgaatcaacataaggtaattttacaaagtaggtgaaaatattggcaagtatcaaatcatatctagacaagcatgatcataaaaagtgggaaacctatgttgatcttggcaaggacccagcaacaggcaaacggttgcgtccacataaacgtggttttaagtccactaaagaggctgaattatgggccgctgaaaaggaacttgattttaagaaaaacggatactggtcaaaaggtggactcacctttgaaaaattgtattgtaaatggttgaaagacgaatattgtcagcgagtaaaagaatccacatatgccaagaccacagacaattttcgattgcatatactcccctacttcggtaatttaaacgctgaaaaaatttcagttggcttttgccaaggtattgttaacaactggtttaaatcgaatctcaaacagtatccacgttttagaacctatgtcagtaatgtttttgactttggtgtcagaatggaattgatcaatcgtaatcccatggaaagaacaagcatccctcgacagaagaaaactaataactttaaaattgatgaatattatgaaaaatcagagttagttaaatttttgaaaagtgccaaagcaaatggtaatccggaagcatttatgttttttagattactcgcctatacgggtatgcgtaagggcgaagcacttgcactcacctttgatgatgttaactttgaaaaacgtgagatatctatcaataaaacactgtcacaaggtatagacggaaaattaattcttcaaactcctaaaacaaacacaagtctgagagtcatttcaatagacagcgaaaccttgaactttctaaaacaatggtacaaggatgtcacatttaaatttgaagtactcggaacgccacacaagacatcatcacagctcatatttccaaatgaaagtaatgaattagcccaaccatcattacccgatcattggaatcgagcaatctgtgaaaaatttaaattaagaagaattaaaattcatgcctttcggcatacattctgttccttatgtgccgaaggtggtattgatattccaacaatttcaaaaatgctagggcattccgatttaaaagtaacaactgaaatttatcttcacgcaactcgtaacaatcgaaataaagctattacagaatttgcaaaatttatgagcgcttagtaaaggccactataaggtctttttattttacccaaataagggcctaaaactggtgccaagatactaaattccacctaaaactggtgccaatcctagcgccaattacttcaaatataatgttatttggtcatttattaacgtaataaaaaaaccgctataccaacgattaatcgctgtataacggtccttaaggcgtaacgattgggctagctgggttcgaaccagcgcatcacgggatcaaaacccgttgccttaccacttggctatagcccaaagattcgtacgtgtaaacactaactcgtttacccgacaagaaatattatacaaaaaaacataggttctgacaagcaaaatttaaaattaatttttcaacatctattaattacttgcaattaatagtcgatcatcgttagaatggtcgtattaactaataactggagttgaatggattgaataacgtccctatcttacacctcattatctgtgcgtttcttgtcatttacggcctccgtgggctaatccgtacccgctacatgcgaacctattacgaaaaaattgattttgctcgctatgcggttctcatgctcatctctggcgcctacctagccacttctttactgagcgtcaccgttgttttcattggcttaatcatttacatgtacctgagtcgaatgcgattcaagcatgaaatggaagataagagcaagtaaataacacgattgtcgccccgttatcttatttccgagcgagcctgtttttttaatcgtctcatcaggtaatggcgccaaaacaaaatgtcctctaattgctagacacagtctaacagttagaggacattttatttaattagttatttttattacggactgaactatgacgataaccatatccgaaatagacaaacaatccaataatgagccaaatgaagaaggccacccacgtaaataattttaattccaacattaaaataacacacaaaataaaggaaataatcggtaatacgggataaaacggcaccttaaatgctgaatcaaggtgtgcaaaatccgggctccgtctcaagaacacaatcccgattgaaaccatcgcaaacgcaaacaaggtcccaatgttgaccaactccgtaattttatcaatggggataatgcatgcaaagatactcccaacaatcccaaaaacccatgtattaacaaccggtgcatgacttttgggggctagtttactaaagaatggtggtagtaacccatcacggctgattgcaaaaactaatcgtgtgccaccgtaaagaaacacaattaacaccgtagtcatgccgataacagcacctaacgatacaattcctgaaacccagtcttgatgaataaaatgtaaagcatacgccacgggatccgcaacgtttaatttggtgtacttaacaatccccaccaatacggccgacaaggcaatatacagtaccgttgcgattaataatgacccaataatgccaattggcacattgcgttgtggtcgcttcacctcttcagcggccgttgaaacggcatcaaacccaatgtaggcgtagaaagctaccgcggcaccagaaaccacccctttaacaccaaatggtaagaacgggctgtagtttgccggcttaacgtagaaaacgcccaccacaataaagagcacgatcacaatgattttaagaaccaccataatggcattcacccgagccgattcacgaaccccacccgaaagtaacaacgataggatcatgataatcacaaacgcgggtaaatcgaaaaaggcccctggatgaccggctgtcccgtacgcagccgtcaacgcttccggcatgtgaatgttcaacccaaccaaaatattttgaaaatacgctgaccaacttgccgccactgcagataccgagaataagtattcagacactaaggcccatcctaaaatccaggcgatgaactcaccaaacacagcataaatatatgtataggcacttccggctaacgggatcgtcgaagaaaattcagaatagcaaagtgcggcgagtgaacacacaactgcggctaacacaaacgccaacatcgcgcctggcccagtatacttagcggcaataatgccgggcgtaataaaaattccggcccccacaatcgccccaacacccatggtaattaaactaaacgctgttagtgatttttccaaaccagttttcttgtaaatatccgttgcaatatctttgcggataaataaacttctcttatttttcataaaggcctccttaaagaatatcgaatattctattttaagatatttgcaacaattacgtcaattatcccctaaaacttgaagatgtcaaaaaagctcccattaatctgatacatttaaagttgacaatagttaagattaattgttcgtcatcacatcatggttaagtttgttaaccgattctcaatattcaattaagattcttcaaacctcacttaagtatagaccatttcttagcattttttaattttatttttaatccgattattatttactaatccataggccagacattaacccgtaataaggctaatattgcataattatatttctcataatctattaattttaattaaaaaagccccaccaatttggtgagactttaccgacaatctttctattctgcttgtgtatctcgtagtactagtgcaagtactaaccccaccagttcaatcgccaacatcagtataaacgtcactcgaaaaccactgatttgcgcgacactggctgcgacaccgctcacattctgctgttgagtgaccgtcgtcaagactaacgttgcaactgccaccccagtcgatcctaagatttgtcgaatcgttgttgtcactgcggtcccatggggtactagctgagttggtaacgcgttggcccccatcgtcaccgcgggcatcattacaaatgcgttgcccccttcgataatcatggcacagcccatcataatccagatattaagctgctctgttaagacggttaccagcagccaccccagcacaatcagtcccatccccgtcaacatgacgcgccgaaagccaaccttatctgccagcttacctgtgagtggattcaaaatacttaaaaatacagccgccggcacaagtgccaacccggaaattaatggcgacacgccgagtacttcctgataatacaggggaaaaatgatcgttgtcacgatcaaagcaacgtacgaaatggccgttaaaatgaccgctaaatcaaaattaatggttttcatcaccctgagttcaagaagtggcgtagttaagtgaaattgtcggatgacgaaccacactaaggcgccgacgctcactaccaagagcatgctatttttgccccagtcgacatttttctggccaatttgattaatgacgtacaaaactccgatcaatccaaccgataaaatgacagaccagtaatccaagtgactgctcttttgcggcattacatcccgaatcaggccccccagtgcccccacaaaaacaagtgagatcactagcataaaaacaacaaataggccccgccaggaaaagtaattcagcacaatgcctgaaatgattggtccacaggctaacgcggaccccattaccaatccggccatccccattgtcttgccacgttggtgctcatcagtaattgtcagcagtaccgactgaaatgacggaaacaagacgccgacagcgatcgcttccattattcgaccaaccatcatcacccaaaaagacggggcgagaacaatcactaaagtgccagcatcaaacacaagtaatatcgtcaaaaagagacgcttaaagttcacattattgagcaaccacgggctcatcggcattgtgacacacataatcagcataaaaccagtcgttaaccactgaaccgtcgacgcagaaatatcaaaataccgcatcagggtcggataggcggtagacaacgatgactgactaatcgacatcgtaaacgttcctgccaacaaagtaatcacaaaccataaccgattatacttttttccagttcgatcaattgcattcattactatggtgcctcccaaaaattctgctctcttctattctaatacaccccttggtaatcgcaagctaacccttttttatagtttaagatgctcgatttcacgtttaagctgttgtaacgccccactatcggcatctggatctgccatgagccgatcgtattttaattgcagcagtggtaacttagttgccggccgggcctgcaaaaccgtctttgcgggatctctaagtagctgatgctcaatcaccactcgacgggtcgctacttgattaacaaatgcctcatcgtgagagacaaacaaaaccgtacccggatacgccactaaataatctgcgagtgccgccaacgcctgatcatccagaaaattcgttggttcgtcaagaaccaacacattactatcactgatgatcacacttaaaacttgaagcttaacgcgttcgccaccactcagggtatcaattctctggtcatacacatccgcatgcaccccaaaggcccccgcaatttgacgtgtgcggtcatcatcaagcactacaacctgacttaatagttgccaaacagtcagttgaccatctaattgggttaaatcctgattaaaatatcctactttggcccgtggcgatatttgcgtctgctgattatgaccaatgatccatgttatcagtgttgatttaccactgccattaggccccattagggcgagccgctcgcctggtttaagcgccatcgtggcatgtcgcaatagcatatgaccgttgcgttccagcattaaatcatcggttctcagtacggttttaccatgaaataccggaaaatcggttggcatcaatttaatttttgcactcgtaactggcttagtcacttttacttgtcgctctgcacgcttcaaaagtgccttcgcgccctgctccatctttccggcattttgctcccgaatggatttagtattggcccgttcaagacgccccattcgtcgacttccccggcgaattttttgagctttttgttgtcgttgttgtacagcctgtttaagccggcgctcctgacgatgctgccgttcgtattcttgctgctgccgctcggttatctgcttctgatcacggcaatactcatcaaaggtactgttaaattcatgaaaagtttgatcttcaatcgcccatattttagttgcaatttggcgtaaaaaattttgatcatgagagactaccaataaagttccagcatactgcttaatttttgaaactaaccaactttgatgttgctgatccaagttggtggttggctcatcgagaattaggatagctgttttggccgccagcgcagtgcgtacctttgccatcacagtctggcccccactgcgctcatcaaacggcaacacttgatcaacaatcatcactgactgtgctacgtgtcgctgcccagtaaatgcatgactatccccactgattattttcattaaagtcgtcttgccagcgccattatggccaacaatcccgatcacatccccggtacttgccgtcaacgctgtcgccgaaaacaaaaacttccccgctaccgttgcttcaatatctgttaatttaatttgttgcatatcgccatctcctcgcgttggaaccgaatcgatgagtgcacacaaaaagcatacccgtttccaggtatgccgactattttgaaaaacagcctgcacgaatcctaatcagttccaatcatatttgggatttatcgatcgactcgataaattaaaaatgagttgaaatgattagatgcgcattggctgaattcctccgtattttcaaaagttattctcactatagcatattagttagattcatgctaccgcgagttcttcattgtcctctctttggtttaccaatattcgccggataaaccgatccttttagatcattcttggcataacgggccgactaaagtagtagccttgtccaaacataatccctagtctctgggccagttcaaaatcttcccgactttcaattccttcgagaatcaattgctttttattgatattcatcagcgtttgccactcttgaatgataaatgacgtatcacctagtatctggtgtaagttgaacttcacgccatcgacatagggtacaaagtcagctgacgagtttagccctggaagttttaattcatcgtcaatcataattcgaatacctgcattacgataacgacgcccaaatgcttgcagctgtgtcatcgatggcagcgcactaatttctaccgttaagcaatgcagttgcggcgtctgtttcacgaataaaactaattgttggcaattttgttcattcgcaaattgattaacggtcagattaatactcagtgatttaacctgtaattcgccgagtaagcgttccattaaggagacttgtgtcgtgatgccgaggtcaaattggaccggcaaacgccactttccctgatcaaaaatgcgcatcaggagctcttcacagacgatttgctgcgtcggcagttcgataatcggttgcgtgaaaaacgtgtgcgtcacaaccacagttgcaaatgggttggcatctagtgtttttccgtcaatggtaatacagtttcgcccatgctgcttcgaaacatatagactatcatccgcacgcccatacacatcatccaaaacgacatcttgtgcttgcaccgtggttaccccaaacgatgccgtcatttggattgtttcacgattatggtgataatcaatcctgtcaattgccgcccagcattggcgaatgatcggaatggactgctccagagacgcattggggagcaaaataacaaactcttcaccaccagttcgatataattcccaagaaccttcataatcgtcgagtgtcgcttttagcgtccgtgttgccgtcactagtaccccgttgccagccagatgactatacttatcattgattgccttgaaattatccaaatctaattcaacaaacgtcattggatgattatcccgcttcatttgctcaaatagttgggttgcctcttctaaaaatttagtatagcttttagcatttgtcagtgtatcataattaacttctcgggtaagcgttgcccgttcttcactccgacgatgggtggcattactatatgtacatgaataaacgctcatgatcataaaaatgacgatatagccaacgcgctgcccatcattgatccccagatacgttacccagtacgtaaccgacaggacggccgcgtaaatcaagtgggcccaccaattatagcgaataatggggcgaaaataacgtagcatgagtccctgaatgattaaaataatggccacgcctaaaaagagttccggaatgaatgtatgattgataaaccaaaataaaccaccaattagcccctgtatccaaaactcccacgacgttaaccggtcattaagcaatggataagcaagaacaaaaagttggaggtttaaatatagtggcacactaatttctcgtgtgtacgttgtgtattgcaaccaaatactcaataagacaatcactgctggcaatgagagccgtgctagtctttgcctggtggttaagtcaccatgggttcctagtgcccatcgcacatgccattcataataggtaatgaatcccgcgatgaaaaaaatagagatcagtaactgtgacgcccacaaattaaatgtcatgtaacatccttcatttctacttcatagttattcatctattatcatgccctaattcacataggggctcaagatgttgacctaaatttcatgaggatgtttcaaaaaaaagagacgaacgtctttgaaacattcatctacttagcaattatttgaatttagtctaattaaccaaggagtcgttcgcatctgtcatctctcctggcatcccaaaataataaccttggaccaaatcaggtgcaaactcctgcacccatttcaggtcgggttgtgtttcaattccttctagtgcgaattgaatatgctgttttgccgctagtgcgcgccaaaaatggagctccgttttaatctggtcacaggtttcccagtttcgtacgttctgtaaagcaaacttacactcaacaacgtacggcaataataacccaactagcgccgctgtattatttcccgttcccacatcatctaaacaaacgtggaggccagcgcgttgataactccgcgctgcgtcgactaactgacgtgctgcaacgggcgcttctccggcccccaagcgctcagttaattcaatacatattttaacggatgtctgacgttgtaatttgacaagtggttgaagaaaatgatgatcaataaactgacgttcatctaaattaaaagccaacatttgaatatcttccgataaatgacgcaccgttttagctagtaattgtgtaatttcagttgcaccataccggctaaaatccaccggcataactaattcatgattaatttcctcacgaataaataattcatatccataacgtttaccagaggccacatcatagatcggctgtcctaaaaatttaatcatcttatcccttcctccactatttcatcaccgacataacaattaatagctgccactagttacccatgttatacatgaactactgaatcctaattttttgatatgacgtttatccagaatttacccataatgtacaaacctaaaaaaaacaaaacgacccttccatagcagccattagtggctctacgtccgggtcgtctccaattctgaagtgagcatgctatattttactattattaaaccatattcatgattaaaaatatatagcaacgctgattaaatttgtattttttacacatttaactgttttttgttaattttatacgtatatctgtaagtacacacttctgattggcagtttagtcttcgctacctaaaatacgagagcaaaaggctgccaagattgccccgatttcgggtgccacaatgtaaacccacaagtgagatacagctgaacctccagcaaacaaggccgggccaattgaacgagctgggttcaatgaaccacccgtcaagttcaaagccacgatgatgagaaatgcaagtgtaatcccgataactaagccggcaaaatcactgttaccgtggtcgtcacttgtcacattcaaaatcaccattaaaaataggaacgtaatgagcccttctactagcattgccattgaggcactaattgttggaaaatctgtttggcccaaggcggttgctttaaagcctaacgctttaacaaagagttgaacgaaaaagctagctgcaatcgcaccaataatttgagaaataatatagcataatgcatctactgcaccaatacgacggttaattaacatcgcagttgtgaccgcaggattaaaatggcccccagaaatacctccgaatgcatacgctgaaatggtaatggccaatccaaacgccagtccaatggctaaaacatcgcccttagcaatcacaacagtcgcagttccaagaaaaacaagtaagaaagttcctaaaaattctgaaatatatttacgcaaatcaaacacctcccatccaatactttattattgtatcttctaaatcacgggtgaacaactagttagcatccttttacgggttgatttttgactaatcacttgatctgtccactaaacaatcccgtattcaaaatccataatgacgctgtcacaccataaaattatgcttgaattaaattttaaattcggtacactgttctacggactaaaattatttggaggatgaatatgcgtattgaagaggattgcatcggtaaactagaaattcaggacaatgttttatacggcatcaacactgttagagcgattgaaaacttccccatcagcactgaaaaaattcatcccttgattgtcaaaggacttattcaaattaaaaaggcagctgcacaaactaatgtagctgccggaactttatctaaggaaaaagggcacgccattatcactgcctgtaatgaactgttgctaggcgatcatgccgatcagttcatcgttccagccattcagggcggtgctggcacctcggcaaacatgaacgtcaacgaagtgattgctaatcttgcgatgcatcataacccggaaattaaaattcaccctaatgatgacgtcaatcagtcacaatccactaacgacacgttccccactgctggaaaaatggcaatgattcatttactgccaaaactattgcggcaagttaatgagatggctaccactctaaatgcaaaagccactgcctttgcagaaatcgtgaaagttggtcgcacccagatgcaagatgccgtaccaacaacactcggaaatagcttccatgcctttcacacagtgattaatcgcgacatcgatcgcattacctacgccgctcaagcactacacacagttaatcttggtggcacggcgattggtaccggactaaatgccactgatttttaccgcgaacatgttgtcgattatctcaacgaattgaccaacgatcatctggttcaagctgaagatttaattgatgccacacaaaattgtgatagcttcgttgaattctcaaattcactaaaatcactggctgttgatctcatcaaaatcgcgaacgatcttcgtctcctgtcaagtggcccccaagcaggtctgaacgaaatgattttaccagctaaacaggcgggctcttccattatgcctggtaaaattaatccggtcattccagaagtggttaatcaagctgcttttgaggtcattggtcatgacgccaccatcacaatggctgctcaagctggtcaactcgaacttaatgcgtttgaacccatcatgttccgtgatattctacaaagtgaacacttcttgaccaatgccatccaaacacttaaccaaaactgcctagccgatattgtcgcttgtgcggacaactgccagcagatggtcgaaaattccgcaattacagccactgttcttgcaccaatcttgggctacgtcaccaccacaaaaatcgtcaaagaagctatgaaaacgggacaatcggtcaaacaattactgattgatcagcaacttctcccaacagaacaagttgaacagcttttctctaacgatcggctgctaaaccgtaccacgcccactgcgcatgcaatcggcgcctcaaaataaccactatttttaagatttaaaactttctgggattggttttgaccaatcccagtttttttgtcgcacaaattggcaccattttagtcacttagttctaaataaaatgcaaaaaaaatgctgtaatccgttttctcaaacgttttacaacaccatccgatagtacctaattgggctagctgggttcgaaccagcgcatcacgggatcaaaacccgttgccttaccacttggctatagcccaataaaatggaggggagtggattcgaaccaccgaacccgaaggagcggatttacagtccgccgcgtttagccagacttcgctacccctccgaaacaatcaactattatatcttacaaaattcaccctcaaaatgcaacaatttttttgaattttcagcttagattaataaattctaatttttgctgccattgttcaaagaaagtatcgcgctgccactcattacgacgccgacggtggtatccaaccgcttgattatagtacgttgtttgctcaaattgccgcggtttaacgttcaaatgtaaatgaccaaacagcacgtgagaaacctgatacgcttccaatagttgtcccaatcgctggcttcccatcattgcattactcatgttccacattcgtagttctggatgaacctgaatgtagtcttttcgtggtgcaaaatgggtcataaataccacttgccgtctttgttgtcgcgcttgcttcaacaatgtctcggtttgctgcagtacgatttccattcgttcttcatcggtcattggttgatcgataatactgtcaatccagtacgcttgcttccattgggcaaaatcttgcttctccggtaatttttcagccaatgtatagtcataccagccattatttccgattaaacaccactgggtcccaggaatggtttccagccggttatgcataaactgtgggctttcataatgcgttagttccgggtaactcacagaatggagcatgtcatggtttcctgcaatccaacggacctgaagcgcatgaccaagttctccttgaagccgctcgatatagcgaacactttgtgcaaaatcattgaataaatcgcccgcaatgagatacagtttgactccgttatcgactaaccactgtgcttgttgtttcaacatttcatcactgtcaacctgattaatatcaaaatgattatcactggttaatgctactttaatcatcacgatacctccctcgttatatgtataataaaacgccgaaacagacgtttcgacgtttgaaaattgctaaattaatcaacaccatccataagacgatgaattggctttacaaagaaacagagcacaatcccgaatacgacactgacaagaccgacagcgacgaagtaaataatttcagtattggctgagtatagcttaacgatttgcgcattgaccgcttgaccagcagcatccgcaaggaaccacatactcatcatctgtgactgaaagaccttcggcgctagcttagtcgtaaccgataaaccaattggtgaaatcaacatttcggcaatttcaacaataaaccatgagcccaccaaccagaaaggacttactcgtccagcggtcgttccgtggatgatccccggcagtgccataaatagatacgaagccccagcaaagatcagaccggctgagaacttacctggtgcacttggttgtttatcccaagtactccacagccaaacaaagaacggtgtcaaaatcatgataaacagtggattcaacgtttggaagttcgcggcggcaaaatgccagccacccacatgcaagacagttcgattagctgcaaataaggctaacaccactgatcctgattcctcaattgcccagaacacagcggcagcgatgaacagtggcacataggcccaaacacgggagcgttcaaccttcgtaaccttccggctgctgagcatcataacaaagtaaataattggtagtgcaatggcaacaatcgtgataatccaaataacattatcaatgttcagattaccagtcaaaccaagtaatccgattatggcagccagtgcaatcacgccgattactgaccagataatgatgggccgcaagttttccttttcaatcgggtcttgaggataaagactatcctttgaaaggtatttcttaccatcaaaatagtattgaatcaatccaaggaacattccaatcgcagccagtgagaacccagcatggaagttcatcgtattaccaaaggcatggaaaccaaagccgttggcagcaaatggtactgcccaaggtgatacggcagctcccaagttaattccgaaaacaaacatactgaacccagcatcacgccgatgatcggtttctgaatacagcccaccaaccatttcggaaacgttaggcttcaataaaccagttccgacaacgatcaaagcgatggatacgaacagtgcggtagcaccgaatggtaacgacagcgcaatgtgaccaaacatgatcagtaccccaccgaagaaaacagttcgtcgacttccccagacacggtcacttaaccaaccaccaacaacaccagacatataaaccaaggatccgtaaattgacataattgacgcagcagttgcttggtcgaaacctaagccacctttgctaacagcatagtacatgtagaacaacagaatggcacgcattccgtaataactaaatcgttcccacatttccgtgaagaacaatgttgataggcctcttggttgtcccaagaatgacgtatcagtattcttttgctttcccaaggtgtttcctccaaatcataagaaaaatactgaagtaatgagtgcaaagtgagcaaattattaaatcagaaacgaactttctacgaaagtatgaggtcaattataccgtttcatgatatttcacgtcaattaagtattaaaatatcattataaaacgttatttttatatcataatattgccattttttcaaataataatgtctttttaatgagaatacctttattatatctgctcaaagttatttatgattaaaaacctaatctatctgaattaacatgatccagtgccccacaactatttaccttagctttattacttctcattatccgatcatgattaacacaataaagcgtttaattttcatcaatcactaataactatatggtgatctggtgagtgactattaatcaaattcacattattgaattattctaagtaaaattaatatttttttgcactattctggtaaattattctctaaactgagaagaatttgtatattacccaaaagattcccgaaaacgacgaataaattcagttacaaccggactcatctgacgcccttgtttccaagttaacacacaatttgtattcaattctggtttaaatgggacgaacttaacatctgagctatggtaggcggttattgcgccttctatcgataaggtgacaattttgccatcaataaccagtggcatcgtattaaagcccagattcatcgttccaactatacttagttcgtcaatcgcatgaccataccatgtcgtgagcaaatcccttacttccgtccgaccaccaactaccaatggcagattaggtaaatcctgtggtgcaatccagtctcgttgagctaggggacttgtagctgcaaccgctagcccccaacgttcaactcgtggtaagacaaatttgacataacggctggtttcaattggttccagtaaaatcgcaacatctaataatcccttatccagtcggtcacgaatatcctcactagtaccatcaaacatgctaaacgtaacctgcggataatctgcaataaattcttctaacataagtgccaatgtgtcggaattatcagcttccacacaaccaatagcaatattaccgctaaacagctgttgcttacgatcaataaattctttttcagtggcatcgctaagcattaaaatttcagttgctcgactttttaaaaatagtcctgcttccgttaactccatttgacgtgcgtctcgcgtaaaaagaggactgccaagttggatttccaaattctttaattgacgacttaacgtcggttgtgtgatgtgcaataccgccgcggccctcgaaatagtaccttcctcggcaattgtcaaaaagtaacgtaataatcggatttccattctttcgatcactttcctttcacactcgtgtacataaacaaaaaagtcatataatcaccatttaagtgattatatgactttttgaaaggttgtaaacctttgataatgccgactgcaggattcgaacctgtgacccccggattacgacaccgatgctctaccaactgagctaagtcggcataaacgaaaagatgctaactaatacagctaacatctttcccgaaataactccggcaggcgggctcgaaccgtcgacaatctgattaacagtcaggcgctctaccaactgagctatgccggaataatgtgcatggcaacgtcctaccctcgcagggagcgatcccccaactactctcggcgcttagaagcttgacttctgtgttcggcatgggaacaggtatatccttctagccatcatcaccacactccatacgcgacactcatactacacaactaacttcgtatggtgtagaacttgcgcccaaactaataatatctactctttttcttacacctcgaacagcctcacgctgcttggttagtcctcgaccgattagttagggcgctccatgcattcactgcacttccactaccctccaacatatctacctcatcatctctcggaggggtcccttactcttccccgaaggagagatgggaaaatctcatccgaggcgaggttcacacttagatgctttcagcgttaatctctctccatacgtcgctacctacagcatgcttcctggcggaacaaactggtacaccagcgtatgtccagtccccggtcctcctcgtactaaggacagcttccctcaaatttttccataagccgccccgcgacggataggctcaccgccggtctcacgacgtttctgaacccagctcgcgtaccgctttaaaaatgggcgaacagccaacccttggaccgatctcagccccaggatgcgtatgatccgacattcgaggtgccacaccctccccgtcgatgtggactctcttgggggagataagcctgttatcccccagggtagcttttttatccgttgagcgatgcccttccatacggtaccacccgaaatcagctacactaagccccgaactttattttttcgtccctgctcgaccttctgtctcgcagtcaactccttgttcctttacactctgcgatgatttccaccattctgagggaacctttggtggcgcctccgttacttttaggaggcgacgccccgtcaaactgcctcctgacactgtcctcccaccacgatgaggtggtggcgggttatagtgggcgagtgcagcagtcgctttcgtagaagcggtgggatcgaggggagtgaacgctcgcggtggcgccggcaggttatgatggttggtgggtagtgttgttccgccggttctaagggggttgacgtagctttcggggcgtaggttgtggtgactggggggaggttgggtggggggggtggtgggcgagcatggggtttggacgccttattctgttgggggatgttagattcgggtgtagtaggaaggttgcgggatgactaccctcgtgcggtgtagtttgtagaatgctgatataggtggtagtgtgggggatactggggtggcggttcggtagtgggtatgaggtggtggatgggtgtgtagcgcttggatgttatgccgacgtccgctagtttggggtggggtgggtcggttcgcgcgggcgtgtgatttcggggcccactacgtcgtgggatgagtatgggttggtgttggggtagtacaggtctggttggtgttcttaggggcatgaacggtagagagattggggagtggcgagtagatttggataggaggggactaacgagggggcttattagggggggtctgggggttggtttgttgtgcttgggggtgaagcgtgcggttaagaggatgtctcgggtttggacgcgtgtttgcattggaaaaattataaagggagtggattgggggggaagggtttgggtgcgaggattgggtgggggtgtgaggtgggaatgtgatttgcatgtcctgaggtgtggggtaggcatggaggtgtagcgaaggagggtgggtgtcagggtgggattggacatatcagataaaggggtgagagctgttgtgtcttcgtacgctcacagcgagggtagtatcccactaatgcccctccgccgaactagcgtcccggcctcacgggctcctcctattctgttctgtacagcagtctacaaacactcaactacaagctacacgtaaagctcccctggggtctttccgtcctgtcgcgggtaaaccaacctgcttcttcacaggtatatcaatgttcacaccggtctctcttgagacagtggccccggaaatcgattactgtgtacgccttcgtgcgggtcggaacactctacccgacaaggaatttcgctaccttccaggaagccgttatagttacggccggccgtttagcatacgggcttcattctgagcttcgccgaagctaacccatcctgttaacctatccagcaccgggcggcttcagcccctatacttcatcttacgattttgcagaacctgtgtttttgatcaactccgcctgggcctattcactgcggctgcactgacggtgcgcaccccttctcaccgaagttaaaaaagaaaaagcggggtccattttgccgattttcctaacgaggtgtttttttcactctcgctcaccttaggattttctccctcgctaccttgtcctgtattgcggtacgggcagttactacttccactagaagcttatctcacggcagtgtggaacatcgggcaacttcgctactaaatttcgctcccccatcacacttgtcctatgattaaagctttcctctaacaagatcccgtgcgcttggccgacatatccaacagtcctggtttgcttagcctctcctgcgtccccaaaaactaccatcgtttgtcaaacaaccagtttaactgtacagagaattcaacctgttatccctcgtctacgcctttcggcctcaacttaggtcccgactaccctgggaggacgaagcttcccaggaaaacccttgtcattcgttggacaagattctcacttgtctttcgctactcataattaccaccggcattcctcacttcctaaagcggctccaccagtcctcacggtctgactttttcattgcccttagaacgctctctccgtatcagacacgcatcccttactgatgcatcccacattttccggtatatgcttagccccggtaacattgtcgtcgtgcgcaggagtcactcgactagtgagctattacctgcactcttaaatgagggctgctctctgagccaacatcctagttgtcctatcaactccacatccgtttcccttaggcatctattttgtggaaccttacactggtgatcgtgagcgctgttcccccttttgcgatggatcttatacgcaccttctgatgactcccggacatcatcaatggcttgcccggatttatattatctgaattcccagtacccaagacggcccctagatctccaaacagtctctaaccttcctacctccatgattcttattccagaggctagccctaaagcctattctcgagagaaccgctatctccaagttcgtttggaatttcacacattatcacttcacaccgctaccacatcctcatcccagccatttttcaactgacacgggtttcggggtcctccagtgcgttttaccgcaccttcaacctggacatgggtagggtcacctgtttcgggacaacactactttcatacgcccatttcagactcgcgttcgctacggctccggttttttcaccttaacctgcatgcaatcgtaacctcgccggttccattctctcaattaggcaacgctgtcacccttaacgggctccccctgttttgtaggcacatcggtttttcaggactatttacctcccctgccggggtgcttttgcacctttccctcacggcctactggttcactatcagtcactagggatatttagccttgggagaatggtcctcccggattcgatgaatttccactgttccgccggtactcagatcctgaactgagagtaagccttttcgtctacgggattatcaccctctctgatatagcttcccagctatttcgacactacgtcctactttggtaactcaaatgttcagtcctacaaccccaaccagcaagctcgttggtttgggcttttgtccctttcgctcgccgctactcagggacagatttttctttctctgcctgtcagctattgattttcagttcactgcgtctacctctgcttagctatgtatcactaagtagtactaacgactaagttagttgggtttccccattcggaaatctccggatcaaagtgtacttaccactcccgagcatatcggtgttagtcccgtccttcatcggctcctagtaccaaggcattcaccatgcgcctttataacttaaccttgcttgaccacacgtcgtggtcgccacagattaattgagtattacgcgatgtatgtaattcattaaaaactcaaataacgcggtgttctcggttgttttaaaaaaatatttcgatattatttagttttcaaagtacaagttatgagggtaacccccctcaaaactaacaaagtttcatgtgacaagtcaacgtgcaaggttccgttttaattcttagaaaggaggtgatccagccgcaggttctcctacggctaccttgttacgacttcaccctaatcatctgtcccaccttaggcggctggctccccgaagggttaccccaccgactttgggtgttacaaactctcatggtgtgacgggcggtgtgtacaaggcccgggaacgtttcaccgcggcatgctgatccgcgattactagcgattccgacttcgtgtaggcgagttgcagcctacagtccgaactgagaacggctttaagagattagcttaccctcgcgagttcgcaactcgttgtaccgtccattgtagcacgtgtgtagcccaggtcaaggggcatgatgatttgacgtcgtccccaccttcctccggtttgtcaccggcagtctcaccagagtgcccaactgaatgctggcaactgataataaggttgcgctcgtgcgggacttaacccaacatctcacgacacgagctgacgacaaccatgcaccacctgtcttagcgccccgaagggaacgtctcatctctgagattggcgctagatgtcaagacctggtaagggttcttcgcgttgcttcgaattaaaccacatgctccaccgcttgtgcgggcccccgtcattcctttgagtttcaaccttgcggtcgtactccccagggcggaatgcttaatgcgttagctgcagcactgaagggcggaaacctccaacacttagcattcatcgtttacggcatggactaccagggtatctaatcctgttcctacccatgctttcgagcctcagcgtcagttacagaccagacgccgccttcccactggtgtttcttccatatatctacgctcactttcacacccgctacacatggagttccactgtcctcttctctcactcagtttcccagtttccatgcacttcttcggttaagccgaaggctttcactcaacttaaaaaaaccgcctgcgctcgctttactacgcccaataaatccggataacgcttgccacctacgtattaccgcgggctgctggcacgtagttaccgtggcttttctggttaataccgtcactacctaagcagttactcttagatacgttcttctttaacacagagttttacgagccgaaacccttcttcactcacgcggtgttgctccatcaggcttgcgcccattgtggaagattccctactgctgccctcccgtaggagtatgggccgtgtctcagtcccattgtggccgatcaacctctcattcggctatgtatcattgccttggtaagccgttaccttaccactactatacaccgcggtccatccagaagtgatagcacaaaggccatctttcaaaatagaaccatgtggttctatctattatgcggtattagcatctgtttccaaatgttatcccccacttctgggcaggttacccacgtgttactcacccgtccgccactcatccgatgttttatcaatcaggtgcaagcaccttcaatcaaaaacgggaatgcgtacgacttgcatgtattaggcccaccgccagcgttcatcctgagccaggatcaaactccatataaaaataagaagctgttagctctttttgattttgttactttaagcgaattgacttcgcaaatgttttgcctttaaccctacgggctaaaggaccctacacatttgatttgtcgaaactttgttcagttttcaaaggtctaccatatgatctgaatcactcagaacacatataagatgttaccatgaattaatgaatcatgcaagccctttttcttatgaaaagcaactgaattagttcaaaaacccatgatgtgtctagtaataacgaatcatgaaacaaaacgttacgtcgtgacaacagatataaactatacgctgctatctttaatccgtcaacattaaatttaaaaatgtgatatttttaatttataccaaacaaaaagacatattttacggcaaaaaaccgttaaatatgtctcattttttaatcttctggccgcattgttgggaataaaatcacatcacggatcgatggactatcggttaacagcatcgtcaaccgatcaatcccaattcccaaaccacccgttggcggcataccatattccaaagcctcgataaagtcttcatcaattccttcagcttcatcattaccggcttcacgttctttgacctgagcttcaaaacgagcccgttgatcaattggatcgttcaattcagtaaaggcattggcaaattcattaccaatgatatataactcaaaccggtcagtgaaccgggaatcatcagcatttttctttgccaatggtgaaatttcaaccggatgtccgtatacaaacgttggttgttcaagcttatcttgcacaaactgttcaaaaaattcattaataatatgacccacctgccagtattcttcatacttaacatggtgttcatccgcaagcttccgtgcttcttcaagtgtcatttcaggccagaaatcaactcctgtgtactgcttgattgcatctaccatgtgaattcgctcaaacggcttatgaagatcgagttctgtcccctgatagttaatcttaccatcttcagatacggcacctgcagcagccttaaaaataccttcagtttcatccattacatcatggaaatcgaagtaagcaacataggtttcgagcatcgtaaactcggggttatgtttagtatccatcccctcgttccggaatacacgtccaatttcgtaaactcgttcaaaaccacccacgattaatctcttaaggtgcaattcaagcgcgatacgcaaataaaggttgatatccaatgcattatgatgcgtaataaatggccgtgcactagcacctccggcttgattgtgtaataccggtgtttcgacttccaaaaagtcattaccatctaggtaacttctgattgcggttataatcttgctccggagtttaaaccggttgaaactatcctgattagaaattaaatccagataacgttgacgatagatctgttcttggtcccgaaggccatggtatttatctggcaatggccgaagcgcctttgataaaaacgtcagacttgttggtcggattgtcaattcacctgtatctgtcttaataacatccccagtgaaaccgagaaaatctccaatatcagcacgcttaaagacatgataaacatcttcgcctaagatatctttacgaacatacaactgaatccgaccactacgatcgagaagatcggcaaacccaaccttcccctttccccgcttcgaaacaattcgaccggcaatggttgccgtcttatgcatctcattgagttcttctttatcgaccccatcaaattcatcatgtaattcctgtgctaaataatcccgttcgaaccggtgtccaaacggatcaattccattatcacggagttcatccatcttttcacgacgaacgcgtaactgatcattcatttcttgtccttttgccacaatctttcctccaattactgtgcttttctaagctgacgttcttgtgttttttcaataaattgatcaaaaatatcatcaacttgggcttctgtcgttgcttcaactaacgcagccttggtcttggcagaatgcgaagtaccctttaaataaaaggttgattggcctctaaattcgcgaactgccaatccttcaccctttaaatcaatcaatcggtgtaagtgttccttcgcaattgccaccttttgtgctggcgttgcctctggaattagttcaccggtttctagatagtgggctgtctgcttaagcatccaagggtttcccatcgctgcacgcccaatcatcacggcgtctgcaccggtggtctcaagcatggccttggcatcctctgcagatctaacatcgccattggccataaatggaatggttaattgatccgcaacctgcttcaaaacattccaatcagcatgtcccgtgtacatttgtttccgtgttcggccgtgcattgctaatgcgctagcaccagctttttccgctgccaaagcattttcaacggcatacacgtgatccaagtcccagccgatgcgcatcttaacagtgaccggctttttcaccgcgtccgtcacatacgataccatctcatagacctttttaggatccaacaaccattttgccccggcatccgtcttgacgactttattaacagggcatcccatgttgatgtcaatcacatctgcttcggtatgttcgtccacaaattttgccgcctgcaccaatgtttctttggtcccgccaaagatctgaatccccattggatgttcgacttcttcgaccttcatcatcgacagggttttctgattatggtacataataccgcgatcagaaatcatttcacagacaacgtatccggcaccaaatttcttacaaatcacccgaaatgcagaatttgtgacaccagccattggggcaacgaccacttggtttggaatcgtaatgtcaccgatcttccactccattttttcacctcattttttctttcgttctcacttcatacgcgatgactatcatagcacattcacttatatgataacaaattagtccgccttcatctgcaataaaattttctttaagtcggtttcgctaaattcatacttattaccgcagaaatgacaaaccgtttgtgcatgatgatcttcattaatcaattgttccatttcatggcgatcgatactagccaacgccttcgcaaaccgttctttggaacagtcacacttaaatgccaccggcatggtgtcaagaattttaacgtcttcgccttcaaataataactgtaaaatttcttctggggcctttccgtcacgcaggagttcagagaccagtggcattttacctaatcgagcttcgagttcactaatcttttcatcgctggcacctggcatgacctgcaccaaaaagccccccgccacttcaatactattgtcatcgttcacaaaaacagataacccaactgcggatggaatctgttcggattgcgctaagtaatacgtaaagtcttcacccagttcaccggagaccagtcccacctgaccggtgtagggatcgcccatttccatatctttggtgactgacaaagtcccttgatggcccacggccccagcaacatcaattttatgtttttcatttaatggcaagtgaatatgtggatgttgtaagtagcctttcacggtaccgttagcattcccatctacaacaatggcccctaccggaccatttccttgaaccttgaccgtcattttttcatcgcccttaagcgttgctgacgataataacaaagtgcccactaaactccgaccaagggctgcagaagccgcgctccatgtatcgtgtcgcttttgtgcttccgcaacaattccggttgcattgaccacgtaggcccgaaacattccgtccaccgcaacacttttcactaaataatctttttgtggcatatttttctcctcttaattccgtccttagcgatttttgaagtcgccatgcggttctttattcaccaataataaaggattgacacaaaatttgcatcaatcctttaatcggacatcaggactattctaccctaatgttactttttattcatcttttgaattcgaatcatcatcctgagtgtcatccttagcttgaagatcactctggcgttgtgcttccttgcgctcaagttcacgcttagattcttcaaacgtcgttgcatgatcttcacggatttcagttgaatcatcatccggcattttaccagtcttgaacaaactcaaaatctgcttttcatcaagtgtttcgtacttgagcagtgcttccgcaataattctgtgttgttcacgatgggtccgaataatttccccagcctgttcatgacccttggttgtcaaacgacgaacctcttcatcaaccaatgctgcggtttcttgtgaatactgtggtccgtatggcgactgttgtgggctttcaagttgaaccatgcccaacttatcgctcatcccatattgagtcaccattgcccgtgcaatttgtgtggcttgttcaaagtcattcgatgcaccagaagactgtgaattaaacacaatttcttccgcagcacgaccacccatcaaaccagcaatttgttccatggcatccttcttggacatcaacatctgatcttcctttggaagcataattgcatatccaccggcgcgaccacgtggcacaattgtaaccttgtgaacaactcgcgcatcgtttaagaccaatccaacgatggtatgaccagcttcgtgataagccaccgtatcgcgttctttcttggaaattacacgatctcgtttagcaggcccagcaatcacacgatcttcggcttcatcaacttcaccagcaccaatgcgtttcttattccgccgggcagctagcaatgccgcttcgttcagcaagttttccaagtcggcccccacaaatccaggtgtctgcttggcaatttctttcaaatcaacatcattacccaatggcttgttcttggcgtgaaccttcaagatcgcttcacgtcccttgacgtctggccgaccaacaagaatcttccggtcaaaacgacccggacgaagcagcgccggatccaatacatccgaacggttcgtagcggccatcacaatgaccccttcatcaccattgaacccatccatttcaaccagcaactggttcaaggtttgttcacgttcatcgtgaccgccccccatgccgtttccacgttgccgaccaacagcatcaatttcatcaatgaaaataattgatggtgcggtcttcttcgcgttttcaaataagtcccggacacgactagcaccgaccccgacgaacatttccacgaagtcagaacctgaaatggagtagaatggaacgccagcttcaccagcaacggccttggctagcaatgttttaccagtaccaggaggtccctcgagaagcaccccggatggaattcgagcacccaatgataggaatttctttggatctttcaagaattcgaccacttcgaccaattcttgcttttcttcttcttcaccagcaacatccgaaaaacgaattttgttttgcttagaatcggaaggttttgctttggacttaccaaagttcattacaccacggccaccgccgccaccttggccagcttgacccatcatcatatagaagaagaaaatcataatgacgattggcaaaacatagaccaacatgttaacccagaagccactcgactcctctgccttggtgcccatcttgacatcattggcttgggcatacttttgcaattgcgagatagttacatcgttttgcaaaacgttagtctggaagctcttagtcttacttgagttcccattaaacgagaagcctgagttgctactcttgctagtagactgcgcttttcgatactgaccggtaatcttataaacgccgccactcggttgtacttggaagctcttgactttgtcgtttttcaattgagaaacgaactggctttgttgcaccgtcttggtctgtgatgatgaattattgccaccaaagaagaaataagcaatgcccataatacataggaagatcacagcgtagaacaagacgtttcttgaaaagccatttttcttgttattgttgttattattgttgttcataactacctcctaactaacgattttagtcgattatcgttgatgaaaattatcatagcatagttaacaaccattcaccattaatttatcgacaatcagttgcgattaatacgtgattggaagcacttttttaattttggtaaatctccggttttaataccccgacatatggtaagtttcgatacgtttcatcgtagtccagaccatacccgacaacaaactcattgggaacattaaacccgacgtaatcgacatctacgtctactagtcgaccttctggtttgtccaataggctgcatacccgaacatcgcgggcattgcgactcgccaaaagttccttgaggtactttagtgagcgaccggtatcaataatatcctccacaattaatacatcgcgaccgctgacatcttctttcagatcgttgagtaaatcgatcttgccacttgactgggtgccaccatgataactagaaatattgataaaatccaaatcaagataaacatccattttgcggatcacatccactgtgaacaagctagcgcccttaagcaccgaaataataataggtcgttttccctggtaatctttcgttaaccgttcgccgagtcgactcacagccgatcgaatatcttcttcgctatataagacgcgctcaatatcgttattcatcgaatttctcctcttacctcagtatctttttttgccaaaacgacatgcttccagtaactgacataattatccggccgcgataaccatgcgacctttcttcccggcacccagattacctgatcattccggtcaacgacgaccacttgttgtgcccgtgcttcttggtccaccttttgatcaatcataatccgccgaaccgtctgatggtgaccacttttcaaccggatgcggtcctgtgagtgccaatgccgaactgataacggccactgtttcggtgctagccacaactcaacttgctgatccgcctctggtgcttgatcaaacacgccaattaattgccgtgcggcacctgtataccactggtttaattctagcacagaccccgatttatgaacattatcattcggttgatcagaaacctgatgatcctcaaatatcagctgttgataccgcttcacgacgtggccgccttgactcaggtcataacttgtttgcggtttagccggattgcgtgccatcgtgtcaagctgatcaagttggtcccgatgtacactagtaacgccccagcgcttttcaagccaccgttgtaacaccatgcggcgcttaaatgcgggtaaagcggctatatgagcaatgcttaaccgtccttgcacgtcacagttttgcacaaccaactgatcgataacctcatcggcgagcattaatgtatcctctagctgatcacgatagtcgctcagatgatcaagtagctgatgattgacgtgctgcatcgcgggaataatctgatggcgaaactggttacggacaatcgacaaatcacgattggtggcatcttcaaaccaagtcaggtgttgctcggtcgcatactgcaccagtgtcgccttactaaggttgagtaatggccgcaatagacgccctgttgcaaacggacgctgccaagcaatccccagtaattggtccaattgccccccgcggaccagtttcatcagcatggtttctgcctgatcgttttggtgatgtgccgtgaccagtgtttgaacatgattatcggccatcacttgtgcaaaaaaagtgtaccggaattgacgcgccgctgcctcaatccccgtctgaggatggtcggcttgcggccaatgcgtcacaactagttgtagggcatgctgttgacagtaattttgcaagtacgtttcttcttgagcactttgttttcgtaactcatgattgacgtgagcgacaatcacccgttcatgtcccaatgacttttccagcaggtggagcaacaccattgaatcgaccccagtcgagaccgcgactaccactctaactgatgggtcaataaaaaggcggtcctgtgataagttccgcctaaattgattttcaactgtagttgcattcatcaatttttattttattgattagctccgacggccaccacggccaccgcgcttcccctcggtattacgacgtaacgtggacaaccgtgattcactttccttcagaaagccagacagtaagtcatcaaaatcttcatgaccgccctttttatgatcattgctattgttacgatcgcggtaattatcagcaggacgtctcgatgatgattgatgatgattattattgctactatcgtggtgaccaccgtcatgatggttcccaccattgttgccattatggaatgaccgatcagaatgcccccggtgtccctgatgttgttgctgtggctcgtcactggctgccttgatggataacgcaattttaccgtcatccccaattgacatcaccttcaccgtaaccgtatcaccgaccgtcaacacatcgtggatatccttgacgaatttatttgatacttgactaatgtggactaacccagtcttgtgatcctctaaatcgacaaacgcaccaaaattggtgattcctgaaaccttacctgaaaccttcgctcctacttcaattgccatgaacaagcaaatcctccttgtatattctaatgtaaagtatatcatagatcagaattacatagctaagaaaaagagatttcgtttttggaaatgaaaagggttgcgaaatgatgccgaaacatcaaatttcacaacccacatatcacttatttatcttgagattgattggtgaaattatagaccgtctcaccagatttagcataaaaatacttttgtcgaataattttttccaggtacgtatcatcgtttaataatttgacctgttgattcaactgtttatttttagcctttacatgcttgagtttagtttgcttttggaccgtctgggcctgaatattttgcaggttatggtgcgcctggaaaatttggacaccaaaaaatattgtcaaaacggcaaacaccgaaacgatcatataaaaccgtttcttgcgaactttcagtaggcgttgtcgtttagcatcgttatccgcaagttgttgagaatacggggtacgcagttgggaaatattatttcgattattgccagccatatctacgaatcctcctcaagttttctagctcgagtatagcataattatcaatcgttcaatattgcttgaaagggtttgtaacatgtttgttaaatttagttaactcccttacgaaagtcctctttatagctttcgtccagaatctcatacatctgttcagcttcatctttttttgtcgtttcaatgatcttattgatcttgattgtctcagtcttattaccgaatttaattatcaattgatcgcccagtgcaacattacttgatgacttcgcagcccgaccgttcacggtaatccgaccttgatcggcaatttctttcgcaactgatcgccgtttgataattctggatacttttaaaaatttatctagtctcatttgatttcatcctatcgtttaattttattaaaaattgtttgccatgtgggagtagcaaaagttctttgacactcaaaaggtgccaccaaacgctgaggcccccagcaatcacgacgcccacaatcaccgcaaccgtaaccgccaacagtgcgcctaggcgactcatcggtatcaaccacgaaaccagttgcgcggtgccaccggctataactcccatcatgacacaaattgctgttaatttcacggcaaaccaatgttttgtatgccagtgaagtaaatcaggcagtccctgccacaccactaatagtgttgtcagcagtgccaatactgtcccaagactcgccccaacaatcttaaaatgcatgactaaccagtagtttgtcagcaccttaacccctaagccgatcaataatcccgtaacgatttgtgagaagcggttcaaactttgcatcacgctactatacatcgtaatcaccgccgctaaaataatactcagcatattcaccgctaaggcaaagctgcccaagcggctcgcaaataacagttcattgattgacggcataatcgcaatgagtcccgtcgtacatagggcggataccgcaatacacacatgtgacaagacttgaaattgacgacgaaattcaaccagcttcatcttctgatagctttccgtgaggctcggtaccaataatgccgagaccgatgtcgcaacgactaatccgagttgaatcagcggttgcccgcggtcaaaaacccctttaaggctcatcgccaatccatttggcacaccagcgctaactaatgcacttttgacggtaaaagaatccacaagctgcaataagatcatcatcgcagcaaacagactaatggccccgccttcaacgactaaccgcttcactaaccgaccatcaaaaaccaccttcaccgttggccgtctaaatagttggcgactcgtcatcataataatgagcgaggaacatagtgcggcaactggtgcactagccattgcaagggttcccgtccgatagatttgccagtggtgctgggaggcaagaacggcgacacacacaacgatcgacacacgcacgacttgctccacaagttgggtgactgaggtgggccacgtcacgtattgaccctgatgatagccccgaccaacggccagaaatggcatccccaaaaacatgagtgaaacactccgaattaccggtgctaggttgccatcccccatcaagcgtgcaattggaaatgctagccaccaaaggacgcccgtcactatcaatgcggcgactaataacaggccaaacaattgctgggcgacggctaactgctgctgttttgtttcctgttccgcaatcacctttgaaataaacacggggagtcccgacaaggccagcacaatccccagaccatatagcggataaacctgttgatagacgtaaaagccatcatttcccactaagttttgaaacggaatccgataaacggcgctcagaatcttagcgactagtgaagaaatcgccagaatcatcgtcccttgaaaaactctactcagctgtttgtgctgcatgatcgcgatcctcacttaattcatcggcacaggcagctaccaacgtggtcaactgctcgagccagatgggttccgtcattttcggctgaataaccagtcgcagggttaacttcccttcatcctcactaatcgtagccttgaacttcgtcaatgccaaatttttgagaatttgttgcggctttaatttctgactgcctagtttactgaaagtcacaaacaagtatccctgttgccggcgaatcttttcaatcaggctcaagtctgcatacaatttcaattttgcaattgcgagcaggttttcaacctgtaccccatagtccccaaagcgatcaatcaaatcactttccaggtccatcaattgtgtttcgtcctcgacctgtcgaatactcttataaagctcaattttttgccgctgatcatcaatataatcgtctggcaaataggcctctaatcctaactcgacttcagcatctgacttcgccgttaccttcttaccctgtttcttggcaaccgcttcggccagcatttgcgagtacaaatcatacccaacggaatcaataaacccatgctgttgctttcctaataaattaccggccccccgaattgataaatctcgcatcgcaatcttaaaaccggaccctagttcggtaaaatcccgaattgcagcgagtcgtttttcactaacttcgttgagcaccttattttgttgatacataaagtacgcgtacgcaacccgattgctccggccaatgcgtccccgaatttggtacagctgtgagagccccatatgatcagcattctcaacaaatagcgtgttaacgttgggaatatcgaccccggtttcaatgatcgacgtcgtcacaagcacatcgtactcaccgcggataaaatcgtagagcacgccttccagttgtgcttctgtcattcggccgtgaataaagcccacccgtgcttctgggaccaacatctgaatttgggcaaccgttttttcaatatccatcacccgattatgcaggtaatatacctgaccaccccgctgcatttcccgcatgataccatcacgcagggcgcctgcattttgctccatcacgtaggtttgaatcggaaagcgtccggccggtggtgtctcaatcacggagagatcccggacccccagcatcgacatgttcaaggttcgcggaattggagtcgccgtcagcgtcaaaacatcgacactttgtttcatctgtttgagacgctctttatgctgcaccccaaatcgttgttcttcgtcaataatcaataaaccgagatccttgaaatggacatcttttgataacagtcggtgcgtgccgaccacgatgtcacactggccagttttcagctcatcttccgtttggtgtagttccttagtagttttaaaccgcgacattaaccccaccgtgaccgggtatccttcaaatctcgtttcgatggtatcaaaatgttgctgtgccaagatcgttgtcggtactaaaaaggcaacctgcttaccggcctcaaccgctttaaaagctgctcggagtgcgacttcggttttaccaaaaccgacatccccgaccagtagccgatccatgggcttgtcccgttccatatcctttttgatttcttcggtacttcggagctgatcacgcgtttctgagtacggaaagtcatcctcaaattgttgctgatacccatcatcttggggatacgcataccccttttccgcttctcgttgcgcatacagctccaccaggtcatccgcaatatcttcaatcttagcagcgaccttccgcttggttttcgcccattcagcgccgccaagtttgttaattcgaggtgttttagactcagatgaaacgtatttttggaccagattaagttggttaaccggtacaaaaatctgggcattatcccggtaattaatgacaatataatcttgatgaacgccaccaacttccattgtctgaataccttgaaagaccccaatcccgtgattaacatgcaccacaaaatcaccgggtttaagatctgtatagtttttaattcgttcggcattagctaagctttgtcgaacaacgtgtttctttttaacctgtttgaacatctcgccttcagtcacaacaacaaggttggcctcgggccattcaaagccattttgcaatccaccagaaacaatttgaacgacaccttgtcgaattgcatccggttgggtttgaaccacatccataccaaaatcggccagtgtatcggtcactttatccgttcgttcctgactattagccattaaaacgaccgtttgtccttgtttttcccaccgttgcatttccgcctttaaaatgggcatctgaccgaaaaattgctgcatattgcgggttgccatgtccacgatctggctaaatcgaagttggcccattccctttttaaacagcgcaaaaacgacctgaccatgctgatcatgatggaccagatcttcaacttggaacccgtacgtttgcgtctcaaatagttgatgctgctcacgcttatccgtgatccaatctgcttcgtcggcctgtaattgcttttcagcttccacaattcgagtgtaatcatcaaagtaaatcgtcgcatccggtgccaaataatccagtagcgacgtcttatctggatacacgaaatcaataaattcaaccatttcgggcatcaattgatgatgttgtagtgccttcaccagcggtgacaccgtctgctctagatgctgtttatcatggtcatccttgagcgctttgagttctgactgtaactgctgctccaatttttgggccgcagtttcaaacactgcgggcgcaataataaagtccgttgccggcaaaaccgtcaccgtttcagcattttcaatgctccgttgactatcggcatcaaaaaaacgcagtgaatcaatctcagtatcaaacagatcaattctgaccggattatccgtattgagggggtacacatcaatgatcgaaccccgaatagcaaaatcaccgggccgttccaccattttacccagttggtaacccatcgatcccagccacaaccgaaactgtgctaaatcaatgtcgtcgcccacctttaaggtaacgaccgcttgttgaaagacggctggcgcgggtaaaaagcgccgcaatccggaggctgacgtcacgacaatacagtgttcatcgtttagcagcgcgtgtaacgcttgcacccgccggagccgaaaatcaggtgaactagtcgcaacttcggctgccagcatttcctctgctggaaattggtacaccgattccgcgggaaggcgattcatgagatcctcagcgagttgttccatgtgataattattatccgtgatcacaatctgggcgtgctgctgttgctgatagagcgcactgaccagtaatgtccgtgctgagccagcaaccccggtgatcagttgccgccgggcaacaagtttttcagttatttgcttaaaggctggcatttgttccagtagtgtctctaattccacaattgcactccttaattaattatattcgttcattaattggtcaaaggtcttgccatctaaccactcttcaattgcccgttccgcttcaattttgctgtcgctaaacggcgcctgttgttctggcttaaatttgcccagtacgtagttcaccacgctttgtttattcgggtgttcaattcccaccttaacccggttgaagtgctgtgttcccagatggctgatcaaactttttagtccattatggccgccagcggagcccttctttttcaaccgaattttaccaaccggcaaatccatatcatcgtggatgatgaccaaatcttcaatctcaacatcataataatccataatggggcgcactgcgcgaccggattcgttcataaacgtagtcggtttgacgagtaacactttatgaccattaatttgaccagtcgcaatcattgcttccattttactgacctgcttaaatgccagttgatgatctgctgccaattgatcaaccaccataaatccagtgttgtgccgtgtgccatcatattgtggtccgatgttaccaagtccgacgattatcttcatgttttttacttctcccttaacaaaatacgaaaaggctgaacgaattcactcgtccagctcatacttcggccattataaactagaacagcgcctcttcacaattgttgtggcctcaaaagattaaattttcctgataattttcaaaatttttaatgtttttcacaaacttactatttagttcctagatcatcatgctataatatgcagtgttaatttttgtattattgtattttcgaaaggatggattgaattgaccaaaaagcaaaatcaccaaaaagtcgttctggtcggcgacggtgccgttggctcaagttacgcatttgccatggctcaacaaggaatcgcagaagaatttgtgatcgttgacgtcattaaagatcgtacaaaaggtgatgcattagacctagaggatgcccaagcatttactgctccaaagaacatctactctggcgaatactcagactgtgcagatgctgaccttgttgtcatcactgctggtgccccacaaaagccaggcgagtcacgtcttgacttagttaacaagaacttgaagattctttcaacaatcgttaagccagtcgttgactcaggcttcgatggcatcttcttagttgctgctaacccagttgatatcttgacttacgcaacttggaaattctcaggtttcccaaagaacaaggttatcggttcaggaacttctctagatactgcccgccttcgtgtggcattggctaaaaagctagacgtagatcctcgcgacgtgagtgcctttatcatgggtgaacatggtgattcagaattcgccgcttactcaacagctactgttggtggcaagccagtcgttgacatggctaaagaagctggcgtttcattcgacgatttacttgaaatcgaagacaagacacggaataaggcttacgatatcatcaacttgaagggggccactttctatggtgttgccactgctttgatgcggatttcaaaagctatcttgcgtgatgaaaatgccgtattgccaatcggtgcttcacttgaaggcgaatatggtttgaacgatatctttatcggaacaccagccgttatcaacggccaaggccttgctcaggtaattgaagttcctcttgatgatcgtgaaaaagatttgatggctaagtctgccgaaacacttcgtcaaatcactgctgatggattagctaaccttaacaagtaatcctcagttcttaaaaagtagtgtcaccattctcataatgatgacactatttttttgtgatcaaaacactagtttaactggatagctatgccttaacatctatcactggttaaattatcattaacatttctaatattattctcattatttgtatgaatttatgctatgatgtactaggtgtttttcacatatcaaaaattggagtttttaactatgctaattaaatcattggtcaagaccaaggaacagttgaccaccttacccgaagatacaacgctcgaagaagccttaaacgttttggaagagtccgatttccgttgcgttcccattcttgataaaacgaacaaaatctttcgtggtaatatttacaagatgcatatctaccgtcacaaatcacgcggtggtgatatgcaactccccgtgacatcattgctcaaaaattccactaaatttatttcagtcgatgcggcttttttcaatattttcttttctattaaagacttaccttacattgcggtgttagatgaaaataaccagttttatggcattctcacccacaccaaattattagggatgcttgctgaaggatggaatattcataccggaagctatgtcatcactgttacaacccccgacgaacgtggttccttagccaccatgtctaaagtgattaccaaatattgtcaaattgcgaactgcatttcacttgatttgcagggatcaactggcctccgccgggtcttatttacacttccagctggcgttgaccaaaaaaagctagacaaaatcgttcatgccttgaaacgtaaaagttttgatgtcccggaaatcgaaaatcttcacggctaatagctgtgtaaaaaagcccgtcagatcaatcatctgacgagctttttgttatctactttttagctgacttatcaacttttttagattggtttgaggatttcgtatgtactgttcgacggtcaccattgttatgtttgttcgtttgactaagtaatccgacactgacctgtaaggcatgatcaacacgtctcatcgtctcatcgtctaaatgtgtcactttgtcacgtaagcgttgcttatcaattgttcgaacttgctctaacaagatcactgaatctttttcaatgccgacatattctgaattaatgccgacgtgggtaggcatcttgggtttttgaatccgtgcggtaatggccgctacaatcactgtcggactgtagtgattgccgatatcattttgcacgatcacaactggccgcatccccccttgctcagaaccgattacaggggacagatcagcgtaaaaaatgtcaccacgcttaatttcaacctttgccattccaccacctcccaatgttgcatgctaaagattaaaatatcccgtcaattataacatacgttaccctcatattagtaatactttttaatttaaatactggcggtctagtcggggggccaaaccagtcaagatttcataattgatggtccctacatagtccgcaatctgcgtcaccgtaatttgctgatcgccttgccgaccaaaaatcgtcacatctgttccgattggtaattcatgtggtaagcgaatcatcatttgatccatacaaacccgaccaaccacctcacaaaactgcccgttaaccaacacatgaaatccctgcatagcacgtggatatccgtcggcatagcccagtggaatcgttccaatccattcatcttgttcggcccggtaagtggccccatagctgacacactcaccagcgtgcaacggtttaacaaagtcaattttactgaccaagctaatcgctggctggagggtcaaactaggttggagcacgtcaccggaggggttttgaccatacaatgaaatgcccattcgcaccatgttacccgcgatattggtatgccacatgccggtcgctgaatttgaaacgtggacgtatcgtggtaaggggtcaataattttggtgagcatttcccacttgtgaaattgttgcataaaatagtgatcatcttgttcatcggccgtcgcaaaatgggtaaagacgccctcaaagtcaaatgctgcagtccggacaactgctaacgcctgctttaattcaggcgtctcacgaaatccaatacgtcccattccagtatcaagtgctaagtgaatttttaatggctgtttagactgtggcaacttctgataggccgtaaaccattccagcgagccaaccgttaatgaaatattattttcagcagcaacgtgtgcctgctcgggatcagtaattcccagtaccaaaattggttgggtcaaccccgcttgtcgcagcgccaacccttcatctaaaatcgccacacaaaaccctttcgcgccagcctctagtgctgtctgggcaacagcgaccaggccatgcccgtatgcatttgctttaaccaccgcaaatagcgcggtatcaggggttaactttttttgttgctgtttgatgttgtgtcgaattgcttgtcggtcgatcaataattttgtggcacgatgggtaccaactaccattattcaggcttcccttctagtattacttgcgtcatcactaactgtgcggtatgagacaccgaaacatgaacgacgccatcgaaaactgactgaactgcgtgtggcttgccaagttcatcatccaaaaattccgcatcttgaaatgaaaaatgccgcccaatccctgtgccaagggctttggaaaacgactctttcagtgaaaagcgtcccgccaagtactctgcctgtgcttggccctgtcgcttttcgtactgagcccgttcgttgggcgtcaaaattttatcgaacatatggggatgctcgacatgcatctgcttaattcgttcaatttccgtgagatcaattccggttccaataatcattattgatcataccttctactcgataatttattgaaccctcattataccaaaaaaagaatccaacaacaattcaagccaatctgaccatttcaatatagcgtatcatttgaaatatttttgtaatgatattatggtgagactgttgaaccactttgttgaaaggagtctttaaaacgaaaactatttcactaaaagtcacagatgaggcaatcgagatatgctaccaacccagtcatcaccacgcccaacctcgcaaggctgtgattacatatgatgaggatcagacaattggtgaaaatttagaaacgatcaaagttaagttagccggcacctcatttgatgccattattatcgagaatcccctcacgtatcctttttccgacacgattgtaggtatcgctcatcagcgtatcgatattggcctcgcactcaccaacatgtttaatgtgccggtagtcgcccggaccaccgtcgatcgtgatggactggccgccgcaatcaaccataagaaagattatctaagctggcatttggactactacggccagtacaaagataaacgaaactacgggcaagaagccatgctgacaatcggtaatggcttttttggcttgcgtggcgcctacgttgaggcccgtgccgaccaaaataactacccggggatgtacgtagctggtctctacaaccaaaataccacgaacatcaacggccgcgatgtcacaaacgaggatcttgttaatttacccaacgctcagtatatgagttttggaattgataattcgaacccctttaaaattcgccgttcggatattcgcgatagttaccggagcttaaacctcaaaacaggtgcactcaccacaaccatgatgatcaacctcaccaccggtcaccaattgatggttaaggccaccaaagtcgctgatatgcagcactggcaccggttcgtggtgcgttatgaagtcacgccacttaactttgcggctaacatgcaaatttacgccgaaattgacggccgtgttatgaaccaaaacgttgaacgctacgccgaattcgatcagcgccacataaccgttactagcttaagtgccgccaccgaccatgccgaattaagcggccaaaccaaaaactccaacatccaatttgcgattgctgatcgccttctttcagacgacactgatacgatcaaaaacaccgttgccagtaattcgactgcggccattcgacaaaccctaaatatcgacgtcgtcccacaacacacgtacacgttcgataaggtggtcgccctatttacaagtcgtgagagtcaggccgcccagcttgaacagctggccctcgatgagctccaagaaaccacatttgaccaaatcctaacggataatcaacgtttcttcgctcgtgcttggcagcaaagtgatattatcatcgacggtgatttaaccagtcaaaagttaacccgcgtcaatatttttcacctctttgttgccgcccatgcgctgcaaagcggccaaatcgatgcctcagtcggggctcggggcctgcacggcgaagcgtatcgaggacatgttttttgggatgaaatgtttgtgatgcctttttacgtctcccactaccccgagctagcacgacagctgctcctttaccggtacaaacgactcccagccgcccggcaatatgcagccagcgaaggttatcagggcgccatgtttccatggcagtctgcttccaaaggagatgaacaatctcagtttgttcatctcaatccgctaactcaaaaattcgaaccagataatagtcgtcgtcagcgccacgtctcattggccgtagcttacaacgtctggttgtacttccaccaaacaggggatcgcgacttcatgactcactacgggcttgaaatgctgctatcaatcgctcaattttggctcagtattgcccaacctaccgcagacggtcagtactataccatcgcgggcgtcatgggcccagacgaatttcatgaagaatatccaaatagcgaccaccccggacttactaataacgcctacacaaacttgatggtggcctggctgtttaccacaatccagcagctgagtgatcacacggatgcaaccatcctcaaaacggtcggccaaaaaattcactttgggcagcaagactaccagacaatgacgaagattgcgcaacaattgaaactcgacattaatgaaaatggtattatcggtcagtttgagggttactttaatttaccaaccctcgattttgacgcctaccgaaaaaagtacggcgacatttcgcgcttggatcgcattttaaaatccgaaggaaaaaccccggatgcctaccaagttgctaagcaagccgatgcactcatgatttactacaattttaatccgacgaccgtcacgacactgcttaatcagatgggctatcccttacctgatcaagctctgacccataacctagaattttatctcgcacgtaccacccacggatccactttatcccgagtggtatacgccgcgctgaccaaaatggaaggaaatatggatcaatcttggaaactctttcgtcaggcccttttctctgattactatgatattcagggtggtaccaccgccgaaggaattcatctgggtgtaatgggcgccacattagagattgaaactcgtttttacggtggagttagcttcttgggtgaccaaattaccgtcacccctcacttaccgaaacaatggcagcaactcacgtttacccaactctttcgtggcaccgccattcactttgagattacccaccaccaacttattattgatgcggatcatgatctcaccatgacggtgttggatcatccgacccaaattcatgctcaccaaccattacagattaattactaatataaaaaggagacgatgttatgactcaatttaatcatattgctggcgttattttcgatctagatggtgtcatcacagacacggcccagttccatactcaggcatggcaagcactcgcgaccaagctgggtgtcacatgggatgtcagtcttcaaaacgggctgaaggggctttccagaatggattcgctggcactgattttacagcatggtcaattgaccgatcactattcattggctgaaaaaaagcaattagccgccgaaaagaacacccattatctttcgctgattcagcaactcactccggacgatatctttcctggtattcgcgcgtttttagatgagttacaaactaagggctacaaaatctccttggcgtcagcttctaaaaacgcccccaccattctacgacacctccaattaaccgactacttcgaaaaaatcgttgacccagcaaccctcacccatggtaagccggatcccgaaattttcttacgagcggcggaaattattaatcttcaaccagatcaatgtctggcgctggaagacgcgaccgccggtattgccggaatcaacgctgcgggcgaaacctcactcggtgtcggagatcccaacgttttatcggctgccgatatggttttcagcaataccgcggacattacgttagctaacattcagcaccggatgactatgactactgctacacactaggagggatcgccatgtatcaagctgttgttttcttcgatcttgatgggaccctcctacaagacgacaaaacgttgtcttcaaccgtcatccaagcaatcactcagttgcgtcaaaatcacgtactgcccgttattgcaaccggccgtaatctctttgaaattcaatacgtgttacagcaaaccggtattgactctgccgtcagtgccaatgggagttacgttcaattaaatggtcacttattgcatgccgaacagatttctcccgagcttatcgcccgcgttaaccattttgcaacacactttggtgaccccgtcgcttggtttaacaatcaatcatttggactaagccgtcgcactaccgcgaccattaaaaactttaacttgctccaccttcatccccatgtggatcccgaatggtaccaaaaccatccagttaactttctgtttgtttttaatcgaaaccgcgacgttcaatatcagcaacacttcgcacacgaactttcctttgttcgtaacaatccacgaggactggatacgatgcttgccggcgtttctaaaaaaacgggaatcatccagttacttcaatctgcacacctcgatcatctgccaacctatggtttcggtgaccaactgaatgaccttgaaatgcttgaactagttgatcacccagtagtaatggccaatggtcattcgctagccaaacagaaggctgaatttgtgactcgtagtaatatggatcatggaattgaatgtgggctgcgccactaccatctcatttaaaaatgaacgtcaaaaaatccctcactagtcaacttgactaatgagggattttttaactaaagtcggtgagcattcaccaaccaattaattatcttttatgaatgttgtatgagtgacggcttgaatgaccgttaccgtgaccatcattccgacggttaccttctgaagctgcacgatgactccggtgttggtttgatccaccaccgcggttgccaccacgatagccaccatggccaccaccattacggctataacgacgacggtgatcaccgccaccaccattaccatgcttacgacgtggtaaaggccgttctggcgtaatcttaacgggtactgaatgcgcatcatcacgagtaacatcattcaacaatgcagcgaccaaatcaactgcatcatgctttgccaataactcgttagcttcatcaatatacttatcgttatctgtccggttgatcaggtcttcaatttgattcaaagcactggcaacttgacccttgaatgcttcttcttccgaaggtggcttcaatggtaacatacgcaccttggtaagcttttcaatttcacgcaggtagtccatttcgtttggtgttacaaacgttaatgacacaccatggtgtccggcacggccagtacggccaatccgatgaacgtagctatctggatcttggggaatatcgtagttgtaaacatgcgtaacacccgaaatatccaatccacgagcggcaacatcagtcgcaaccaaaatatcaatcttccccgccttaaagcggttcatgatctggctccgccgttgctgtgttaaatcaccatggatgccggcagcgttataaccacgggcaattaagcccttagataattcgtcaacacgacgcttagtccgaccaaagacaattgtcaaatctggatcctgaacgtcgatcaaacgagtcatcgtatcgaacttctcaaaatcacgagaacgaacgtagtattgatcaatcaattcagtcgtcaattccttagccttgatcttaacttgcttaggatcagtcatgaattgaacaccaatttttttgatttctggtggcatggttgctgagaagagcaacgtttgccgtgttgcgggggtcttcttgataattgattcaatatcttcaaggaatcccatgtttaacatttcatcggcttcatctaacaccaatgtcttcaagttttcgagtttcaccgtccgacgattaatatgatctaataaccgtccaggtgtcccaacgagaatttggggatggttctttaagttgttgatttgacgacgaatgtccgccccaccatacacaacttggaccttcgcgtgcttgtctttacctaaacgataaagttcttcttgggtttgaatggccaactcacgagttggtgagataatcaatgcctgaatatcggcgctgttggtatccacatgttcaataattggcaaaccaaaagcggccgtcttcccggtccctgtttgtgcttgaccgatcacatcttgattgtctaacaccattggaatggtttgttcttggattggcgttgcttcttcataaccgctacgcttaattgctttcagtaggctttctgataaacctagttcactaaacttcaaaaattgcttcctcctgtaattaccattattaccctcacaaaatccgttgcttcaacaggtaataacttaactgttcaaaatatacaaccttgctagtatacaaggtaaacaggcaaagcgcaactaaaatggcctgatttaatcagccaaattttgcaaaaccgtttccaaatggatcccgtggcttgcctttaacatgacaacatccgttggttgaatctgtttttctaggtcattcatcagttgttgcttgttttccacatcgtagtggtgcaaatgttctgtgccgtatgcttcaattaatcgctcgtacaaaactttcatttgaggaccaatgaggtaaacatcactaatcgctgcggcgtcaaattcgtccgccagtgacgcatgaagtcgtggtgaggcatccccaagttccaacatgtccccgagcacaacgattcgatgaccggtggttggggtttgtgcaaaggcatggagcacctgctttgcagcagtcggattagagttatacacatcacttaaaatttgttcaccagctgtgccttggacccattgcgcccggttttccgttaattcaacattggccagcgcttggcgcatattgccaaccgaaacgtgcaacaactggcccacggtcaatgcggccagtgcgttattgacgttatattctcccatcattgggatcgtaaagtcttcttccggccattggttcaccgtaaaggtaatttcatgtgtcgccgcattaacactcgtcgcgtataaatcattttccaattgccgcccaaatttaagttgctgctgagctagggacgcggtccgctcaatcagtaatggttcgtcgccattaaagaccagtgttccatcttctttcagcccatgggtaatctccattttggcatccgcaatcttatcgcgtgtgccgaagaattcgatgtgtgcttcaccaatcatcgtaatcacagccacatctggattcaccattcggcttaagaaatcaagttcaccaaagtgatccattcccatttccacaaccactgcttcagtatttggttccatacttaataacgtcatgggtaccccaatttgattattaaagttagcataggtttttgtgacgttcatctgggtactaagaattgacgcaatcatgtccttagtggtggttttaccattgctacccgtaacagccacgaccattggattgattttatgcaaataatattttcctagttcttgtagtgattgcagtgggtcatcaacaatcaaaacgggttgatcagtggtcgtcgtcacctcgtggtcagtggcccaaagtgtcgcagcagccccattttcaaatgctgcattggcaaaccggtgaccatcactttgccccatcagtgggataaatagggccccggcagcgagatttcggctatcgaatgcaacactggtaatttcaacgtcttgccatttggtgatgtcattttttacagcaatcgccttggcgatctctgcgagtttcattttcataaattgcagactcctcttttttcaagatctttatcagatctgcttaacaactccgttattatagcatgaatcctaaacatcatagaaaaaaattagacggtcagcaaaaaggccccaccatagattgcgttgcaatcacgatgagaccttttcattaaatctagtttacatctgttctaaccgttcaattctcttttccatcggtggatgagtatcgaacaagtgtgagaaagaatgtttattttttaagggatcactaatgtacagtgccacgctacttgcatcggcagctttcatgggttgggccgtcgaaattttttgcagtgctgaaatcattccttgcggattacgcgtcagttccacgctcccagcatcggccaaatactcccggtttcgcgaaagggccatctgcgcaatcgtcgccgcaacgggccctaggataatgactaagactgacaagatcatcatgatgatctggaggtatccaccaccttcgttgtcacgatcacgccggccaccgccccaccaaaacgaatgcatgccaatgttcacaagcaccgagattgccgctgccagcgctaacgaaatcgtctgcaggcgaatatcatagtttctgacgtgggtcatttcatggcccatcacgccctctaactcttcacgattcaatcgttccagaattcccgtcgttgcagcaaccgccgcgtgttcaggatcatttcccgtcgcaaatgcgttgggactgggatcgcgaatgatgaacacccgcggcatcgggacttgagcgactaacgccatatcttccacaatatgccatagctccggcgcctgactttcatcggtaatttcttgggcgtggttcatactcatcacaaccgaggtcgactgactgatcatcatcaccatgtaaattccaccaatgatgattgccatgactacccccatgatgacactgttaaagaacacatacccaatcgccatgccgatcaccatcacgagaagcacaaatcccaccattacatagatcgttcgccgtttattttgtgcaatttgctggtacaacatttacaacaccccgctagtcatcaaatgaaacttttggtgctgctttttctgtttctggaacttccaggtaatcaacttgaacaaagtggtgtactttcgctacaatgttgcttggaaatgattggatcttaatatttaagttagcagccgttgagttaaataattgccgtgaataagcaattttattttctgtattggtcagttcttccatcaacttggtatattcttgactggcctttaaatctggatagttttctgatagcgcaaaaatactctttagcgagctggtcagctgatcagaaacttccatcatttgttgatgatcaccagctggaatctgggtcatttgattgcgcagcgcaaccaccttctccagtgttccggcctcatacttcgtgtaccccttcaccgttgagactaaatttggaatcaaatcgttgcgtcgcttcagttggacatcaatctgactccacgactcttgagtatgtgtccgtgccgtcaccaagccgttgtagattccggcatagatcgcaatgataagcacaatcacgacaatgacaataattgttgttaacataactctattcccccatttcttcgcttctacccctatcttaccgaataagtgccagggtggaaagcacaacgttggacatttagaaaaactaaacatttagaaaggatgttagttatgattaaagttttatttgtttgtcttggtaatatttgtcggtcaccgatggccgaagctatgtttcggcagatggtagccgatcaccacctgaccgatcgaatcatcgtcgattctgctggtaccagtaatgaagaggaaggcaaccccgtccatcctggcacccgcaaaattctcaccaagtatcatttgtctgcagatggtttgatttcgcgaccattaaccacaacagacttcgccacggccgactatctcatttgcatggacgacatgaacctcgctcatgtccagcagatggctccggcagactcccacgcagccctatacgccatctttgacttgataccaaataaaaaaggccaggaaattcctgacccttggtacacccatcggttccaagatacttatgatagtctggcactggccttaccgtcatggttagcattctttgaacaacagcttaattgagcgtgttcgtgaatttagcacttagctgcttttgaaccgtcttaggagcatcattaaatttcatggttttttgtagtttgccacgtactaataaccgatttttcccatgagcatcacacgttatcaacgtaataatgttgcggtttggtgtatcgttcacgacgtccacccgcgtcgccgcgatgaagatacgcttataaattttatattggtacacatgcttgaggtcggtcaaataaattttttgaccgactttacttttacggtacagtggcgtaaataaaatatttttggtgtgcatgttatgaccagcaagcgcgtaattaccctttcccatcaccatatcatcacgcattgtcccggctgctaatgccaacgtgaggttcgtaacccccttagcaatcggtaagttcattttaattgctgggattgaaatttctccaatcacgttaattttctgcttgtttaaccgggcctgggcgaccgtcttcaaatctagtgacttgacgttactaaagtcgtaatcgcccttcttttgcttgttttgctgaatggtttgccggcttaccgctggttgatagtgatctaccagaaaatccttgacctgttggttaaaaatcaagcccagtgaaatcacaatcacgacaatgaaaaacagccgtaataaccacgtttttacccgtgaaggctttttttcgttcattggctttcctcctcatatgctgtgaagctggtctcacttcttaaattggtgtaatatttgtgagttatcagcttctcgcgacgagttcctttgcactcgccgatttaattcaacataagtatacccaaaaaatagagaaatgaaaggagttcgtcttatttgaattggattaaacaccgcctctttcggccgcgcgaaacatgggagaaaaatttatttgttctctggtttagcgtttttgttaccggcatggccttctcagaaatcatgccattcatgtccctttacgtcgacactttaggccagtttaccaagggtcagcttaatttgtatgcgggactaattttttcagttacctacctcgtctcagccatcgtctcaccaatttggggcaagatggccgatcgatatggtcgaaaaccgatgatccttcgcgcctcacttggaatggccctgatcattggtgcaatggggctagtcactaatatctgggagcttttcattcttcgttttattcaaggtattttttccggctacgtcagcaacgccaacgcactgatcgctactgaaacgcccaaagaaaaaagtgggatggcgctcggtaccctgatggcggggctcaccggtggtaatctcctggggccactcctaggtggctttcttgcctcgacctttagttatcggatcacgtttattattaccggcattctattgttactggtcttcattttcagccttcttttcgttcacgaacgcgacttcaagccggttgccaagaaaaagctggccagtgctaaaggtgtaatcaaggtactcaaagatccgcaaatgatttttggtatgcttctcaccacactgatcattcaagcaaccaataattccatcaccccgatcatttccctgtacgtccgtgaattaatgcaccatagtggcgacgtcactctcgtcagtggcattgtcgccgcggttcccggcatcgccactatgctggccgcccctaaattaggtcaacttggagatcgaattggtacagaacgaattttaacgattggttttattttagcaatctgcttctttatcccgactgcgtttatcactaacgtctgggaacttggtattttacgatttctgattggaatctccgacgcggcgatgatccctcaggttcaaaccctgctggctaaaaatacgcccatcgaagttaccggtcgtatcttcagttggaaccaaagcttccagaatctcgggaacgtcgttggtccattgctaggagcagtcgtatctggcttctttgattacagtggtgtcttcatcgcaaccgcgctactagtccttcttaacctcagcttatttcgcattaacgtggccaacaaacgccattaatcaccattattcgaatggtgatttttttattcaatttatgtaaccgtaatcattccaaaattaggtaaagctaaccaataattatgctatagtaagttcaattcgttttcagaaagaagattgatggatgagcacatcacaaaaattatttactaaagacaccactttaatcttacttggcagtttttgttacatgtcaagttccatgttaattaacccacttatcgttggttttacccatagtataggtgcaagcgcaattattgccggggcaataactgccattatgaacctgacttcactcctatttcggcctttcgcgggccaactaaccgaccgactgtccaaatttaaaattgccctttttggtggcgttttgctcctactcgatagtattggctatgccattgctcacgccgtttggctagtcgcagtctttcgggtcattaacggcctgggtttcgcactctgttccgtctgcatggcaacttggttagctagcctgctcccacgcaatcgaattgggacggggatgggctactacggcatgatgaacgcactggggatggcaattgcccctgctctagggatttttatgtaccatacggttgggtaccggtgggccttcatgtgcgccgcacttttcagtctcaccttgattattttaattcagtttattgccaaccacggtcaaccacgcgtcatcacaccccccagtcagccggcacataccactcaccatcttcaaattgttcaacatcaagtcgtcccggtggcgtttattatcatgctgctctcaattccctactttgcgactcaatcctacattgtggaatatgtcgctgcacggcacttgcacgtccttgtcggtagtttctttatcatctatgcgatcattcttctcgccatgcgtttgagcctcaaagactattttgatcggttaccctttcgatatttcttactcgccggtatcatctgcaacttagtcggcatgatcggtcttacatatttggttaataattggatgatgctcgtcgccgctttcggtctggctggtggttacggcgttatgtattcagtctgccaggccacggcactcctagttgcccccataagtgaacaaggactggcaaactcaacgttttacatcgggatggattctggcatggtcttaggcccgctgattgggggaatcttatttgattttgtcccttacagctggttttaccccgttctaatgatcacgctaccgctggccgcgatcgtctttcttcgctatcatcgtgcacttgaacaaacttcggttaaataaaaaaatcctgacacataactgtgtcaggatttttaagttgatcgcttattttaagccatacttcttgttgaaacgatcgacagcaccatcggcctgagtaaacttttgcttaccagtgtagaatgggtgtgaatctgaagtaacttcgacccggatcaatgggtattcgttgccgtcttcccactttgcagtttcttttgaagttgcagttgagccagagatgaacttaaagcccgttgatgaatcttcaaaaatcactgtgtggtaatctggatggattccttgtttcatagtttatacgctcctttgccatgagtcatttgctgagacatagttatttatcattaactctaacagactaacatatttttttttagactgcaaggttattcaatgacttcaacaccagattcatcctcaatccggacgttggcatttagtcgattgagtttccacacaattcggtcatagccccgtaaaatattgtcagcctttgtaatcacagtttctccctgtgccatcaagcccgcaatcatcaatgatgcgccggctcgaatttcaccggccgaaacccgagccccgtgcatttcacgggtccgttcgaccatgattagcccgccttcagcagagatattcatccccatattttgcagttctttgacgtgtttcgtacgctgcgggtaaatggtatcaacgatgacactcaccccactggctcgcgaaaggagcggcgtgatcggttgttgcagatcagtcgcaaaccctggaaatggtaaggttttaatattaatggcctgtaattcggtactatgaggcacaaaaatactgtcctcaccgatttgcagttcaactcccatttcgatcattttactcgtaaatgattccaaatgttctgggataatattgtgtagcgtcacaccatcaccgatggcagcagccaatgacaaataagtccccgcttcaatccgatcgggaataatggtatgggtgtttgttgaccgcaatgtatcaacgccttcgatccgaatcacgtccgtcccaacgccacgaatcttggcccccatgttgttcaaaaatgttgctaaatcaataatctccggctctttggccgcgttctcaataactgtggttccctttgccttaacggcagctaaaatgctgtttatggttgctccaaccgagaccatgtctaaaaatatccgggcaccgtgcaaaccgttgggtgcttcaatatgaatggtaccgtggtcctcgtctacttgtgcgccgagagccttaaaggccttgatatgctgatcaatgggccgtggtccaatgttgtcacccccgggaaacgttaatgttgcccggtgaaaccgtcctaataaagagcccataaaataatatgaggcccgtagacttttaattgctttacttggtaattcgctttcaacgatttgtgtcggatcaatgtttaagacaccatgtttgaagttcgagctgacattcatcgactccaaaatgatcatcaggttatgaacatccaaaatatccggcactgtatcgaattgaacaggggtatcggctaagatagcggcaggaataagtgcaactgtactgtttttggcaccgccaatcgtaatttcaccagacagccggtttcctccttgaatgatcatgtttttcattttttaaattcctcactgttaaaaaaactattgcattgtttaaaaacaatcaactgtaataatatagaaaccctcaacaaattacaaccgtttatatggattccatatcaatattaccaaaatttttaacgattacgaaatcgtagcttaaatttcttccagttttatgagatacctctaatttttactagttatcaaaactagcatatcagttaaatctcaactttaatttgttttgtttaccaggttaataattaaccaatatgcccattctagcgacaaaaaaagccagtgtcgatcaacaatcgactaactggcaattttgtttaattatttttcactggctgctttgatgaatgctttgaacaagccttcaggacggttcggccgtgacaagaattctgggtggtattgtgctgccacaaagaatttatgttctggaatttcaaccacttcaactaggcggttgtcaggtgatgttcctgagaagaccatgccatgtttttcgaagacgtcacgataatcgttgttaaattcataacggtgacgatgacgttcgtggatcaaatcctggttatcataagccgctgccgcaatggttccaggcttcagcttgcatggataggcccctagtcgttgcgtgccccccatattagtcacatcttcttgatctgacatcaagtcaatgatattatgcggcgtctttggatcaatttcagcggagttagcatcctcgtaccccacaacgtggcgtgcaaattcaacacaggccatttgcataccgaggcaaattcccagatatgggacattattttcacgagcataacgaattgcggcaatcttaccttcaattccacgggttccaaaaccaccaggaaccaagatcccgtcagcatcacccaataattcggccacgttttcttcagtcacgttttcggaattaaagtgtttgatttcaactttcgcattgaccgggtagccggcatgacgcagtgcttcgttcactgagatgtaggcatcttgtaagtcactatacttaccaaccattgaaattttaatcgtcttttcaaggttacgtacgtgatccaccatgtcactccagtcattcatatcagcctgaggtgcttgaattcctaagtgatcgcaaacaatttggtccatgttttgggcctgtaagttcaatggaatttgatacaacatatcaacatcgcgagattcgatcacagcttccggtttcacatcacagaataaggcaatcttttcacgcatatcatctgtgatcgcacgttctgtccgaaccacaaggatattaggttgaattcctaatcctcgtaattccttcacactgtgttgggtaggcttcgtcttcatttcgccggctgcatgcaaaattgggatcagggttgtatggatgtacaacacattttctgccccgacatcccccttcatttgacgaagtgcttccataaatggcaaggattcaatatccccgaccgtcccaccaatttcggtaatgacgatgtcagcatccgtactggttccagcacgtaagatcttttccttaatcatgttagtaatgtgtggaataacctgaactgtggctcccaaataatctccgtggcgttctttacgcaacacttccgaataaattttcccagtcgttacatttgagtattgattcaaattaatatcaataaaccgttcgtagtgaccaagatcaagatcggtctcagtcccgtcatcagttacaaacacttcaccatgttggtagggactcatcgttcctggatccacgttaatatatggatcaaatttttgaatcgtgatctttaatccccgattcttaagcaagcgaccgagtgatgcggccacgattcctttgccaagtgatgaaacaactccaccagtaacaaaaatatactttgtcattttgaaactcctttgggaaaattttgaggcagcctgtcgttaacacaaaaaaagaaagctccctattagtgtgtaatagggagcttgaatattcaacgaactattcccaattcataattgggagcccatataagataatacaaggcaatcggtctttcgtcaagaattaaaattaattctcttcgttatcgtcctcttcatcctcgtcgtcatcatcaccgaagtcttcatcatcgtcgagttcagcaagttgaccttcaataccgtcatcgggcacatcttcgtcttcatcgacgttttcagtgtcaaaatcatcatcatctttggcgtcttcgaaattatcatcatcgtcgtcggcattcaaatcttcgtcttctggatcgtcatcatcgtaatcgatcacatcgtcgtcatcaccggcgtcaacaaggaaggcgttaaccttcttgcgctttttacgcttaggttggtcttcatcttcttcatggacagttgcttcatcaattgattcaaatggataccatgcacgcaggccccatgtattgtcaccaagggaaataaagctgccatcgacatttaaatctgtgtagaattgggacaaacgttctcggatttcctcgtcacttttacccaaatattgctgaacctcgttcgcgaggtctacaaacgccattgtctcaccatgttgggacaggatagcgtgtgcaacttcgatcatcgaaagttctgatttgtcttggccgtcaaaaacttttaaatccaaattggtgcacatcccttcaaaaagtctaaactacataatacaatactatgcgttaaattgcaatctaatttggtactttccaatcaattgtccttgcgcgtgtaactcgtaatcaattgccagtttcccataagcattcattaaatccaaatcggttagaagtcgctgcgtttttacaatcaacttcatcataccatacgccgtcttataatgggtctcataatcttgctttgcattaaacatgatccgcaaccgattctcactactccgactaagcatcacagtttgatcatcatcgaaccgaaatgtcacggggacactagtatgctgatccgtttcatgatagcgcaagtaatagtgtccatttaccaacactaactgtcccggctcatcaaatttaaattgttgttgctgtccatcttgttcgatcgtggtcactaaattgacccgaactggtacccctgtttgaatgacgttcaccctcttcacattatcgttcacattataccctaaaacaccaccagtcacacgctttaaccgtgatctttgttcatgtataatggggctaaactaatcaaagaagcgatgataaaatgactagctcccattttgaactgattgaccaacactttgccccgacagaaaacctcaacgcctttgcctacactaacgcactcctcaacgaactgccggccatcaacacccccatgctccatttctggacgcttgaggataccttgatcctcgggatgaaagatgttcgcttgccccatctcgatcgtgacctcgtctttttaaaccagcagcactaccactactttgttcgtaattcgggtggactggccgtcattagcgatgccggtgtccttaatctgtcactcctcattccggcagcaactcctttaagtgtggacgccgcctaccagcaaatgaccacccttgttcaacagacctttccgaacctggcaatcgttgctgaagaagtcccccattcctactgtcccggaaagtttgaccttgccgttgacggtgttaaaattggagggatgtcccagagacggaatcctaacggaattgtcgtcatgctctatctcagcgttaatggtgaccaagctgcccgagccaaactggtgcatcagttttacgactacggtttagcaggcgaacctaaccaatggcacttccccgacgttaaggccgctgccatgaccaccctagcagactgtctcgggaccccgatgacacttgccaccgttaaacaaatgattgtacgaacacttagtttaacgctaaatgccacggcccaggtgccgaacctacacgcgcccgcctttcatgatcgactccaacatgaattagctgggatgcaaaagcgccaaacgaaactacccactacggaggttaattaatgtccgaaattaacgacgaacaactaccaaaagaaaaggtccttcgtgacccgatatacaactatatttacgtcgaaaataagatcattcttgatttaatcgacacccccgaatttcagcgtctccggcggattaaacagctcgggaccgcttctcttattttccacggtgcggaacacagtcgtttcgggcactgccttggggtttatgaaatcacgcgccgtatctgtaacctatttcaacgcaactacccgactcaaactcccggtgacggtctgtgggacgatcatgaacgcctcgtcgcgctttgtgcggcgctccttcatgacatcggccacggaccgttctcacacacgtttgagcacattttccacaccgatcatgaacaaatcacaacccagattatcacttctccagaaaccaatgttaataaaattttgcgtcgtgtttctcccgattttcccaaacaggtggccagtgtcatcacccatacctatccaaatccccaagtcgtccaaatgatttccagccaaattgatgccgaccggatggactacctgcaacgcgatgcctactataccggtaccaactatggtaaattcgatttagaacggatcttgcgggtaatgcgaccataccatgacggtatcacctttgagatcagtggcatgcacgccgtggaagattatattttaagtcgctttcaaatgtacatgcagatttactttcatccagtttctcgagccatggaagccattttggaacacttattggcccgggccaataaactataccaagggcaaattagcgaagtaaaattcacgccccacatgcttatgccgttttttaacggtcattttacgcttcaagactacctggccttagacgatggcgttttaaccacctattttgcgcactggcggacttttcccgataacatcttatcagacctcgctggtcgctttctcgatcgcaaaccgcttaaatcggttctttatacggctcaaacggaagccctactgcctaagctgcgtgatttgattcaaaccgcaggatttaacagcgactactacacagccgttaacgatagctataatttaacctacgatacgtataacccgcaggtcgccaaaccgcaaactcaaattgagcttatccaaccgaacggtgaactggtcgagctctctcaaatcagtacgttggtggcggccattgccggcaaagtatcgggtgatcaacgcttctttttcccgaaggaaatgctcgaaaagcaccaaaacattgaaatcttcgatcccatttacgaagaattccagcaacatattcacaataatgaaattatcaatccatcaaaggagtaatttaatgagtatcaaactagtcgccattgatattgatggcaccctactgaacgaaaacaaccatctcactgagggcacgattgacgccatccaaaaagcccacgagcaaggcgttcaaatcgtactatgtactggacggcccttaacgggagccaaaccctaccttcaaaaactcggcttagataatagcacggataaccatgtgattacattcaacggatcactcgtccaatcaactaacggtgacatcatggtgcgacacaccttaaccttcgccgactatgttgacatcgaagccttaacacggaaaattggcgttcatttccattgtgaaacggatcaatatatttatacggcgaataaggatctcagtccctataccattggggaggcttatctagttcggatgccaattcggtatcgtgaggttagtgaaatgaccagtgatctctccatttctaaggggatgattattgatgacccccgtctcatcacccaaattcaagaagaacaccttgtaccagacgacttctacgatcgtttctatattgtgcaaagtgaacccttcttcctcgaaattatgaataaaagtgccagcaagggcaacgccttggccgaactatgccaagaactggggctcgaacgaagtgaagtcatggctattggggaccagggcaacgatctcaccatgatcgacttcgccggtaccggtgtggcgatgggaaatgccattgatgaagtcaaacaacacgccaacgaaattaccctgcctaacagccaagacggtgtcgcggcggccatcaaaaaatgggtgcttaattaaagacgtaaaaaagagttatgtgatcatcattcacataactcttttttaatagccatttagtttttagttagttttcgtgacggcacccgttgaggcattatactgatagataccaactaagttggcaacactaccgtcttggttgtccttgcgaacttcaatcgtgtacgtttgcccactttgaccatcaattgtaaatgagtagccagatttgccatagtacccaactgctgatgcaaacttactgatgatgctattttcatcagttgttgctgaactactgctattactgctgctagacgtcgattcagacgacgtaacagagctagtacttgatgaatcactgttcttagcactggtaatcttatccgctaagcccgcagctgcttgttgaacttcgtttgtgtctgatttttgtaacgttgttgtgctatctgttgcactattgtaattaccgttcttatagtcagattctgcttgaatcagttgtttaacttctgaaatcaaactcttgaccttggtcgatggtgcacttacgtcttgcaaagtcgttaatgcctgttcatattcaccactggcaatcaacttcttggctttttgaacggcctgcgttgatgcgttcatctgcgatgactgactagttgctgaactagaactgctactttcatcactactactttggctattcccacaaccacctaacaccagcaaggcggccaccatcaacatgcccaaccatttggcgcggccttgaattaatttggtcactaatatcaccccttcgctaagattttaacctattccaaaacaatatgccagtcgtccgataaaatgggacaactggcatactttaattactgatctaaaatgttttggaaaccgcgccactcgtggcattgtactggtaaataccaactaagttggcactgtcgctggcggcattattttgacgaacttcaattgtataatccgaaccactttgggctgtaatcatgaagctcaaatctgactgcccgtacaacttagcagcactagcaaattggctaatcacggtattgctatcttcattggtcgtttgtgtcgtgcttgacgagctgctttccttagcaactggtgcttgactgctactcttagcagtcgtcgtagccgtcttcacgctggactgactcgtttgaacactattccgagttgcctgcttcggtgtcgttgtacttgcaaccgtggctgctgtactggatgacgaatgagttgatgttgctgtaactgcactttgactggtcttagatgtgcttgttgcaaccgttgcttggctaaccgaactcgttgcagcttgggattcggttgattgttgactatccttcttggcactttcatgtttggcactcttcttgacggtgacactcttggaacttgtggccgcatgcgatgagctattattgttttcaacactactacttgcgcaaccaccaagtgctagtactgccagaaccgtagcagcttctaaggtaatttttttatagttagtaaacagtttcatcatgaacccctccttgctttacaagtactattataacatgcttttttaatttttgtaacatttgcgtaatatttttgtcattttaagataatatttatgtcgtacttttgtaacataaaccccttttagtcacttaattgtcacaaaaggtcataatttcttaatttgcctaattattgttcggtatttcatactccctcaattagttaacttgcaacaaaaaaatccctatcaaatgacaatcgcatttgatagggattccgcttgtttcaccactagtagcaaaacaaactcattattaatttagtcttctgaatcttccgcgtggaaccggttgttaaacaatgggctcacgggtttgttttcgttaattcgcttgatagcagcacccagtaatggtcccacagagacctgtaccaacttatcgatccgcttttcagcaggtaagttgatcgtatcggtcacaattaacttcttgatcggcgcgttttgaagtcgttcaatggcgggacctgacaagactggatgggtacatgacgcatagacctcttctgccccagcatccatcaatgcctgtgagccaagtgaaatcgtcccagctgtatcaatcatgtcatcaatcatgatacatttcttccccttaatatcaccgataatgttcataatctcggcaacgttggctcgtggccgccgcttatcaatgatcgcaatcggcgcatgtaagaactcggccaacgcccgggcccgggttacaccaccatgatcgggtgaaacaaccactgcattttcggcaattccttcgttaatgaagtaatcggccaacaatggtgcccccatcatatgatcaagtggaatatcaaagaagccctgaatttgtgccgcatgtaaatctaacgccacgatccgtgaggcacccgcttcttggagcatattagcgactaatttcgctgtaattggttcgcgagaccgtgccttccggtcctgtcgtgcatagccatagtatggaataacaacattaattgtggcagcactcgcccgcctgagggcatcaatcataattaacaattccatcaaattgtcgttaactggggcagatgttgactgaatcacgtaaacattatcgccacgaatgctttcttcaatattaatccgaatttcaccgtcactaaaacggtccacggataattttcctagttcgactcccactgtttgggcgatcttctcggccaatggcttgtttgaatttagagcgaagatcttaagtttgggatcaaaatattgttgttccattaggtcctccgatttaattaattgtctcaactatcatatagacttgtgatttaaattgcaagttttaccagggtaattttttcgcatatcctggcttattggtctgacgagcacgggcaattgccatatcgaattgttccgtactatcagtaatcgttgatccagctgccacaaatgaatctgcagcaatatcaaccggcgcaattaagttactattgctaccgataaaggcatggtcgccgacgttcgtatggtgctttgaagttccatcgtagttaacaaaaacaacaccacaaccaatgttaatgttatctcccaacgttgcgtcaccaatgtacgtcaagtggccgaccttggtgcccttaccaatataggccttcttcacttccacaaagttcccaatatgggccccttcaccaatttcagaagctggtcgcaagtgactgttaggcccaatatcgctgcccgtgtgcatttcagaatcttcaattgttgatgaggtgacctttacttcatcatggatggttgaatcaataatttccgaatgggcaccaatgaagcagtccgaaccaatgacggtcttacctttaagaagaaccccgccttcaatgaccgtatccgagccaattttaacatcggcatcaatataggtactttcgggatccaatagcgtgaccccatttttcatcaatcttgtgttaattcgctcacgcatcaccttattggcccgtgccaaagcaacccgatcattaacacccattgattcatcgaaatttgccatcttgtaggcccccacgatatcgccgcgctgcttcaaaatactgatcacatcggtgagatagtattcgccctgtgcgttatcgtttgtgagtaagtgtaatgcagcaaacaatttttggttgtcaaagcagtacacacccgtattgatttcatgaatatcttgttcatcacgagtggcatccttttgttccacaattttttccacaatcccaatatcattccgaacaattcgaccatatccggtaggatctggtgcaacggacgttaagactgtcgccgccgcctttttagcttcgtgatattcgaacaaatgtgcgaaagtttcggctgtgaataaaggtgtatccccactgacaacaatggtttctccatccaagtttcccaaaatatcttcagcttgaagaaccgcatggccggttccaagttgtttcttttgtaggacgtaccgagtccgttcgccgagttcgttttcgacatcctgagcaccaaaaccaacaatggtaaccacgttatccatcttgttttgctcgatttgtgtcaacacgtggtcgaccatcgttttaccacaaacctgatgaagcactttataaagtttcgacttcatccgtgttcctttaccagctgctaaaataattgcgtttcttgttgccatctttacttgttccccatttctgttccaaataccgtgctcaagtaattaccaggttgtgcagcaatcgtttgattattcacatcaaccgcgttgaccttcaccagtgacgtgtagttgtctaccaaccgatgacccgtaaattcaccttctgcaaacaccgtcataccaacaaggtgtgcgtcaaactcattaattaaagagcgcatcccatttagggttccgccgcccttcatgaaatcatcaacgaccaacacgttagccccttcttgcaggctccgtcgtgatagttccattttctcaattcgtttggatgatcctgaaacatagttgacactcaccgttgatccttcggtgatatgcgagtcatttctaacaatgacaaatgggacgttcagataggttgcgacactttgcgcaatcggaattcccttagtagctaccgtcatcacggcatccacatcttgattcagatactgggtcgcaattaagcgcccaacctggcgtaaaatatctggccgacttaataagtcggataaatagacgtagccccctgggagtaatcggctctcatcgttgacttcaccaataatttggtcaatgaagttctcggcatcttctctcaaaatatacggaatgaagcgtgcaccaccggttgctcccggtaatgtttctaaaattcctgttccccgctcctggaatgtccgttttaaaatccccaaatcttcactaatcgatgatttggcagattcgtaccgctcaccgaaaaacttgagggaaaccaacgtccgaggatgttccagtaaatatcgtgtcatatcgaccaagcgatcgcttcgtctggttttcatcgccgttacccctttacatctagtgttagcattttgaatgttatccttatgaataataccataattgttcgtgttttacttaaataatgataaaaaatgtttaacttactaaatgttatgccaatttactcaagcaaccctgctatccgttcagcagtcttttatccgtttctcataatttttaacgccaaaaaaacttaattctactatataatagcttgcctaatgcgctttcatttggcccgtagaaaaagtcatgcttggaggttgtcgaccaagcatgacttttaatttctggtaaatatctaagcgcgacgagcatgccagagggccgccacaaaaatcagcacttcgattgttgcgataaagaagctcaccggccaattagtcaggtatcccagatacagaccgagccaggttcccaccaaggcaaaagtaatcgcgagaacaatcatcttaaaaacaccatgaacaaaatatttggcactcgctgccggcaatgttagcaggataaaaatcagaagtgaccccacgatttgtgctgcgacactgacgctcagtgctaatagcactaagaaaacaatggaaatcaaggttccgttaattccattcacgcgcgcaccgaccgcatcaaacgattcaaacttcagtgatcggtacatgagcaagatgaccacgataatgaccagtgatagtcccgcaatctgccacacttcggcgctactaatgccgatgacgctcccaaacaaaatgctcgtggcagaactagacgtttgatcagaaatcgcgagaaataaaatcccgaggcctaaaaacaacgccgataccgcactaatcacagattcccgacgggccgacttcacactcatttgcccgaccatcgcggaactcaacaccgtaaaaagaagcataccgttaagggctggccacccggcaaacaccccaaacgcggcgcccgcgaacccaatctctgccaatgtgtgggttaaaaaggacatgttacgggcaatcacaaagacgcccattgtgccacaaataatagcaataaaggtccccgccacaaatgcatgacgcataaaatcataacttagcattactgttcctccacttgttcgaccggtaaatcagcaatcttgcctgtcgtgtatttaaagtgttccatcatgaggaaatgatcggcgtaccgctgtgcaagtggcagatcatgagtaataaaaatcacacttaagtcctgaccatgctgaaattttgcgacaagatccaacaattcatatttcatttcgttgtctaaactcgccgttgattcatccaaaattaaaagttctggccgattaatcaacgcctgagcaaggtacgcccgctgcttttcgccccccgaagctaatcccacgggccgattggcaatcttcaataggttggtttgttgcatcacttcatctaatcgctgcacttccgctttattcagccatggtagtcgacgattaatcaagctcagtgccacaaaatcgcgcaccgaaagtggatactcttcgtctaggtttctaaattggggcacataaccaattttcattttctttttaggttcactaaattcaatcacaccggccttaggtttcaactgtcccaaaagcgctcgaacgagggtcgtttttcccacgccattttcaccaattacggccagaaaatgtcctgcttgcaggtgaaagtttaaatcatcaatgacatcttcatccccataggataaagctagtcgttgaacgttcaatacatcactaatatttacatctcctactaactaaattgtaataattactatttagtagtttactaaagtcactttactttggcaacagaaaaaattcgtccaccgtcaatgatgaacgaattttaaggttgataactaaatcttaagctgtgggatggctctcttggacacgatcaaccaaattgagaaatttctccaccactcgtcgatacttagctgggttcacataaattgattcaatatgatccgccgttggttcaacgtatagttttttcggttggttagcggcatgatacagttcaaacacattcttcaccggtaccgtttgatcccgcccaccgtgaatcaacagcaatggcaattgattgcgctgtacctgttgtaaaatatcaccatcttggaatgcgtagccatcacgaaccttcgaaatcgtactagcaatcgccacaaatgggaccgctggaaaatggtatttgtgacgaagacgatatttaccttccgcaaaaacgttgctatacccactatcggcgataataccgacaacgtttttcgggaggtcctcaccgctcacagccaggaccgttgttgcgcccatgctgattccaaagagtaaaatttgagcatcctcgttttgccgtttcagaacttcatgaatccactgcagataatcctgccggtcaagccatccaagaccaattacattgccctcactcttaccatgcgcacgagcatcgggcattaaaaggctatacccctgctcgtaaaatacacgggcgtatacccccacctgctgacgtgaatgatgtaggccatgggccaagataaccactttaccagtcgaagccggattctggacaaaactggccgccagtttgagcccatcctcggtcgtaatctgccactcttcagcattcaggtgatcaaaccaatcattgtccaccggattattttggctgatcgatttatcctgtccctgctttttttgcttatctgaaaatccagtcgcaaaccggtacaccagtgctgagccgacgattaatcccgcgcccaacgccgccgtcgtatgttgaacgagcttaaattgtttcgtttttgtgttcacaaattcaccttctcacgtattcaaaggcttattatacaccgcttgccactgaattcgaataatttcgtatcaccgtgtgtgattcttggtgcacaattcggcccggattaccgacaaccgttgcatctgccggaatatcggccagaaccaccgttcccgcaccaactttggcacgggcccccacattaattcgtcccagcaacaaagcattggcgccaatgaacacatgattagcgacatagggatgacgacggccagtttcgttgtgccgtgatccaagtgtgacgccatgcaaaatagtcacatagtcccccacaattgccgtttcaccaatcacaaccccgtgcccgtggtcgataaatacatggtgtccaatctgggcgcccggatgaatttcaacatccgtcacacgcttcccgaaatgtgcaatcattgcggcgaggagataccgatgatgctggtaaagccagtgtgcaacccgataaaagcccaacgcatggaatccagaataggttaaaagcacctcccagacccctttagctgctgggtcctggtttacgatgtatttcgctgcagctaacatcgcgtcccctcctttccgtcttttgatgtcaacttaaagttggttgagtccttgttgaacatcttcaattagatcagtttcatcttcgaggcccactgataaacgaatgagttcatctttaattccgctcgccaatcgaatttcccgcggaattgaaccgtgagtcattactgatggaatttcaatcaaactttccacgccacccaggctttcagctagtgacacaattttaaggccctcaacaaacttcttcggatctagtccgtcacggagctcaaatgagatcatggcaccgaagtgggtcatttgtttctttgcaatctcataaccgtcaaagtccggatctcccgggtaataaaccttagccacccgatcatcgtgtttcaataaattcacaatcgcagccgcattttcgtggtgcacgcgcatccgcgcccccaacgttttcatcccccgttgtaacaaccagctatcgtctggtccaagaaccgcaccaattgagttctgtaaaaaggcgatttcttcggcaagttgatcgtcattggtaaccgcaaagccagccaccaaatcgctgtgaccgccgagatacttcgtggccgaatgaaccacaatatctgcgcctaacgctagcggattttggttatatggtgtcgcaaacgtattatccacaatggccttcaatccgtgttgtttggcaattgcgctgacagccgcaatatctgaaatcttcagtaatgggttagtgggtgtttcaaagtaaatggccaccgtatcgtcttgaatggccgcttcaacctgttttaagtccgtcatatcaaccgttgtaaacgtgaggccaaacttcttgagcaccttgttaatgagccggaacgttccaccgtaaacatcatttccaacgacaaaatgatcgccggccttaaaaagagagaaaacggtgtgaatcgcggccgacccagatgcaaacgcaaacccggccgttccctgttcgatatccgcaatcagctgctctactgcggctcgtgtgggattgccagttcgcgaatactcccagtcgggctgcccacccagcactttttgatggaacgttgaagcccgataaatcggcatcgaaactgctccagtcgttgaatcctcactcacaccgccatgaattaacttcgtatcaaatttcattattaaattcctccatttttttagtcgtaaatattttcgctcaaataacgctcgcttgaatctggaaagatcgttacaatcgttgaatttgccggcagctctttggccatttctaagctcgctgctaatgctgaaccacttgaactccccacaaatagcccaaatttggctgccaattggtgcacgtggtcaaatgctgcctgatcactaattgttttcgtgacgtcaatttgaacatcatcgaagaacggaggaataaattccaccccaatgccttcggtccgatgactgtgtgagggaccaccattcaaaatcgagccctccggttcaacaaccaccgtcttcatcgtgggataaacatcgtgcagggctttggcagtgccagcgaacgttcccccactaccggcaccggcgacaaaagcatcaatccgttgtccggctaggtcggctaaaatctcaggacccaatgttgtttggtaaattcgcgggttagcaacattttcaaattgcattggaacgtatgaattatcgatctcatcagctagggcttcggccttcttcatagcccccttgatcccctcttcggaaggtgtgttaataatttcggcccccaaagcgcgcatcaaggtttgcttttcaaaactgaacttagccggtaccactagtttgactggtaaacgatacttttgcgcggctaaggccaccccaattcctgtgttacctgccgttggttcaatgattgtggtgcctgccgtaattgcgccaatttctatgccgtgttcgatcagggccatccccaaccgatccttgatgctgccaccggggttaaacgattctagcttagcgtaaatttgactgtcattaggtgtcggcaccgccaatttcattaagggggtgtgtccgattaattcgtaaatattattgaccaacattgtgataacttcctttcgaatttgaggataaaaaaagggcgtaaattcaaaattgaatttacgtcccatacgatttatcccgatgtaattgaagtgcgagttcaaattttaggcacaccaactagtgggtcgcataagacgcgatccacagcaacatacatttgcaaaattaacattgtacgcttgtgtcatttgaactacctccgtttaattgcaattagaataccctagattttttcgcctgtcaaactaaatttttatttttagtgcgcgaatgcctcaaattgagcccgcatctgagcactaatttctgctacccgtgcgtcgttattcacctgcaccaacttatacccaattgcatacggcgacgtgggataccgggggaccaccttgcaaatcagatgggctttttgccggtaaaaaaagaggttatatgagtgacaccggccccgattataatcggtcaaaaaatagtgggtcaacacccgaatggcatccgccatttcatcactggccgctaccgaatcaatcaaaatgttggcttcgacaaatcctaacaccggttggtccgaaagtgtcacacaacagtgatcagacgcaatgactgtcggccccgtaaagttctcgggaccgatattttcataaccgtctacctcctccaatccaacaatctgaagatggggatgggtaagactaccgcccgataatggcccaaaatttttgtacatcagtacactttgataacgtgggtcggataataactgttgccaagccgctagtgcaaaacgaataatatcgcgactttcagttgcggaatagttactaaaatcaccatcatgacggtgtgattcaatcaacactgtttgcgtcgtcttcgcgagtgtcggaaacttgttcatcagccaaatcatatccccacgctgctcaatgatatcggtcagtgcctcggtatcgcaaaacgggcaagcattgtgcggatgacgaatagtttctggtttatttttcgcaatttgtgattgaaaaactaattcatgtttaagcacctgacattctcctttggtcacaaacgagggactgcaactcggtgtgcagtcccttctcttcagtgattgttacaatgctcggacgagataaacctcatggcaaaaaccccgaagactattttggagtcgtttggcttgtgataattttttgcagaccccgaatacggtcggccccgtcccactcatttgcgccaccgatgcgccgtgatccaacattttttgtttcagcttcataatttctggatacatttgattggtcaatggttccaaaacatttcccatcgcatcaaacatcatttcttcgtcaacttgttccaagccctgaatgatctgttcaatattcacattatgatttaaccgttgataatcaattcgtttcaagatggtcggcgttgagacactcacctttggcttagctagcacaatcgagtaatgcggaaacggagctaacaaattgaccttttccccatgccccgtgacgtgtgccgtttgattatacacgcaatatggtacgtcagaatcgatcgtcaatgagattttggcaagctcttccagactgagtcccaagtgccagattcggttcagtgcccgcaatactgccgctgcatctgccgatccgcctcctagaccggccgccaccggaatgttttttttgatgcgaaccgtcacgccatctttttggtggaatcgattgcgcaatatatggaccgcctgataggccaaattacgctggtcgttcggcaaaaagccgctatcggtgtaaaccttaatctggtgatgtttttgaaacacctccacgctcacatagtccgctaagtcaatggaggtcatgatcatgttccactgcggcgagccatctggatatctcattggcgtatctagtcccaggttaatcttcgccggtgctttctcaatcacattcaccagatacgcctcctttttcgttagttatagatatgccaattatactaatttttaggagacggggcaataaaagaaaggcgggacttgtgagaaggcccctcacgaaaccccaggaccacggctaatcgtcatgttcgtcggtccgttcacttcggcaatgtagtaaaatgcgcactaatgcgattatctaacgttggggataactgattcatgtactgaagaactgccactttctggtttcctgtatacggtgttggcacatagtcattgtgactatcggtggtcgaaatccgggttggaatcacacggaacttcatggcactcatctttttgcccttcaccatcatattggtctgtaaaataaacgagcgcttatcggcaggattgggattccccccaaaggcaaagttgctcatcgagtaggcaatcagcttacccttgtacgattccatcgactcaatcacgtgtggatgtgaaccgatcaccatgtcagccccgtggttaattgcgtaatgggctaacgtcttttgcgtgtcattcggataggcattgcgctcaattccccaatggaagtatggtatcacaaccgcacatccctgcttgcgaagtgaacgaatgtccttggtaattttttgcttatcagcctttgtggccgcccaaccttggtatcctaaaaagcccagtttgacgcccttgaccgtcttcacgtaccgataaccctcaccaaagtaacccaactgggccttttttaaaatctcaatcgtgtcttgaaaaccgcccttaccataatcaaaaatatgattattgctaactgtaacagtatcaatcccgcccactttgagggccgcgactaatttcggattacccttgaaatgaaagacaatgctaccaggcttggcggcctcttgtcgactgtcagatgcaaatgtcgtttccaaattggcgaccgttagatcatcatgtttaaaatactgactcacattcttgaaaaaatagtgtggatcattaccatgttgagcccacaccgttggtaaattcgtggctgctttaagctgaggatctgttcctaaagtgtcgtctcccatgaatgataagtgaacggttttcgttgttttagtcgctgtctgcgtggttgccgtccccttcttggcaaccgtattttgcccatgatatcccactaaaataacaatcagcacaacgcttgcagtaataatcatcccaattttgatttgcctaattttccccataattaaactcctcgcttaataattgaataatcgaatccttcgattcaatctcccttactactataattcatcactaatgcaattgaaaccgattccagtaaaaaagcaatcatcagtaaccgatgattgctctgccgtataacgatgggtcgaacgataactcacttccatcgttaattcgtttattttgcctatttaatattaattaccaaacaaatatatttttttgttcattactctcattttttcataccactaaaaaaaccaatgactgaagccattggcgtttttagttaaattaatgaatcgtcctcaaaatcaatctcgatattcttggtcagcacatccgtgtaactgtacgatacccgttcaaacgaattttcatcctgattcaaatcgacaacgaagactgctgggtaggtttcactcaaaacgccatgacgtttagtgacttttttgcgtcctgcctgcgcaacaactaacaacttttcacccacacgggcgtcaagcttagccttgatgctctgaattgttattggcatctaattcacctcactgtgaaactattatacgcctgtttcacaaaaatagcaaattttaccacacttgcccctaattggcaagacctgaattagattagttccgcgtcccgtaaccgatttgcgagcaaaataaactggtcgagcgataacgtttcgggtcgaaccgagggtgcaatcgatagctccgctaggatggcttgcgtttgggccttcttatcagcccccttgccaaccacaccctgcagattattagccagcgtcttacggcgatggctgaagcaccccttaatgagccggaacaagcctttttcatcatcaggtaatacggctagtgcctcatggcggggcgttaactcgacaatcgccgaatccacatttggtgcggggacaaacacggtccgtggcacttcaaacgccaagcggacgtccatcttatactgaatcgcaagcgatagtgtcccgtacgccttggttcccggttccgccgccaaacgctgggcgacttctttttgcatcatcaccacaatgctagcccacttcacgtcaacgctcagtagctgcatcaagattggcgtcgtaatgtagtacggcaagttggccacaaccttgattggacgactcggatcgctaaattcctcgttgatcagggtcttaacatcggttttgaggacgtctttgttgatcaccttgacgttatcgtagtcaaataggacctcgtataaaacgtctagtaggtcttcatcaatttcaagggcaaccacttcaccggctgcttgcgccagtttttcggtcaatgccccaatcccagggccgatttcaatgacgttatccgcttttgtgatttcagcggcactcacgatgttattcaaaacattcgtatcagtcagaaagttttgccccaaactctttttagcacgtaatccgtaacgttcaaggatcgcttttgttctaatcggattaccgatttctggtttctgattcatgttgttcctccgttaataactgggcgaccgcctcatcgaaacgggccttggaaatccgaaataaattcaatcgcttgagtaattgtttaccgttcccgtacccgattcccaataactcacccaatcgttgccgccgttgtttcgcctgcgccccatttgccagcccagccgcccggatgtcactggcagtaatggttgcggcgtgtggctccgtctcctgggtataaagatgcgcaagtgcctgctgaattacctcaggggtggcatgctccaccccgagacttccaccgctcacctctggaacaccttggctccgcttgataaaagcgtgcttaaccccagggattgcctgtgaaatcatctttcggagtcgctcgccattaaaatcaggatcggtaaagacaatgagtccacgcgtctgctgcaactgcttgagctgttcaatattggcggctgagagtgctgagccattggtctcaaaagtatccgcgttcacagcctgtgcgagccgcttcgtatcatccttaccctcgaccacgatgacttccttaatcttttgcatggtgactcccaaatagttggaccgtattagcaaacgtcgcgtcagcaacctctttggcactcatttcacgtaactgcgcgatggcatccaccacaaacttagtgaagcccggttcattttgcttaccacgatatggggttggtgttaaatatggggcgtcagtttccaccagtaacatttctaatggtgtttgtttgacagattcgtgaacctctttggcgtttttgaagctggccacgccactataagaaatatgcatccccaaatccaaaaacttcttaagccactccggatcaccgttgaaactgtgcatgactcccccaatgtcacggacgtctgccgccttcaaaatcttgtacgtatcttcaaacgcatcacgatcgtgaactgaaattgggaggtgaagatctttagcaatctggacttggcgcgcaaaaacgtcgcgctgaacatcttgtggtgaggtatcccaatgataatcgagacccatttcccccatcgccactaccgccggatcggccaattgttcaatgagctgcttttcaacagtctgattatagtctttggcgttttctgggtgccagccgacaattgcgtgcagttggtcgtagtcatgagccaactgcagggcgcgctcgtttaaaacggcgtctgagccgacaatattcatctggttgaccccaaagtgcttagcacgggccaaataggcgggaacttcatcgtaaaaagtatcatcgtttaaatgcgtatgtgaatcataaatatttagtttttcgtcatgtgtgtaaattgccatggtgattctcctttgctggctcatgagatctgttttcgcaataaatgcgaagaatcagcgactgttttcggtcacgatccttcgcatttgctgtcactctaattcttattcgacgcctgaaccgttcacgagttcatctggcacaataactaattttacttcgccatcgtgttctgcagacaacaacatgccctgactcagttcgccacgcatcttacgaggcttcaagttcgccacgatcaatacttttttaccaaccaattgttctggttctggataccacttagcgattccagagagaatctgacgaccttcagccgtcccatcgtctagttggaacttcaaaagcttgtccgcaccttcgacatggtcggcggccttgatttgcgctactttaatttcaaccttatcaaaggcttcgatccgaatgggctttttaccgtctgtttcggtagcttcttcagccttagttcgtgcttctttcttagcagcttccattgcggcacgtcccttcttcttttcatcctttgtcatttcaccctgaataaaggctacttcttgctcaacatctaaacgagggaagattggttcacccttggccacaacatgcgcggtcgttgggaaatcgttaaattcaagggcactaatttgaagattatcgccttcaatgccgagttgacgcatcatctcaaccggagcctttgtcataattggttgtaacaaaccagcaatgacccgtaagctcttagctaagtgactcataacgtccacgagctgtgcgcccttggtctcatcctttgctaaaatccaaggttgggtttcatcaatatacttattggcccgcgaaactaacttccaaatggccttgagggcgtcactaaagtgcatctggttcatcaaatctttaaactcagtaatggctgcttgcgccgttttttctagatccgcatcaaactcggttgtttcaccattatcagcaattaccaagccgccttcatacttgttgatcatggcaatagtccggtttaataagtttccgaggtcatttgctaaatcaaagttcaccttatcaacaaaatcttccggcgtaaagataccatcattaccataaggcatcgcgcgtaacaagtagtagcgaacagcatcaagcccataacgttcaaccaacgtttctggatagatgacgttccccttagacttcgacattttgccgtccttcatgagcaaccacccatgaccgaagacctgtttaggcagatccaaaccgagggcgtgtaacatgattggccagtaaatcgtgtggaaacggacgatttcctttccaaccatgtggacatcggctggccagtacttcttaaagttaccgtcatcatcagtgccatacccaagcgcggtaatatagttcgtcaaagcatcgatccacacgtaaaccacatgcttaggattactcttgaccttaacgccccagttgaaggttgttcgtgacacggctaaatcttccaagccgggtttgataaagttattgatcatttcgttcatccgagcagcgggctgaatgaagtctgggtgcgtcttataataatcgagcaaccagtcggcatacttactcatcttgaagaagtaggattcctctttcacgagttcaacctcgtgaccggaaggcgccttcccgccaatgaccttgccgttatcatcacggtaaacttcagctagttgcgtttcggtaaagtattcttcatcagaaacagagtaccagccttcatattcacccagataaatatccccctgagctaataatttttcaaagatcttttgcactgctgcttcatgatagtcgtcggtagtccgaataaatttatcgttggaaatatctaataactgccacagattcttgattccggcagccatttcatccacgtaggtctgtggatcttttcctaatttttcagccttttcttcgatcttgaggccatgttcgtccgtccccgtgaggtaaaagacatcgtaacccatcagccgcttgaagcgtgcctccgcatcacaggcaatcgtggtatacgaattaccaatatgtaacttaccagatggatagtaaattggtgttgtaatatagaatgttggtttttgttcagccatatgaggccttcccttcttacttaaaattaacttttaattattagtacgtatttgtacatattagattacagtatagcaaattctgagagtagattccatacaagcgagaccgtttcgttgtaaaaccggtgccctattaagccggtactggccacttattatctaccaagccgttgtcccttgtttttctctacgcggtcagcgtggactgctagtcgattgcctgtgacctgtagtcaccaagccaccgggcctaaaacagatccatttgttcaggtggtcgtttagcgagaccggcaaatgacacgtgcaacatttcttgcaggcgtaacgcattcggggccgcatccttaccagagttattattgaaaatcacgcaaacttctcgtacctgcgatttgacgccatcaatggcttggctaaactgtgtcagttcttcgtcgctataccgatagagcgtccgttttttgcgccactcttttcccggttggttccaaccggtcatattgcgaccgtgcagtcgcaacatcaccagatcagggttcgtcacggccagttggaatggcaccgatcctgctgccgtttgtgcctcgtcagctgcgacaagcgtcatctttaactctttcagataccccgttaaggactgcaaaataatcggatcaaaccaagtcgcattgcgaaattctaccgcgatcggcacagcgggcaaaagagcccgcacccgtcttagatacgtaaaattttcggtattcgcctgaaaatatggcggaaactgaaacagaaccgtctttaactgattagccgcaatgagcggctgaagcatttctaagtacgtttgaaagatttgacggcgggcttcatcagaaataggcgccgcctgccgatcaaccgctggatgtaacgtcatttcacgatgagctttgataataaattgaaattgtgctggcaccaaggcctgccactgatgaacggtcgacgccttaggaatgccataaaacgcactatctacttccaccgtcggaaaccgggctgcatattcatccaacaagacatcacgtggttccttaatcaatgccggatgatccgtccatgttgttaatccaattgttatcatctattctcccctgctcccacaaaagtaatcgagcccgctattttcacagcgcgcccgaccattatgccattatttgatttcatgctcaagtcttagaaccgttccaaggcccgcaccagttgcatttcctgatcggaaagccgacccgtaaactgttgcgatagttgcatgccggtgctgcggtaatttcgccgaatcacggcgaggcataggtcaattgccccaatcagcaataccacaatcatcgcgttattttgcaccattgtttggttaaacaatgtcacccgtgtgccatccacgatcacacatatgatgccataaacgaccgcgcaatcaaacaaaacctgaaacattcgaatagttcgcatcttccgaatagttctatctaactgatcaaaaatcatttcacgtgtcatgacgatcacctcttagatcaattgtaaccgatttcattggtgaaataaatagttatacttcgagttcactgaaaaattgaacggcatcttcttgaatcatttcaaacttcaccggaagtgataaggcttcctgattgaccgcaatcacggtggcctgtggattacgataattcaacaaccccgcaaacgggtaaacacgcattgatgtcccaacgatcaccactaaatctgcttgttgcaggtaggccaacgagcgggtaatcgcttcactaggaatgccttcatcgtacaaaacaatatcgggccgtagcggtcccccacaaccttgatgaattcgatttttaagatagtcgtgccaatccaccgattgatgacatttttcacaggatacgtgaaagaggtttccatgaaaatcaactaattcctgcgttcctgctacctcgtacaagttatcaatattttgggtaatgaccgcagctcgcccctgattcgtgagttccgactgcttgtcgtgaatcacattcggctgagcatccgggaaatagaggttttgtttacaaaagtcgtagaacccctgcggatcagccttaaaaaatgcgtgactcagatagtattccgcatttttattttgcgtgtataacccattagccgatctgaaatctggaatccccgacgccgtcgaaacaccggctccggttagaaaaacaatatgctgtgcctgatcaaattgtgtttgaattgcagcatccacgttgatcacttccttacgatataaggcatcttaatctgcttgaaaaagtcttccacggtctgatcgtaaatatccttaaagaaatctgctgactgatccttcggtgggttgaccacgaaagagttttgccgatcattacgccgcaacccaatataggccttctcgccagtttcacgatcatccatttcggaatggaacacttcgaataattgacggacttgaaggcgaagctgccgttcactaaaggcgctcgataacgtggtaaattcgttattatgcaaggccggcaagccccattcgttcatcacatcatcaaactgcccaaacaacttaacgattgcacggcgcatggcaaacggtgaatccacgggtttagcggtcaattcatcatacagatgatgtgccgccgcaaacgccttaggataccgcttttgcaaatgttctgttacctgatccaggtggtcaccataaaagacacaggcgtccagtaaggtcaggagacggagtgtgcgttcgtcatcgtctttaccagtttcggccgtcaacgtctcgtcgattcccttgaggtagtactgttcaatttggtcatcgatcaatccgtgcttgcgttgttccgcaacgaccactaaatgcatcgcagcattgtaaagatcggtcgccataatcatcaattgctcgtctaacttctgatctccaaatgagacctgaaagaagatctggggaaatccctgcatgagcatcaatacatggagcagttcatgcgacgccgtataatctggtgccgtcacatccgtcaaggtaatcaccaagccgtctgataagatctcttgttttgcttgatcatgacggacaaatccggcctgctcatcttcggcacgaagaatcacaattcccggatactgttgattgaccgtatcgagaagattttgtgccgcttcatttaatttaacttctgccattggtttgttcctttcgtaattgcattaactggtccactgccacccggcggtcaacttgggacaggttccctagtcttgtcactaatgactcaacttccgtcggctgggcaccaactgccagtgccagtgaccgatactgcagtttcatatgaccggcctgaatgccggtcgttgccagcgcctttaacgcggctaaattttgggcaaggcccacactcgcgatcaccgccgcgagttcatggaccgatttaaattgggttagttgccggtttaactgcaccatgggaacgatgccaatcgaaccgcccaccgttcctaacggtaatggtaccaccaatttaccacacaactgatcaccgacgacttgccattcactaagtccccggtactgtccatcacgcacggctgcggcgtgggccccgctttccacggcgcgccaatcgttacccgaagcaatcaccgccgcatcaatcccattcatgatccctttgttatgcgttgccgcacggtacggatcgatctgcgcaagatggctcagttcggcaatctgcgcggcaacttgttcaccagaccactcaccggtcgcaagctgagctagttcaatctggcaattgaccatctgtgtacttgccgtggccaaattactcaaaatagccgtcaccacgtgatacccgaccgtccgcaaatggtgcgccactgcttcacacatcgtattaaccacgttggcccccattgcctcgctgacatcaatcaacaggtcaaccgacaaatagccatccggtaacggccgtaatttgagctgctgcgcacccgcaccacgggctttcattgacggatgggcttgattggcaatggttaacagttcggcagtatgggccttcagccatgtcgttaccggtgctagctcagttatctgactgagcacaacctgaccaatcatttgtcgtgcactactttgggccgtaaaaccgccactttgtgcaacgattttagcaccgttattcgcggcggccaccaccgaaggctcttcagtcaccagtgggacacagtacgcgtgctgattaaccaccatgttgagcaccagcccctccggaatggtaaactcacccacatagttttcaatcatctggtcaccatgggccgacgtgttctgtgccaacaactgccgctgggctgcagtgagttgaaagcgatccgcaatcaacgcctgccggttctctaacgactgcttatagaaaccatgttgccactgtgccatcataatccctccgtcactcttggctactgttcacttctttgtttaacatactcggcgataatgccttcacgaacaccactttccgaaaagattacccgaccatcgctactgcgttgcaggagacaaattagtggaagcataccgccaacaatgatgtcagcacgctctggttccaatcctgaaatcttctttcgttgggacaggttcttatttaaaagttcccggtaagttgcgtacacagcgcgggctgataaatgatatccgtgaatgctcccacgggtcttatggcgataattacgactcattcgggccaacgtccggttggcaccaccgagtaagacaatcgggacatgatgcgcatacttcagccatggtatcttagtaaggcgttcattaacccctacctgagctcggaacaagtcaaccgccttgacgtatccaccaaggtgatactgctccgaaatattcacggcgccgattggaatggaaatcaagttacgggccttcttatgctgaaccaaaatcaattcgcaactcgcaccaccggtatccagaatcaagcagtgatcgagttggagggttcgcacaacaccaagataatcataatacgcttccttagcaccggatagcacttgaagctcaagtcccacttcatccttgacccgctttagaaattcggcctgatttttcgcctgacgaaccgccgccgtcgtgatcgcacgaaccttgaggtggggtaagccatcgtataatttcttaaatcgtttcaacgctgcaattgtccggttcatcgcgtgttcttggagcattttttcccggcccatcccttccgagatgcgggagtcttcttttacgcgtttaacttctttaaagctcccatcaggggcaatttcggtaatcgccatgcgcactgaatttgagcctaaatcaacaattgccaagttctccaattttttcacctccagtgcgtttaaaaatatctcattaactttttattattcctttcaataataccatttcacgcgggtaacagcacttaaaaattataatctgcacgatcgacctatcaatttaaaatgattccttcaaaaccaaaaaccccgacatttctgtcggggcatttctggaatcacagaattcaaaattaacgcctgagcttagccaaagtaattgatgccaatcgcatcgcgaacttctttcaatgtttggttagccaccacattggccttctctgatccctcttttaggatctgataaacgtagtcaaggtcttgttcgtactgggcacgacgatcacgaatgggagccaaaacatcctccagcacttcgtttaagtagcgcttgatcttaacgtcaccgagaccaccagcttggtactgcgctttcaacgcggccacttgagccttatcctgatcaaaaatatcgaggtaggtgaagaccgtgttgccttccacgtggccaggatcgctgactttaatatgttcaggatcggtgtacattgacatgacctttttagagacggtatccgcatcgtctgacaggtaaatagcattgttcaacgacttactcatcttggcattcccatccaaaccaggaattcgtcctagtccttttggtgggaagtagccttcaggttccactaaaatatccttttggtaaattgtgttgaacgaccggacgatttcacgcgtttgttccaacattggttcttgatcatcaccaacaggcaccgtatccgccttaaaagccgtaatgtcagcagcttgactcacggggtagataaagaaaccagctggcacgctttcgccaaacttcttttgtttgatttcagtcttcacggttggattgcgactgatgcggttaactgacacaatgtttaaatagtgcatcgtcagctcgttcaaggctggaatttgtgattgaacaagaatggtcgacttagctggatcaatgcccacggccaagtagtccagagcgacttggatcagactgttgcgaatcttttcaggatcacgagcgttatcagtcaacgcctgctgatcagcaatcatgatgtaattgtcgtattcaccagaattttgtaatgcaactcggttacgtaatgagccgacataatgcccaatatggagcttacccgttgggcggtcaccagttaaaattgttttctttgccatgagattattttcctccaatgttataaaaaaagcctactgcaaaaaatgcaataggacgtcgtcgcgcggtaccacctagcttgcagcatatgtgctgccactttatcccttagggcgggaaaccacatgatccaattcgcgctttagaagtcctttcaccaaccacacttctcgcttaattcacgctactcttaactctttaagtttaccgattaaatggaggaatgtaaagatgtgacttttaaatcagaggaaatcttaacaaacccacgaataatgttgtcgaacgcttgcagtgacaccactgacggtctacaatggatagacactttttgaatggattaggaaacggaggccctgtagtgactgaacaacaagaaaaacaacaagaacagcaacgggtaaattttgtgagtggtcaaattcgggaacaaattgaaaccaaccggcaacttctcgaagccgcccatcgtgaaacacgggccgttgaacaaaactacagcgataatgcttcggtcaataactacgaagccgatgatacaaccgatacgattgccaacatcgaagagcaacggcaactcgttgcgcgtgctaacgaaagcgaaatgatcttaaaacggcaactcgatacgatgactaatctcgccggatcgccctattttggacggattgatattaaggaccctggtgaaactactcccgaatcactttacattggtgtcgcttccctaatgaatgacgaaaaaaacgagttcctgatctacgactggcgggcaccaatttctggggtgtactacaatggcacgctcgggaccgttcactatcccacccccggtggcacgcaaacgaccgaattaacgaagaagcgccaattcaccattcgtgacgggcaaattaccaatatgtttgacactaacgagaccgtgggcgatgaaatgcttcaggctgccttggggcagcaaaacgatcagcatatgcaaaatatcgttgccacaattcaaaaggaacaaaatgacattattcgtgataccactagcgatctgcttctcgtacaaggagttgccggaagcggtaaaacttccgccatcctccaacgcattgcgtacttgctctaccacagccgtgccagcctcaacgccgaccaaattgtgctcttttctcccaatcgcctctttagccactatatttcagaagttctcccgagtttaggggaacgtaatatgcgccaaattaccctggcggagtttctcaaccggcgttttgaaggtcttgatgtccaaaccttattccagcgcttcgaagacgagcaaagccaaactgagcagcaaaaaacggttcaagcagtactggaaagtgcggccagcatgcaacacgtcgagcagtattgtcagtccttaactccgaatgatattcagttcaccaacattctatttaacggtcgtgttttcttcagtgccgatcatattctcgcactttaccagcagcttcccaccaatttacatctggctgataagatattagccaccaaaaatgccttgatcaaggaactgaaacaacgaattaaacacgaggctaaacaagcttggattgcggaagaattagaccacctcagtgatgagtcgatgctggcgctttacggcaagcatcggccagaggagttcgattccgaagacgctcagatcgactatctctcacggcgattggctcatcgtagactccgaattgtgtacgatgcgatttataataactactttatcgatttctacgctcagtacgggcactttttacaggccaccccactcgcccaacaggtaaccactgatgcctggcaaacaatgatgaccgcttatcgccatggtattgagtttcaccaaatagcgctcatgcattgtgccccgcttcttttactacgggacttaatcaccggttcaggacaaaatcgagcattggaatatgtcttcattgatgaaacgcaagattattccgtggccgccctcatctatctaaaacacgtctttgttaatgctaaatttacaattttaggtgacagcgagcaagcgctctttaaggatatcgaagccccacaatctcttttgcaccggctcagcgaggccctcgcggctaaacggcccaacctaattgctctcaatcgtagctatcggtcgaccaccgaaatcacacactttgccaaagcgctgcttcccgacggcgatcaaattacggctttcagtcggcacggggcccgtccgaaagtcctcattcgttacgatcacgcaggtgcagatgaggcattacttgccgaaaccaaacggtatcaggccacctatcaaaccgtggccattctcaccaaaaatgcccaacaggccaaggacgtcttccagcggctccacacacaaaccgagctgcatctcctacaagatactgatcgacaactacccggagggctaattgttctcccaatttaccttgcaaagggactcgagttcgatgcggtcatcgcctacgacgtctcagaaactaactatcatgagcggcggtcaatcggcattctctataccattgcatcgcgtgcgatgcatgacctgaccctactaagcatcggtgaagtcagttcagttatcacccaaattcccagcgatctaatgcaaattgaacatcgtgtctccaaaaagtaatccgccgtactaggctaccgaaaaaaacttcgtcttagcatcgacgcagagtaaggtttcattaaccattcaaaatcgccaccaaagtgggaatgcccctactttgatggcgattttagtgatccgatgatgcctttccattttctcagtaacctccggaatagttaagctgttttttagtttacacagttaacaatcattggtataccgcggtttacaaattgttgatataggcaatcgtttcgatagacttttgttgcacaacggattatagtaggggcagaaatgttacttaatctatccggaggtgcacaataatgacgaaaaacaaagcgattatgattggtgcagggctggcaaatatggcggctgcggtttatttgattcaggaaggtcactggaatggtgatcaaattacattttactcactcgacgatcatggttccaacgatggtgctccaactgatgaaaccaccgatgaatactggaataaagaacacccgatggccaacaccaagggttatgttgctcgtgggggccggatgttaaactaccggacttacgttgatctaatggatttgctcgatcgaattccatcagcaacggaagaaggaatgacggcggccgaagatacgcgtgattttgacgcgaaacaccggaccttcgataaggcacgcctgcttcaaggcgggaagggcattatcaatgggggccacctggggctgaacaataaggaccggatgctactgagtcgtctggtcctcatgcccgactctcaggaagaaaaactagataatattacaattgcggactattttaaatcgtcgcaacatattttcaccactaatttctggtacatgtgggaaaccacgtttgcattccggacgaagagttctgtccaagaactccggcgttacatgcaccaaatgatttatgaattcactcaaattgaacacctagttggcgttaaccggacccgctataaccagtatgaaagtatcatgctccccttgattaattatctcaaagaacaaggttgccaaatcattttaaaccggcgggttaccgactggcacttcaaagaaacagccatgcaagatgaaattaccgttacgggcttagaaatggaaaacaccttaactggcgaaaccgaaagtgtcacagttgacgatgcaacggctgttttcttcacaaacggatcaatcacggattcagccacaatgggagactacaacacaccggcagctgaaaacatggactacggggcagccgctgggttgtggaaaaaagccaccgcgcatttctataacttaggtaaccctgacaaattctttgcggatcgggatgcaagtgaatgggtcagcttcacgctaaccactaagaatcatcttttactcaacgaaatcacgcggattaccacccaagttcccggtaacgcactgaactcgtttatttccacaacgccgattaccccactcggacataaggacgttaatatgtcgattgtggtccatcaccaaccccacttcacgactcaaaaaccaaatgaaaccgtcatctggggttacttcctctatccacgtcggcgcggggaattcgtcaataagcagtatattaagatgactgggaaagaaatgctaacagagctgatcggccaactagcaaaggtggatcccggcccggttaatattaaccactacacgaaggaaatctttgatagcgtcatcaataatattccagtctacatgccatacgcctcggctttgtttaataaccgggccaaggcagatcggccagaagtgatccccactcactccaccaacctcgcctttaccggcgaatttgttgaacagccctaccaaatggttttcacggaacaaagtgcggtccgttccggagaaatcgcggctttccactttgcgggcgtgccaatggacaaactcgtcaaaaacccaagattcgacaaggatccaaaggtcttggcaagggcaacgaaaaaaatgtttatgtaagtaacaggatgcgtagcaagcacgactatggcttgagcattagtgaaataaagacaattaatcctgatcttgggattggttgtctttatttggctaagcgcagagccttgtgcttgcggagctcaactcaaacaggatgcgcagcacacgcgactatggcttgagcattagtgaaataaagacaattaatcctgatcttgggattggttgtctttatttgattacatgaccggtgaacatcacctctaacctgttcaaaactcgccaccgtcagtcattatccacatgtgcaaaactacatttgtcattgacactgtggataactcaaaattatccccacaattcacaacttatccacgtaaaaggaccacttatcccctgaatgcacagcaggtaagtgatcctttcttaattatccacagttaactgactgtagaaccctgtgataatgatgtcgttggtaactgttgatggtgcttgatcgcatgcttgaggataaatggtgccaataccgtggctaaaacaatcactagaatcaaatccgaataataggcccccgatagcaggtgcgcatcaaacccgatttgagccgtaatcagcgccatttctcctcgcgaaatcatgccagccccaaccaaatagtcgctctgcaaactaaagccacttaaagcagcaccgagaccgcagccaaggagcttggtcagacatgccagaatcgtcatgataatgacaaacccaagcgattgcgacaaatgggtcatcgtcatgttgagcccgacactcacaaagaagagtggaataaaaatggcgtatccaattggttccacacttttatccactatttcgcgcttggtggtgtgggcaatcgcaatgccggcaaaaaaggcgcccacagcaccactaagaccaacataatctgcgaccgcagccatgctgaaacagatcaccatcgacatgaccgtcggcgccaaggttgtcagtaacttctcactgagtcccattaaaatgggcgcaagccatctgacaagtaagtaaactcccgcgaaaaataagatctgctccacaaaaatcagggcgaggctcgtggatgcccccgtcgccattcccgtttggtgcatcacactaatcatgatgctcaacaagatcacgccgatcacatcatcagccaccgccgcacctaaaattgtggcaccttctttggtatctaaataatgaaattcctttaaaacagcgaccgaaatgctaacggaagtcgctgaaaaaacaaccccaataaacaatgattctagtagtgagaatcccatgatgaagcttgccatccccatgatgacgatcggaaaaatcacaccgattaccgccaccacgagagctggctttaaatatcgttttagcagtcccaaatcactttctaatccaccaataaacatcagcaaaatgacgccaatattttgaaattcattcatcatcgtgtccaactgaacccaattaagtagggccggtccgactatcattccaatcataatctgaccgatcactcctggaataccgatgcgatgacatagatgtgccgctagttgtgtcagtagcagtaatccggctaatactgcaataaatgtcatgttcccgtcccctccatcggtttatatcataccatgaaaaatcggccaacgtgctagcagcgcccacactctgcagctcgtagaccgatgcccacttttcatattctatttttactatgtgtttaatcgcttagaaatacttcatttattttatgtgtttgtcctatgtgttgtttgttatatgtggtgaccctatgtgtgtgttgtgctatgtgtcgatggttagtttgattctggcatcatcttatgtgaatgactcgttaatgcttggcaaccgtagatggcaagccccaaaataaatccgattaaagctggtaatacccaatccatcccgtagctcgcgaatggtaggtaattatcaagttgcaacaaggccttggcccacccgctggtcgaaatgatcgcaggtgcagaagcaatcccgtcaaggaatgcaggaatcaaagttaaaatagttgtcataatgtaaacaatccgagcccgcttaaacagtggtgaaaggattgataaggcaatcagcgtaatcgccaatggataaacaaacatcagcattggtaaggaccaagcaataatctgatccagcccgaggttggcaatcaaaaatgagagtaagcaggtaaatgcgttccacttagcgtagctaattttagggaagcgactgtgtaaggcttccgagaaggaggtagataacccaatcgaggttgttagacaggttaaggtcgccataattgctaaaataatctgaccggggatccccatgaagtgcatggcaatttggctaaacgcaatgccgccatcggccgacagcttaaagtaggttaagctcgttgccccaatgtaaatgagaatcaggtagatcaatgcctcaaggctaatactgattaagccagatttagcggtggccttggcaattgccgtcggatttgtcaacccaaagtggcgaataacagtcacgatcgcgatcccgaatagcaacccagcaatggcatccatggtattgtatccttgcaaaaagccattcagaaatgaggcgtgctgataagccgcagtggcagtctgactaccagcgtgacccattggttcaaaaaaggcaaacccgaaaatgatcgccaataaaattaaaaataacggattcagtaacttaccaatcgagttaacgatttcgccaggtttgcgtgcaaatgcccaagtaatggtgaaaaagattaacgagtaaatgaacagggcccatggtgtttggctggcgcttaattgctgaccaaacgcgatttgaaatggtgtggtggccgtccggggcgttgcgaataatggccctagcgtggcacaaagtaaaatcataaaaatcgtcgcatatttcttcccgatcggttttgcgaggtcgtaaattccattagatctcgtaatgctaatcgcaataacggctagcaatggtaggagagtccccgtaatcagaaacccaatggcagctggtagccaatggcttccggctaactgtcccaaatgaatcggaaaaatcagattaccagcaccgaaaaacatgccaaacaacattgatccaataaacaaataattacccttagttaacttctttttttccatgatatgatctcctttgaataaaagctgtgctgtatctatctattcaaagaaactgactcgaataattcctccgttactactcgcccgattactttgcatacccaagccttctttcgtttagttagttaaagataaataaaaagcgcccctattaagcacttgcttaataaggacgctacgcgtgttaccacctcatatttgtatactcctcacgaaatatacctcaccaggtacggccacactcgtggcgataccttggcactataatgggtgcacccattgaacactcgttgctcgcattcaactctcggagattactttcacaccgctcaggctccccgttctcaccaagctaggggtctcttaagtcctgagtaatactactcttctcttcaacgttctaatctatctttaatgttgtaaatagattaacgcgcttttagcacattgtcaataggattttatcattttattttcagaatctaattttaagccaattattgggcgcgtccacttgagccgtgacagcccatagctccatatcaaaatcgtcccaaataccgccacaaaacatagtgggacaatgaccagatacacccatgatggccatgcggttagccgtaagagtcccgccaatgcagtcaggaaaatactttgtgtgagataaatgccaaatgtcagttgcccgagccgatgaacgaccgggattgtaacccaggaccgtcgtagcccccattgactcacacccaacaaggccataatggtgaccacatctagcagtaccacgaagggttggtgaatcgactgtgcatcatgattggcaaatccgagaacgttaatgttaacccagtacaggccgatggtggccacactcagcccgactgctaaccaacttaacgcctttaaatggactttcagccagtgactgacccgctgatagtgaaccgccgtgacggctcccattacgaagtaaagctggtacatcaacggatcagtaccataatgatgaaaaatgagccccaaaacggggtgggcggctgttgtgggatgcccatatttgatcaccgcagtcagcaggagttgtaagccaaaactaaacccgatcaaccactgatgatgatcccgcgttttttcgacaatccataataagatcggaaaaatcaagtaaagttgcgcaatcataaacagaaaatacatatagaactggttaccatgaccgatggtggtcaaccaccgttggacgtaccgagtccacgtcaatcgctgatgaatgacaagcaatcccgccagcaaaacggtattccacactaggtatggaataccgatgcgcacatatcgtcggtaccaaaaggtgacccaattaggatgccggtcaaaatattgccaggtcagcactaagccggttacaaagacaaaccccattcgcgtaaagtgcaacatagtatgggttgaattaaaaatcaggtgactgactgatccggttgcggtggcatttgtcagcgttgtctcagtatgagttagcacaaccccaatgattaggagtagtcggagtaaatctccttcgtataaatatggccgcgcgtgttttacccgttcagccatccctacttaccagcggatacactcagtagttcatcctttaatttcggccgcaaaattttgccagtggggtttcgtggaaaatcgtccacaaagtagacctgagttggttgttcgaacttggctaaattataaccagcataatctagcaattgttgccgcatatcgtcgcggtccccactgagatccttaggcttaatgacggccgtcacagcttctccatacaggtcatctggcatgccgataacggcaatttcttcaataaacggtaactgcgagagaatactttgaacttctgcgggggctactttttcaccaccgcggttaatcatatccttgctacggcccttgacgaatagataaccatcttcatcgagatagccgagatcccccgtaagaaaccacccgtcttggaatgaggctggttgtggatccatgtactcggaaatcacatggtcaccacggacaacaatttcaccaatctgagtatcgcttgtttcgtactgtccgttaactaggattgcgaggtcggtcccgaatgccttaccggcagagccaatcttttgcgcgtcaaacggattgagcgtacattgactggatgtctcggtcatcccgtaaccttcaagaatctgcgtgtcaaattggtcttgaaaggccataaatttgttttctggcaatgagaatgacgaactccgcacgaaacgaagattgatttgatcacgtaactgagaatagatcaagttggctttatcattaattagcagaattgaaataatggttggcacaaccgaaacccatgtgacgtggttatcactcacctgctgccagaaacgactggcgctaaacttctgtgcaatcacgattttgccacccgaaagacgcgttgacagggttgaaatcacttgggcgttaatatgaaacatcggcatgataatcatggttgtatcatcttcagttaaccggtgagaatcaatatcgtgatgggcggcgttattcaaaattttgtgcgtgagccctacccgcttgggctttcctgtggttcccgatgtattcagaattaaagccaaatcatcttcgctgggttctgtaggattttgaatcattcgatcagccactaatgacgtgttgataaagacagtcaaattagaatccgtttcaagccggatagctgttttttcaaggaccgaatcgttcacaatttgatcggctagttcgtgcttcacaatgaccaccgcatagtcatgttcattgaattctgactgtaactgcgcaatgggcgtcgttgcagctacgggatgttcaatcatgcccatttcccagattgcttgggttaaaacaggatacacggctgaattatcaagacacacgagcgccaaatcgcccttggtcagttttaaattaataaagtgctgtcttaatcgggtaacatctgcggaaacttgtcgcccggtaaaccattggtcagccttaaggtctttaataacggtatcgttttggtgcaggataagttgtttagtcagttgttttgtaagttctgtcatagtgaatgacttcctttctttttcgtctctgtggccggccaattaagattccaaatggtgggaccttgtagcagaaccaagcaattaaaaatgaaccaatggccacaaatgcgtagccgacgggcaataataggacatagccccaggatggtaaatgggtttgcgccaatcccagttttaaaatcgtcagtgggatggtttgaacgaggtagaccccaaatgagaccttggcacccattctaataatccagtcgattttgggactcagcccatgttgtcgatggtatgcatagcgtcgtccaacccaaaatacggtcgaaatcataactaatgcatagaccatcaggtatggctgatgaacctctagcgccttcgctagtgtcaggtgcaaaacattgatgtcaaagaagtaaagaccgatcgtaccaaatgctaacaagacggtgattaccataagtggccgagcatgatctttaatccagtcatcgaactggtggtaatgaatagccacaaaggagccaaaaataaagtacagttgatatgaaataacgttcattccatatgatctgaaaagataccaccagccactagtatccaagtggggatacccgtacttgaacatgagtaacatgagaagttgaacaatgatgctgccaattaaaatccgactgtgcatcttaaccgttttaaacaggcggacaatgagcggatatagcaggtataactggaacgtgaccaagatatagtacatgtaaaaactatcaccgtacaaaatagcgtggccccaatttttaaagtagctccaaccgttgaacgcgacaccatcggcaatcattcccatcagtaggaagaacccgttccaaaagatgtatggaattccagaactcagatatcgcttcttccagaactgtggccaattattttgccggttgtaatagtttaatgtgagtacaaggccggtcataaacatgaaacccattcgcgtaaaatgaagcatcaaatgacttgcgttaaagaaaagttgactggatgaacctgctaccgtcatacgctccaaggccgtagtcgtgtgatttaataacacaccaaaaataaaaatgatccgcatcaaatcaacctcgtatagataaggtcttttcgctttagtcggcattgctgttcacctgcgttttcaaaaaattcattttgctcatcctctctattagtgctgcttcatccatgcaacaactagtgaaagggttgcgacactactcaaaatccaaatgccttttttcaatctgcctttagttttcatttcatcgcatccttttttattattttcaagagttaaatttacacttccgatttgaacgcaccacgaccaaaatacgaaaaaataagccaaagttatgaacatttctgttataactttgacttatttatgagttttttgaagatcttatgaacttacaagcaataactaatctaactcggcgaaacccagactcatcctatctcaattccgagttcctagtaatagagcccatgttcgtaattccatgatgagaatacctgactcatgttttccataattttatcaacatcgagaccctttcgaatcacaattggtgcaggctgaacaccaacacggccattttgccgcggaacgagctcgccgctctcatcgaccattgaaaccatcaccccttgttcgtaacgagtatcgacagttttatctggttgaatcgaagctacatagtcatctgcttcgatgatgacatctgcagccgcttcaatgcgttcaccgattcccgttacgagtccgcgatttcccttgccagaaggattagctgaactagcaaatgagaatttatggtacttggtccataattcatgggcaatctgttcacttggtttaccaaatttgataacaaaacagcttgtttcgcgtttatccatcatcaaatcctttgtcccatcgttaggaagttgtgccttagcttcttccttccatgggagaatgcatccgagcaaaatgtcttgatcccagtgcttttggtataatgcttcaatttcgggtgtcatttgggccagttctttcacctgctccatcgaaccacacaacacaacaccaggtttattccgtttacgttttttagccgcaaactttcgttccaatcccttaacgtcggaagtcatgatgatgtagcccaccttggtgggactgacaatcattccgccgttgcccttcagtttttcgattccttctgcttgtaccgctccctgccattttactgttttagcagctgctgatggcttacttgtctggttatttcgcacttttgctatgtattctgatgctttagtcatatcaatctcttcctttcatgtttctctttctatgtcatcaaaatataaaattaaaataatctaataatacatttttgttatattctagtatcggcgtaattgaccgatatgtcaatatctaattatgagatttttttcatttaattctaattattatttgaattaaacgcactagctctgggatatagctactaaataaacgcgcggttcgcagttttaacggcacaaaaaaaaccgctagtcttccgactaacggttatcgtgcatggcgacgtcctaccctcgcagggagcgatcccccaactactctcggcgcttagaagcttgacttctgtgttcggcatgggaacaggtatatccttctagccatcatcaccacactccatacgacatcactgtcgtatttgagaacggtgcgctctcaaaactaataatatctcccaattcatttttctaccaacagccttcaatcacacacactgtacgaatcgcactacttagttacgtctcgaccgattagtattggtcccttccatgcatcactgccacttccactcctttcaacctatctaccctcatcactctctgaggggtcttactcttcccgaaggaagatgggaatctcatctgcgagaaggcgagtttcccacacttagatgcgatcagcgtttatctcatccatacgtactacccagctatggctctggcggcacaacatggtacaccagcgtatgtccatcccggatcctctcgtactaaggacactccctctcaaattgcgctgccccgcggacggatagggcgcgaactgtcctcaacgacgttagcgtgaagtgcgcgcaaatctctcagtaccgtgtagcaaaatggtggcataaaaaacagcccaaccgcgttggggacagccgacatagccccaggataatctgatgaggcacatcgagggtccaaacctccccgtctgatgggactcttgggggatgataggacgctgttaagatacccaacaggagttaactttggtaaggagtccgtttgagcgatggcccttcctcaggttaccaccgtagcactagcccgacttttcgtccctgctcgaccttcctgtcctcgccagtcaagccccttgtgcttacactctggcgatgatttccaaccattctgagggaccctttgggcgccctccgttactttttaggaggcgaccgcccatcaaactgcctacctgacacgtgtctcctccccaccacgatggttcgggtttagagtggtcatacacgagtgatagtatccactatgcctccgccgaaactagcgtcccgtcctcgtaaccggtcctacctattctgtacagcggtacaacactcaaatcaagctaagttaagctccatggggtcatttccgtccttgcgcggtaccctgtttccgttatcaatttcacgagtctctcgttgagacagtgcccagatcgtacggcacaacgtgccttcggcgggtcgaacttaacccgacaaggatttcgccctacccttcaggaccgttaagttacggccgccgtttactggcttcttcgattctgagcttcgccgaagctaaccccatccttttaccttccagcacgcggcagaggcgtcagccctatacttcatctacgatttttgcaagaaacctgtgtttttgataaacatcgcctgggccctattcactgcggctgcactgacgtgcagcacccttctccctaagttacggggtcatttttgccgagttgccttcacgaagatgttcactcagctcccttaggattctacctcctcgctcctgttccgtgtttgcgtacgggctggtaactattcactagaagcttttctcggcagtggtgacatcgcaacttcgctaccttaaatttcgctcccatcacacttttccgttagattaaagccatttcctctaatcaagccttgctgcttggcagacatatccaacagtcttgtgtttgctttagcctcctgctccctccatcgttcaaacacgttaactggtacaggaatatcaacctggttatcctcgtctacgcgctttcgccttcactagctcccgacttacccgcgggaggacgagcctttcccggaaaccttgtcatgtgccggtggacaagattctcacattgtctttcgctactcatactgccattctcacttctaagacgcctccaccagtcctcacgggcttacttcatattgcctctttagaaacgctctctatcacgcatcttacgatgcatccaatttcggtaatatgccttagccccgttacattgtcggcgcaggatcctcgactagtgactattacgcactcttaaatgatgggctgcttctgagcccaacatcctagttgtctaagcactccaacatccttattccacttagcatatattttgggaccttaactgtgatctgggctgttccctcttttgacgatgatcttagcactcaccgtctgactcccgacaaatcaatggcattcgagtttatctgtattcagtaacccaagacgggccctagtcacaaacagctgctctacctccatgattcttatccgaggctaccctaaagcctctattctcggagagaccagtaaatcctccaagttgttttggaatttgcacatcgctacccccccaccctcatcccagcattttcaactgacacgggttcgtcctccagtgcgttttaaccgcaccttcaaacctggactgggtagtgtcacctggtttcggtcacaacaacatacgtctatcgcccatttcagactcgcttcgctacggctccggtttttccacttacctggcatgcaatcgtactcgccgttcattctacaatagcacgcggtcacccattaacgggctcccactgtttgtagcacattgttttcaggaacttttcactccccttccgggtgctttgcacctttccctccggtactggttcactacggtcacagggagtatttagccttgtggataatggcctccccgattccgacgaatttcacgtgttccgccgtactcaggatccgacctgagagtagccgtttcgtctacggattatcaccctcctgattagcttcccgctcttttcgacacgtttctcactttggtaaacatcaaatttcagtcctcaaaccccaaccaccgccaagctcgttgtggttgggctttttcccgtttcgcctcgccctactcagatcagggaatgatttttctttctcttccgctagctacttaatgttttcgttcactgcgtctacctctacttaggctatgtatttcactaagtgtgaactaacgactaagttagtggggtttccccattcggaaatctccggatcaaagtgtactgtaccactaccatccgaagcatatcgtgttagtcccgtccttcagcggctcctagtaccaaggcattcaccatgcgccctttataacttaaccttgctttgaccacgtcgtgtcgccacagattaatttgagtattactcgatgtatgtattcattaaaaaactcaataacgcggtgttctcggtttgttttaaaaaaatatttcgatatatttagttttcaaatacagttatgagggtaaacccctcaaaacaaacaaagtttcatgtgacaagtcaaacggcaagttccgttttattccttagaacaggaggtgatccagccgcaggttctccctacggctaccttgttacgacttcaccctaatcatctgtccacctaggcgctggctcccgaagggttcaccccaccgacttgggtgttacaaactctcatggtgtacggggcggtgtgtacaagggcccgggaacgtattcacccgcatgctgatccgcgattactagcgatgtccgacttcgtgtaggcgagttgcaagctacagtccgaacttgagaactgcttaagagattagcttaccctcgggcgagttcgcactcgtttgtaccgtccattgtagcacgtgtgtacccaggtcataaggggctgaatgatttgacgtccgtccccaccttcctccggtttgtcaccggcagtctcccaagtgcccaactaaatgctggcaactgataatagggttgcgctcgttgcgggacttaacccaacatctcacgacacgagctgacgacaaccatgcaccaccttcttagcgtccccgaaggaacgtctcactctctgagattggcgctagatgtcaagactggtaaggtcttcgcgttgctcttcgaattaaaccacatgctccaccgcttgtgcgggcccccgtcaattcctttgagtttcaaccttgtcgtctacccccaggcggaatgcttaatgcgttactgcagcactgaagggcggaaaccctccaacacttagcattcatcgtttacggcatggactaccagggtatctaatcctgttcgctaccatgctttcgagcctcagcgtcagttacagaccagacagccgccttcgccactgttgttcttccatattctacgcatttcacttccgctacactggagttccactgtcccttctgcactcaattttccccagtttcccagttccgagcacttcttcggttaagccaaggcttttcacatcagacttaaaaaccgcctgcgctcgctttacgcccaataaatccgataaacgcttgccacctacgtattaccgcggctgctggcacgtagttacgtggctttctggttaaataccgtcaccctaagcagtttactctgatacgttcttctttaacaacagagttttacgagccgaacccttcttcactcaccggtgttgctccatcagcggcttgcccattgtggaagattccctactgctcctcccgtagatatgggccgtgtctcagtcccattgtggccgctcaacctctcagttcggctatgtatcattgccttggtaaccgttaccttaccaactagctatacacacaccgcgggtcctccgaagatagcacaagccatctttcaaataaaccatgggttctatctattatgcggtattagcatctgtttccaaatgtatatccccccacttctggccaggttacccccgtgttactcacccgtccgccactcattcccgatgttttatcaatcagtgcaagcaccttcaatcaaaacggaatgcgtacgacttgcattattaggcacacaccgccagcgttcatcctgagccaggatcaaactctcatataaaataaagaactttttagcctcgttttgatttgttactttaagcgaattgacttcgcaaatgttttgcctttaaccctacgggctaaaggaccctacacatttgatttgtcgaaactttgttcagttttcaaaggtctaccatgttgcgtttatgtatcgcaacaacgtctacttactatacagactaaagtcgaattcgtcaacataccatttactagcttttttatagttcaaagaagcattgttcgttttttaactatcagaagctcatacggaactatttttgttcgtattagtcgtcatttaattcaaaacaagggccaaatgaagactcaaaattagcaaaaaataaaaagccaaaaaagtaaacttttttggctttctcatttttatctcattttagtgaattcgcgctaggaaatacttcttcttcccacgacgaacaatgacaaactttccatcaaaatggctggcaggatcgatctcagcttcaagatctgtgaccttctcaccgttaatgcgaattgcaccattttgaacatcttcacgggcctgccgtcttgatgattcaatcttagtatcgtcaaccaaccacaaaatgatgttcttcttttctgcggatacgtcaacggacggcatatttttaaagccttgctcgatttcagccgttgttaaatccgcaacgttaccagagaacaatgcagccgtaatatgttgtgcttcctcaaccgcctgtttaccatgaacaaattctgtcacttcttctgccaagcggcgttgtgcttcccgcttttcaggttgtgtctcaactttgtgagccagttcgttgatttcatcttcattcaagaaggtgaagtacttcaggtatttcacaacatcacgatcatcttggttaatccaaaattggtaaaattcgtatggcgttgtcttttcggggtccaaccaaactgccccaccggcagtcttaccaaactttgtgccatcggctttaagcattaatggaatcgttagtgcgtgggcccgggcatcggcgccctcaatcttatgaattaaatcaatcccggccgtaatattgccccattgatctgcgcccccaacttgtaactgaacgtcctctgcttggaatagatgaaggaagtcaacggattgtaaaatctggtaggtgaattcagtgaaggaaatcccgacttctaaccggctcgcaacgacttccttgttcaacatggtattcacgttaaacagctttccataatcacggaggaagtctaatagagaaaactgtgataaccaatcgtaattatcaacgatcgtaaagttctctgtaccaaacaggttctccatctgactcgtcaaagcttccttattgtgctgtacttgttccattgtctggagtttacgttccgagttcttccctgatgggtcgccaatcgcaccagttccaccaccaatcaaaattaccggatggtgtccttgcaattggaaccgtttcagcatcataaacggaattaagtgaccaatatgtaaactgtcacccgttggatccacaccgcagtatagactgattttcttttcatcagtcaatttccgtaagtctgcttcatccgttgtttgattgacggccccccgccagcgtagttcgtcaattatgttcatctgtatcctcctagttttttggatcaaaaaaagtccccgatctcatataagatcagggacgaatattccgcggtaccaccttgaattgaaaatattgctattttccgctcttcgtcagtaacgcgacgatccgttcatttctgaaagttccgtaattgtaattcaatgcctacccacgtctagctcacagccccgctaaatttctggttgtcccgataaacttctactatattacgtcatcacttcaattgttgattgtattctagcgtgcccacaccgaattgtcaatttttattctattatcttatgccttgttgatccaaaaatggttaagcatattcctggttcaagtccgcaatctcatgaacgtacttctttgcaataatgacccgaccattgaactcattgattcgcatcaagctagcgcgatccgcctcttgaatactggccatatctaattcaatcaaataggtgttttgatattccttggttaccttccccgtgaaccctcgtttaatcatcggacagccgctactcgaaactaaaaagcgttgatagttacagtcatcgtttttccacatattggttctcctccccactgattatgaaatcttatgttttctataagttagatattaaactttaaatgtgaagaatttgtgaagaatattaggagaaaataataataatgattacgcttacattttgatttaaagttcctctccgattgcaagaataaaatcaaggcttaacttccctgtcaaattcccgtacaataagacagacaaaataattgagaggtgttcccatgtatcaaaataaagtttatctcgctagtccgttcttttcagacgaacaaaagaaacgcatcgatgtggtgatggatgcactcaagcataatccaacgatcgatgcagaagaaatctataatccccaagaacaccaagaagaaaagcttcccttcggttcacgcgattggcaagactcggtttacaacaccgatatgcgccaagttaaacgcgccgatgtagttgttgcgattctcgactataagtacgaggaacaaaacatggaacccgatgcaggtacaatctttgaaatcggtgctgcctgggcttggcacatccccgtcatcatggttcagttcaaccctgaaaacgagctcaacctaatgttagcccggtcacacaccgccatgtttaccggtgacaagattcaggctggtttaagcagctacaatttcaacacactaccaaccgtttggactgatatgaaagtcttttaataataatttggtatacaaaaacaccgcccttattggacggtgttttttgtcatgatgattaatcttctgacgtttcagtttcctgaggttgttcgttaatttctggtagtggatcgaccagtttttcttcaggtaatagggtgtctgcatagacactttctaagttgatatgcttcttattagcttcaaagtaaacgggttccatcatcaacaatactggcaaataagcgcagattcctaagatcaagatgatgaccagaatgtacacaaccgccgttggcatcgtgaagctaccgtagttagagccaaagtagatgatcgcactccagatcgccgtccacaaaatgacagggacaacgcccgcaatcatcaagataatgtagttgatctttcgaccacccatgaaccgccgacttgcagttaacgcgtggcgcattgattgacctaaaaactctggttgtttctcacggtacaacaacaagccttgagaatattcaacgcccttccagatggcaatcacagcaccaactgctttcaagatcgccgcaacaatctggttactaccgaagaacccgtttaagatatctaccggtaactgccacaatgttgtgaataaccaaacccatagcgccaaccgaaccagttgccacttcttcaagcgtttaaactggctaaagatttgacgaatttgaatcttccgacttggatcacgaaccacgtcttgaaaattaaattgaatggccgtacggaagaagtagatgacaaagaacaaaataatgtaaagtactaacactagcagcacggttaacgcaccggtaattaatgaagtgattgtactcatcccgtacatcatcatgtaatacttcatcatcagtgagcgtagcaacatgtaacctaccacgcctagtccaagaataatagcaactgaaataacgaatagtcccacaagcgcacctaccgcactcttgtagtttggttttaaggccttcttaatctcagcaaaaaactgttttattgataaattgctttctttcatttctccacctatccggggattgccccctaaatttagtaaatcataatcaccgtatgttcgattgtatcataaacttctttttaactggtagtttacggtcataattcaataattcattactttttagtcatattttgttcatgatgtctggcaaggcacgtaaaaaggccccgctttcgcgaggccgcaatcctattcaaatagctgatcagggataaacaagtcgcccaacgttgcggccataattgctttgatcgcatgcatccggttttcagcctcgtcaaagaccaccgagtgggggccattaaacacatcatctgtaatttcgatggcggccatctggaattgttccccgagtgccttgccgacctctgtcaaatgatcgtggtaagccggcaaacagtgcatgatgatcgtactatctttaccagtttgatccagcaatgcctgattgatctggtagggtttcagcaggttaatccggtcagccggatcgacgtcttctcccattgaaatccacacatccgtgtaaagtgcatccgccccttgcacagcctcggttgggtcttcggtcagtaacacatgactgccactcttttgagccgcctcctgtgccagcttcaccaccgagtcggccggccagagcgctttaggggcaccaatgtgaatgttaacgcccagtttagcggccgttaccaacagtgaattgcccatattgttgcggccatcgccaagataggtcaacgttagcccatttaaatgaccaaaattttccttcaatgtcaaaaagtccgcaatcatttgtgtgggatgccactcgttggttagcccattccagacgggcacgccactatattgtgccagttgttctaccgtttcttgagcaaacccccggtattcaatgccatcaaacatccggcccagtaccttggcggtgtcgatggtcgactccttcttgccaaactgaatatcatttttacccaaaaattcgggatgggcaccaagatcaatggacgccactgtaaatgatgaccgggtccgagttgacgttttttcaaacaacagtgcaatatttttgccctgtaaatagggatgcgggatattgtgatgcttgagatatttcaggtgcgcggcaaagtcgatcaaataggttaactcactggatgaaaagtcaatttcctttaaaaaggatttattttgaaaatgattcatggtttattcctccccgatggtggtcagtacggtcttaatttgtgccaatccagccagtaaatcggccgaactcataactaatggtggtagtaatcgcagcgtattgtgcttggcagacaacgtcagtattcccgcctgttgcagctgatcaatcacttggttcacatcgaccgtggtcgctaattgaataccgatcatcagtcccttaccagaaattcccgccaccgcagctaacggggcaatttcagtttgcaacacttgccagaccggaacactttttgcctggacttcgtgtaaaaaggttggtgttaattgcgccaagactcccttggcggaagccaatgcgagtttgttcccgccaaaggtggtgccgtgggtacccggtccaaatgctggggccaatgcttgcttaccgatcatcgctccgagcggcaacccattaccaattcccttggctaccgtcacaatatctggatccaaatcaaagttttgataggcaaacttctgaccggttcggcccatgccagtttggacctcatcaataatcagtaacgcccccgcagcatgacaggcggtctgaacatcatgaagccagtgtggctcaccattgaccaccccaccttcgccctggataacttcaagaatgacagcggcggtttgctgatcaatggccgtaatggctgctggatcgttgtagtcggcaaacttaatggccggtaccaatggtgcaaatccggcctgaatatcggggttaccggtcagcgacatcgccccgtatgtccgcccatgaaagctattattgaaactcaaaacagttggtttaccggtggccttacgggctaattttagtgccgcctcgttagcttcggtacctgaattacagaaaaatgcgagcatttccggttcgcatagtgctcccgcaacctcatccaccaacgcgctctcgtacaagtttgaagtatgccaaatttgaccaagctgctcggagacgttttgcacgatcgtttcattactatagccaaaattgcagaccccgattccgctcgtgaaatctaaatatgtatgtccctgacgatccgtcaggtgccaatcatggcctgcgacaatatcgattggatactgctgataagttggaaaaatattttgcatgctaaattacctccatgaattaacctgcgacccgcttggttgaccgatgtaaaatcgtgcccgaactggtcagatcatttgtgatcaacacttgatggaccccatcatgtaacgcattaaaagcggccctaattttaggcatcatgcccgctttaatttgtttttgctcaaatagttgatctgcgccctcctgatccagtagtggcacgaccttgcccgcattgaggacccccggaacatctgtgagtagtaccagcttatttgcccccagcttagccgcaattgcggcggccgccgtatccgcgttgacgtttagtaaatgcccatcaatagtctgggccagtggtgccaataccccgatttcatcatgtaagacttcttgcaaccaggtttcattgacgctggtaatctggccaacttcaccatattccttttgatctaggtattctccacccagcagttgattatcactggtgttcaatccgacaacgtgcagatgatgctgactaaactgctggcaaattgcgggttgcacgatgccgaggagtaccgcttgagtcacggcgagcgtcttggcatcggtcacccgaataccatgatgcttgtggaccgttagccccatctgatccgaccaacgactaatttgtggtccgccaccatgaatcaccagaatgtgtttgccttcggcttgccagcgcgttaactgctgataaaactgttgcggcaactgatcactggcatgaccaccgaccttaattacaattgtttctgccatcgtcatccacactccctcttaactatggtaggcggcattgatcttgacgtattggtacgtcaaatcacacccccaggcctgtcctgtgccctcaccgctattcaaatcaactttgattttgacgactgattctcccaagctagccttcatttcggctgcatcaaataatgccgcctgactgttcttaacaatgagcagaccgttaaaccaaattgacacatgatcaacatcgacgtgtgcgtcggtctgcccgattgcgcccatcagtcggccccagttcggatcctcaccaaaaatggccgctttcacgaggttagatccgacaattgccttcgcgaccatctgggcctcatcatggttaagtgcaccaatcacatctgtttcaacaagtttcgacgccccttcgccatcctgcgcgattgactgcgccaagaagctcaacacctgatgaaaagcagcgacaaacgtgtcatagtcctcttgatctggcgttagagtctggttattcgccatcccgtttgccagggccacgaccatatcgtttgtggatgtatcaccgtccaccgtgatctggttaaaggtttcgtccacttcttgactcaacagcttctgcaactgatccccggcgatctgagcatcggtggttacaaaaccaagcatcgtcgccatattaggatgaatcatccccgacccctttgcaaaaccgctcattgtcacagtctgcccatccagttcaaattggatactgatcgtcttgggatgcaggtcggtagttaaaatggccgtcgttaccgcatcgtttttagtcaattgtaagtgatctaatccagcttcgataacgcccatcggaagttgctcaccgataattccggttgaggcgacccccacaagttctggtgcaattccgagcttttgtgccgtccaagcctgcatcaatgcggcattttgagtaccttgaacacccgtgcaagaattcgcattcgcactgttcatgatcatggcctgtaagtgatgggttgcctcaatcgtttgtttggtcagcttagtgggagcggcctgaaactggttggtcgtataaacgcccgccgcggcagccggaacctctgaataaagccagcccatatcctttttgccttctctaagtcccgcattaagtccgtcgctataaaagccctgtggccaagtataggttgctaatgtcgttatgtttttagtcgttgtcactgtcattttcaagtccccttctttatggtaataagacatccgttggtaacccgtccgcttcatcaaacccattcatttgattaaagttttgaattgcttggccaccggcacccttgacgagattatcaatgacgctcgccaccataatggtatgcgttgtctcgttatatataacccctaagtcacagtagttagttcccacaacctgcttaattgtcggcatttgctgcccagtatagcggacaaatggctggttagcgtacgtcgtttgaaacgcgtgatcaaccatcgtcgccgtcgtcgtgggggtcgccttaacgtaaatcgtggctaaaatgccccgggtgattggcaatagcgtggtactaaattggatggcactcaccgtcgaatcccactgctggagttgctgcacgatttcaggaatgtgcttatgttcgttcaccttataaagttgcaggttatcatttacctgtgtgaagtgggccattgccgatggcgtcttaccagcaccagacgtgcccgacttagcatcgacgataatcgaatcgacatcgaccaaatggtcttggatcaagggagccaatcccagcagcgttgcggtcgcatagcaaccaggattagcaatgtaggattggtgtcgcgcatcattgaattcagctagtccgtaatgggccatctgtaaatccgccaactttgcagctggcttgtgataccacttttcataggttgccggctgttttaagcggtagtctcccgatagatcaatgaccggaaaatggtgtgcaatgaacggcgccgctaattgtgaagtgactccggccgaagtggcaaaaaagaccgcatcgttatgggccataatttggctactatcatatggaagaacttggtgcgtgtgatcgccaacgaataaggggaccacctgtgataagggagtcggtaccgtttgttgatgaccgtataattcaatttgagtgacctgtgaatggtgctgtagcatttgatagagcaccataccaccgtagccagaaatcccgactagtgcaattttcatcttcatcatctctctatatgcatttcgtgaatctttattaattggtatcagattacaatgaatgtttagaaaaagcaagttgttttttatttttattcattaatattcgatatatactatattttattcatttatcgctaactttttccatattttatgaagtttagtattgactattcattcaataaacagttaatatagtgacaaataattcgaataaacatacggagggataccgaataatgaaaaaatacctcacattatcagatggcaccacttttgaaggacttgcttttggcgatcacaacgccctcgcggctggcgaagtcgtatttaacactggcatgaccggttatcaagaagcaatcacagacccttcttataccaatcaactgctgacatttacttaccccctcattggaacctatgggatcttcaaaaaccaaaatcaaagttctcagtctacctgtcaggctgttttagtgcggcacctcgaaaatgaaatcggagacgccaacctatcattagatgcttggttaaaagatctgcacatccccggaatgagcaatctggatacacgggccctcaccaagcatattcgccagcatgggacccttaaggcgatcatcgccaacgaaccactgaccgtggccgatttcaacaccctttatcccacgctcagcaatgaactcagtaaaaagcctcagcttcagcatcaaacttacctcgcactgcatgctgactaccatgttgttgtcatcgactttggcatcaagcagggcatcattagtgaactgctggcggccaattgcgacgtgaccgtgctcccttacacaacgagtctggctgacattaagcaggcccatcccgacggcattctgatttcaaacggccctgacgaccccagcgtctacaccgactacttaccccttatccagcaactggaggcctgctatccagtggccggcatttgccttggtcaccagcttctcgcccttgccaacggggccaagacttaccaactaccgtttggtcaccggggtctcaaccatcccgttaaactgttaacgagtaaccacaccattatgaccagccaaaatcacggctacgctgtcgatcccgcatcactgaaggataccgatctcgtcgtgaccgcagttgagggtgacgatcacaccatcgaaggattggccatgcaacacatgcccgtcatcagcgtccagtttcatccggaagctaatcccggtccccttgatgccactaatttcttccaccaattcaaacaattaatgcacaaagaggtgaaattgcatgcctaaagaccacaccattcataaaattgccgtcatcggttccggccccattgtcatcgggcaagccgctgaatttgattacgctggtagtcaggcctgcattagtctgcgtgaagaaggttacgaggtcgtcttgatcaactccaatccagcgaccattatgactgacgatgaaattgccgatcaggtttacttggaacccctgaccctggaatccgtcagtgcgattttagccaaggaacgccccgacgccctgcttccaacattgggcggtcaaaccgggttaaaccttgccgtggaactcaacgatgccggtgttttagatcagtaccacatccagctactggggaccggccttgcgaccatcgaacaggctgaagatcgcgaaaagtttaagcaactcatgcaagacattcaccaacccattccagccagtctcacggtgcactcactcgcaagcgccctccaatttgctgatcaaatcggctatccggtcatcgtgcgcccagcctacaccctcggtggaacgggcggtggaattgcagctacccccgcggaactgactaaaattgccacccgcgggctcgcaatgtctcccgtgaccgaatgtctgatcgaaaaaagtatcgctggcttcaaggaaatcgagttcgaagtcatgcgggatgcaagcggcgacaagattagcgtctgctgcatggaaaacttcgaccccgtcggcatccacacgggggattcaatcgtggtcgcccccagccaatcactcaacgatcagcagtttcagcgtctccgttacgcttcactcgccattgttgacgcgcttcaaatcaaggggggctgtaacgttcaactcgcacaagatccgcatagcgaccaatactacgttatcgaagttaacccccgggtgagtcgctcttcagccctcgcctcaaaagccaccggctacccgatcgccaaaattacggccaaaatcgcaattggactcaccctcagtgagatcacaaaccccgtgaccgaaagcacctacgccgcctttgaacccgcgctagactacgtggtcgccaaaattccgcggttaccgttcgataaattcaccggtgccaaccgagaattaggcactcaaatgaaggctaccggtgaagtcatgggaattgggctcaccctggaagaagccctcctcaaggccgttagttccttagaaatcgaaccgcaagtccaagcaacgcttctcccgctcaacgtgcaaaccgatacggaactcacaacggcattgcaacacccaaccgaccagcgtcttttcgaactatttgccgcccttgatcgtggttggactatcgacaagatcgcagcactcacccaaatcactcccatttttctccacaagctgaatcatatctggcaactcaagcagcaactccgtcagggactaacacccgaccgtttggccactgcgaaacagttcggttttagtaacgacaacatcgctgcagctacgggacaaccaatcgccgcgattgaagcgcaattaaccaaggctcagttgacgccggtttataaaatggtagatacctgtgctggtgaatttgcgagcgaaaccccttatttttacagtagtttctttccgggcgagaatgaaagccaaccgttgggtaacagcatcatcgtgctgggatccggtccaattcgaatcgggcaaggcgtggaatttgactacaccaccgtgcactgcgtccaggcgattcaagcggcggggtaccacgccatcatcattaacaataatccggaaaccgtctcaactgacttttcaatttcagacaaactgtacttcgaaccgctcaccatcgagagtgtcatgcacatcgttgacctcgaacacccgctgggcgtgatcgttcaatttggggggcaaacggcgatcaacctaacgcaggccctcgtcgatcacggtgtccacatcatgggcacctcgttagccggcatcacccaaacggaagatcggcaccaatttgaagaacttctgaaaacccagcagattgcccagcctgctggtgccaccgccatgaatcttgcgcaagcccagcagatcgcgcctcagatcggctatccagttatggtgcgcccgagctttgtccttggcggacgcgccatggctgttgtccatgacgaaaccgagctcgcaacctacgttgccaaagccatgcaggccgcaccgcatcaacccattttaatcgaccactatgtcgccggtatcgagtgtgaagcagatattctcagcgacggccacaacgttttcatccccggaatcatggaacatttagaaggttctgggattcactccggtgattcaattgccgtgtacccgacccagcgactcacccagactcaaaaagacgccatcattgcgaccgcgattaaaattggtcaacaggtgcactgtgtgggcatgatgaacattcaatttatcgttagtgaccaagtttacgtcattgaagtcaatccgcgggctagccggacagtcccgttcatgagtaaagtgaccggccaacacctcgccaagattgccactaatttaattttgggtcagtcattgaccgaccttcacattcagcctggttatgcgccagaacccgatcacgtggccgtcaaggcgcccgtcttctccttcactaagctggcgggaatggcttgttcgctatctcccgaaatgaaatcaacgggtgaaacgatcggaattgcgcccacctaccaagaggcgctggctaaatcgttggatgacagttaccatcttaagcccgtccaagacggtcaagttgcgattctcgatgaaactgctgggcaggatcactcattgcgcaccatgcttgatcaaaccggtgttgagacgctagtcgctcccagcgctgaacagctcgcacaattaaggcccgcaaatgtctggctagtcgttaataacgcccccgagcaaaccacggctacaccactgaactactttgccctcagtagcgaaatcccgttcttcagtgcgactgaaacgctcaaagggattctagctgccctaaacgttcccaccgcctagcaaaaaagcttggaaaacacatcgttttccaagcttttcttattttattatgttcttgattgactccataatcggcaactagacctgactaaagaccttcttttccagccgataggttgtatcacacatttcggccaccgcagattcatgggtcacaatgatgacacacttgccctgttcatgtgcaattttttgaaagagtcccacgacctcaaccgtgttattctcatctaggttaccggtgggttcatcggcaacaaccagttgggcatcgcatgccattgttcgtgcgattgcgacccgttgttgttgcccgccggagaggtgttgcacatttttacgcatcagatcttcggtgattccgagcttcttgagcatcgtcgccgcaaactccttatcgccggcatgttgggaacccgtaatcgccattgctgtcagtaggttatctaatggtgacatgtacgtaaataggttataggactgaaacaccactgaaacgtctcttttacgatagtttgtcatgccaatttttttaatatcctgaccttcgtacagaatttgtcccgccttaggttgatcgaggcccgctagtagggacagaaacgtcgtcttgccagagccactttgcccaacaattgcgtaggattggccggcttcaaacgtcagattgacatctttgaataaataatcgtcttgatgggtgtaccagtacccaatatttttggcttctaacatgttaggccctccttttatgactcgatgagtactttcttcggttgcaggcgtaaaataccacctgaagccagcatcgttgacaagaagataatggctaatccaaagccacctaattccaccattgtcagtgcggtgacgttaatgtccagatccgtgtccgcgctggcactcgtcgtaccagtttgaccgcccatactgctatgaactgccatgccaccgccttgaccgccgccactcggtgcaccaccgcttggacgactaccgccacccatattaccgccgttggaatcaccgggagccgaaatggttgctgatgatgactgggtctgctgtgacattaattcactgcccagcttatcgccgacaaatttaccaccaatgccagctaagcacagcgataccacaagaaccatcaccagttccgcaaagaactgaccgacaatcttccatcgtgcttcacccattgatagtaaaataccaatttcgtgacgccgttcgcgaatcattaagataacgatcaatgccagaataatggttccagcaatcgccacgagccatacaatcttatcggcaaaggatttgatgttgttcattgacgatttcaccgcttggtaactgctatcgttagttgcaagtgagtacttgctggtattgatcaatttcttgcccgccgccttaacactgttgaccttcgacgggttagaaatggtaaatgtgaccgaatcggcagtgcccgcatacttgctgcccttaaccgtattcgctaacgtgtatgacgaatagattgtgttggcgggatcacttgcaccaggacccatttgggttgaagaactcgatgttgatttataaattccgacgatcttcaacttgtaagtcttaccgctcttcttcacggtgatggtatctccaacgctcaagctatcttccttagctaattcagattccaccacaacgttgttcgtgttcttatcagaactggttagaccacggccctttgtaatcttgttcgtgccatccgtaaagctggtcgattggctggtgttagtcaccccagaaagggagatatcacccgaactactacttgaagcgccccctggcattgtgcttgatgagctggacgtcgaaatcgcgtcaaaactcttggcgttaaccgaggctgaaaccgtcgcattataactcgccacgttagccaatttagcaatcttcttggcatcactcagcttaaccgacgacatcttcaacttcggtttagatgatgatgagctggacgcccgcatcttcttgaacgccgacgaccgattagccgacaaggtaagtgtcgcgccgacactttttttggcattggcagtcgcctgatcagccgccgtatggattagcatccctgctaaaacaaacaacattatggcggtcgtgactaacacaagtagtaccgaccgtcccttcttagctgataggctgagccaggcccgttttaaaaaattcataatggccctccttaaaaaaatagtattaataattgatgtttattactttagctaataatcgtgactaaattatgaatttcacttgatctattatgtatcatttctaggagtttaatattatagtctaaatcaatgacatcccgatattgagaattatctgctcatcatttcgccgtctcttgcggctaatacggcattttttcaaaaaacaccgtcggcttcactatatcaatcgtcaacagttcaaaattaatttctccaatttaaccaaataacctgtaatttctaacaaattcaagctatattattagtagtaatatgtttcgctaaattttgaaaagtagggagtcgttaacgtgtcaatttcaaaagatgtactgaaagttcagccttccgccactctggcaatgtctgccaaaactaaagccttgatcgccaagggtgtcgacgtcatcaacctgtcaatcggggaacccgatttcaccaccccagaaccaatcaaacgggcggcaattgatgcgattgaatctggtaaagccagtttctacactcctgctggtggtctaccagaattaaagcaggccatctgcgaccgtattcaactcgaagacggtgttacttacactccagatcaagtgattgtgacggacggggccaagttttcactatttctaatcttccaagtgattctcaatgctggtgaagatgtcttgcttcccgaaccattctgggtcagctacgccgaacaagttcatctggccggtggcaacgccattgctgtaccaacgactggcaaggatcacaaagttacggttgctgatttggaagctgcaatcacccccactacccaagcgttggtcattaattcaccacaaaatccatctggcttaatttacgaagccgctgaattaaaagccatcggtgattgggcagtggcccatgatattaccatcattgctgacgatatttatagtaatctgatcttcaacggtcacgagtttacttcaatcgtcacccttggcgaagcaatcaagcaacacacgctcctagtttcaggcgtttcaaaaacctactcaatgaccggctggcgaattggttacgttctcggcgatgccaagaccatcaagatcatgaataccgttgcgagtcacgcaactggtaatccggccgctgtcagccaatacgccgcaattgccgccttaaccggcgatcaaaaagaagcgcaagcaatgcgtgccgcattcgaagaccgactcaacacgatttatcccaaaattgcagcgcttcccggttttgatctccccacgaaaccacaaggggccttctaccttttccccaatgtgaaaaaggccgttcaactttgtggattcgcctcgacagaggactttgtggaagccctcttgacgcaagcccacgtcgcagtggtcagcggcaaggccttcagccagcccgatcatatccggctcagctacgcaaacagcaaagaaaatctattaaaggcatacgaacggattaatcaatttatgcaagatcatatgcaataatgcgcaccaaaaaaccaggactgatttttctcagtcctggtttttataatcattagcgtaaaacgtcaaaatccgttgaaaggtcataatgtcgtcgtacgtaaacttcatcgataatcgttcattttctttcagcatatactgagacacaacgttttccaatttaatggcatcgggcagcaactgaacctgcttttgacgggcgtcatctttgagcacctgccgaacaattaactgctttttttccattcgttgtaacattgtcgtcgcagtcgaacgctgaatattaaattcatgttcaatatctcgttgtgttacgactcggccctcatgacggccgataaaatcaataatcgccatctgcatactggttaaaccatactgctgggcaaactgatcaaaatttcggttcaactgatttgccgctttttttaacaaccgcccattgtcttgggtcatgtcgccatctccaatcgttagttaactagcggtagccactatagcatagtttgctgcgcacccgcaagtaacttatcgattggattttgctaatctagcggtcccttgcctaaaaaggcggaaaccatccaaatgttcttatcaatctcactcttaaatccatttagcatatcttgggtcggaaaatcacgttcttcatcagccgcatccattcccaactgatactgaccagccagatacttaaactggtcatctaggcgatgcatatagtccggtaactcgtattgctgccaagtcaccttttcgtctggtaatccggtatgatcgataaactcgtgagtggtcgcgtatggtgagccacccagcgcaattaaccgttccgccacttcatctaactgatccgctaaggtatcattaaaatcatccatcttggggtgcaacttaaaaaattctgggccccgcatataccagtgaatttgctgaatattggtctgtaactgacttaaatcggcaatcaattgattcagttgggccattgttttgggatatttaacttcggtcatgtctgaactcctctcaaatcctagcagctaatcaactataaatctagcttatctgaaagggcttcctttcgcaaatcatttgcatacaaaaagtagtgcccagcgcaattggacactacttttttcagtcaaattattaattaaacgtacttaatcccaccgtcaaccatgatggcttgaccggtgatatagtcagctttgtcactagccaagaatgatactaagttggcaacatcggctggttgctcgccacgaccaagggcaatgccagaaaggtattgcttgattgattcgcccgctggtaccccgtgcaattcacccatttcggcatcaatttgatcccacattggtgtcaatacgattcctgggcagtaggcgttaaccgtgatcttatcttgagccaattctttggctgcagcctgtgtaatgccacgaatggcaaacttagtggctgagtaagctcctaataattcgaatccttcatgtcccgcaattgaagaggcattgataatcttccctgaagtcccctgcttcttaaactgtgtggcagcggcctgaatgccgaataccgttcccttaacgttgatgtttaatagacgatctaggtcttcttcttcggtattaattacctgtgcaacgtgtgcaatccccgcgttgtttacaaatacgtccaagtggcctaattgtgcaacagtttgtgcaacactgtcgaaaacttcttgcttactttgcacatctgccttgatggcaatggccttgccaccggcttcgttaatatcatttgcgacacgttgaactttattcaaatgacgtccagctaaggcaacttgaaagccatcattagctagttgtttcgcgattccttcaccgattccttgaccggcaccagtaattaatgcaaccttttctgtcattaaaactaccccttcttgtgaattattattcagatttgttaaagttattatgacacttagttgcacataaataaagtataatatgcaaaaaatttcatttcttttttttgatttgcttctgcgtcaccgacccttataatagaaactaacaattctacttttaacgggagggccaacatgaaaattacgataattcaacacgtcgcgtttgaaaccccgggactgatcaacgaatggattcgcgcccacgggtatcactccgacctcattcaaactttcaacggtgattcactaccaagtgccgatgatattgaatttctagttgtcctcggtggccccatgagtgtccacgacgaccatgcctggctcaaggaagaacgacgactaatccgaaccgtggtcacccgtaatctaccgatgttaggaatttgcctcggcgctcaacaactggccatgacatttggtgctcaggttactcccagtccgattgaagttggttggggccccgtcgcaagttcccagacgacccgccaacttcttaaaaaatttccccgtcagttcaccgcccttcattggcatggtgagggttttgaaatgccactccagtcgataccactcttttcgtcaccaacgtggaccaaccaaggattccaatttttgaacgcaattggccttcaattccatctggaaacgacaccaacgacactactttcattggttggtgaagaccgcgaattcatcaaacaatcgatctttgataccagtgtggatcaggtcatcaaccatccattagaccctcacaatcaagatttattgttccaaattctcgattatttgactgttgctgctaattaggtcgaaactaattgcaaaatttcaatcaccatagttccagtttaatgtgcttttcgagttaaaaatattcttaaataccctaaattcacaaaaaatgttcaaagccgtgaaatttcatccagctttgaacattttttagttacgcggtgattcttattctatttattttaattttgttcatctaagtctgttagcttgtcataattatccttcatagcatttaataaatgtttaattaagattctagaagttgcaatatttaaccgaataaatccatcaccgtattttccaaaggcggttcccatatacacttcggcaccgactttgttcaaaaaccaattctctacaaattcagaagggagtttcaacgcagaatagtcaatccacaatgtatatgttccttgacgtggatacacaacaaattttggacaattttccatcaaaaaatctgttactactttttcattgttatcaatatagtcatttacacttttcagccaatcatcacattccctgtatcctgcactaaacgccggtagtgaaaaaatattaggattatgaattcccatcttaaaaaactctttttgaatttttgtacgaatatctttatttggcacaatcaaatatgaaatctctaagcctggtatgttgtaggtcttagtcaatgaattagcaaccacaatacggtcatattcatcaactttttcaattaaactatgatgtaaaattccatttttaagtaaatcagcgtgaatctcatcagtaaatattgttatttgatgtttagaaataatactcattaactcagttatatcatcttctccccagactgtaccagttgggttatctgggttcacaaaaaacatggcagtgttgctagaagcaattgcagcttcattaatttcatcatagttcatgtgccatgcaccgtctgtaaattgagttcttgccgctaccggtttacgattatttgttgaaattgcatcctttaaaggtgaataacatggttcattaataattacaccttcaccaggttttgtactaccatttataaatgccgtggcagaattaataactctaggtgaatacacaatccaagctttcggaatcacaattccatattttttctgataatgttcttgaataacttcgtaaaactcgtcattcacatcggtataaccatatacaccgtgattaacgacattttgcaatgcttgttgtatcggctccggcgaaacaaagtccatatcagcaacaccaaagtgtagaaggtgatcattatgatatacctttgcctgagtatcccatttagcacaatttgtaccacgtcgattaactatcttatcaaaattatagttcattttcatatccccccagatacattatgcttgagtagagttttgtacagttgctttgacatcatactttccatcaccagtattccgttgaacatattcgtcgtagaaacgactctttttagtgatctttgcaaccccaatacccgtaaatgcatatagaagggcaaaaaatgtaccagaataacaaagaatagcccaaggcaaatagctaagtgttggcactccaagtgttgtagccatgtaaacaccagctgccgtccatggaacaattggttcaaccatcgttccagcatcttcaacagtccgtgaaagatttttaggttccaatccatatttcacaaaggtatctcggaacatctctcctggcaacaattctgatagctgaccattggaagttacaaaagtaacaagaatcgttgagaatacagcagtagcaatcaactgtcccgctgaacgaatagcttttgtcatctgattaagcacaacagttaaggaattacttacatccatggcaccagcaaaaccatatgcacataaagcaattaatacaacactcaacattgaaatcatcccaccgcgctctaacaaagttgccaaagaggcagttaaatgaactcctttaggaagcatatccacagtaaaaccactcacagctgcagtacaagcatctttaatattaaaatgttgaataacaactgcattaaaaattgccagagtacttgaaaacaacataaccggaattgttggtttttgaagtgccgatccaaccaatacaattacaatcggtaataaaatcataatattcatactaaacaatttttcaattgaattttcaactaacaaaatattatgactattggtcccggatgcaacatttaaatttaaaccaacgatggtatatacaacaagacagataaacacaccaggtagtgtggtccaaagaagatgttttatgtgctcatacaattcagagccagctgcaattggagctaaattggtagaaccagacaacggtgataacttatcaccaaagtatgcaccagaaactacagcaccaccaacaatagctaatggtgcatgcatactagcggcaactcccataattgcaacgccaatagtccccgtggaaccccatgacgtaccagtacataacgaaacaaacgatgtcacaacaaacgcagtcacaataatgaatgatgggctaattagtttaagaccgtaataaatcatcataggaattgtaccgccaatcatccaagtaccaattaaaaaaccaacaacaatcaaaattaagatagcaggcatagtttttgcaattttatccacaatgttatcttgaatctcatcccagctgtaaccaagaaaataggcaataattgcggcaattgcagctgaaacaagcattaacacttcaggtccaatatggaaaaagccatagcctaaaccaagtaagagaatcattgcaataatcggaataactgcaacaataaaagacggttgtttcttctcacgaatttttttctttttagccataatcacgttcccctttagtcaatgtatagcttcataactcagctgtggcttcaatttcaactaatgcatgcataggtaattgagaaatttgaattgctgttcttgcaggatacggtgcatttaattcttcttcaaacgctttgttaacgcttacaaaatcatctaaattggtcatataaacagttaactttaatatcttagaaaaatctatactttctgtttccaaaatcaccttgatattcttcagactttgcttagcctgtaggtatgttgtatctccttcaagcctatttgtttcgggatctaagggtagctggcctgacgtaatcagtaaatcacctgattttcgataagcagaatatggtccaatagcagatggaatttttgtcattttagtgctcctttcttttttcaaggacagcataacaataaaaaaagtcatgtcaataattttttatcataaaaataaattattgttatctgaacgaatttagtttaaaatatgcctatatcaaaatcgcgaccaaattctactatggagggccataaatgaatgaattaaaaaaatataagaaactcactacttttcttggacaagttttaggtgaaaattatgaagtagttctacactggaaagacgaaaacaactcattttacattgccgcaattgaaaattcagttgttagtggacgaactattaattctcctatcacggatcttgcactcaaattagtacaagaaaaagtgtatgaggaaaaagattacgttgcacattacgtagcaaaggccaaatcaaatcataaagtcaaaggatccacatactttataaaaaatgacaaacaagaattacttggtctactctgcatcaattttgatactgaccggtatgtaaaactggctgataatattttagctttaactggtttaaatgttgacacatccaatactctcttaactgaagaagataaaaccaacactattcaacaagattcttctatttctattcagcccgaggaaatacttcattctgatgttgatgaaataattagttccagcatcgatccacaattgttgcagccaggtgtttctatgacgcccgaaacaaaaacaaaaattgtgcaagaattacaagataaaggcgtttttcaaatcaaaggcgtcatgccacatgtcgcaaaaattatgggtatttctgaaccaagtgtttatcgataccttcgtaaaatcaatgactaactaacttctataaattagtagttactatcttctccttaacttattaaaaggccgccatctccccgatgacggccttttagattggtgcaattaaactttttcaactacttttttagaatatgtttgttgctcgtcagctgttttgcgatcttggggtgccggacgcatctgttgtaacttacgatagcttctcagactaccaaaaataaataccaaaattccaaaccagatgaacgcaaacacgactgccttatgccagctgaaggcttcatgtaatacaaataccgccatcaataattgaatggtggggttcaaatactggatgaatcccagagtaataaaatccgtatttttagtggctactgcaaacagaagcagtggaattaccgtgatcacaccacttaaaatcaacagcagtgtaatatgcggtccgttttgagtcattacatgcggtgacagtagcagatagacgaccgcaatcggggccacaaacaaggtctccaaggttaacgaaatcgtggccggtaactgaacctgctttttgatcagaccgtaaaagcaaaacgagcccgccatcaatagcgtgttcaacggcaacgaccccgtttgaaccgtcaaaatcaccacgccaataatgacaaagaaaatcgcaatcagtttcgttcgcgacaactgctcgtgtaaaaagaggatggcgacggcgacgttcatcagtggcataatgtaataccctaaactcgcttccgttgcttgatgatgccccaccatgtaaatgtagatcagccagttcaccgaaattagcagggaactgagtacaatccacccaattttccgatttttagtcaacgtcacaatcgtttgccaaaccacacaccagctacgttgtaccgtcagaacaatcccaattgtcacgagtgaccacacaattcgatacgccaacgtatccatagccggtaccgcgtgtaacagttcccagaaaactcccagcatcccccacaaaatataggctgccaatcccgtgctcacacctaatcgtttattctccatacacattctctcctacctgtaagtattcctaatagcgtactccagcttggaataactttcaatggtagagcgtcccgtcacggcatcaaaattggttgaccaactggccacccatcgaatcggctattgatttcgtcgaaccagcctacctaaccctccaagcggggccatctctgactcgactaaatccctatttcaaatttaataccgttaacttttcacgcgacatcgataaaatactgttgtgcaccccttgggttcccatccccgaagccttgacgcctaagaatggaaaattatctggtccccgcgatgggcgcccattgacttgaacggtccccgcttcgacaccccgtgaaatctcaagggcctcatcgatatcctgcgtaaagacgctggcctgtagaccgaaatctgaccggttcgctagatcaatcgcctgcgcattggacgtgacccggataattggcaacactggaccaaagggctcgacccatgcaatatccatctccggcgttacgttatccaatagtgttggtgccaacaaattaccgtctcgttgattaccagtaaccagtgtggcccccttggccagcgcgtcatcaatcaggccttggacaaaatctgccgccttgtcatcgattaatgggaccacatcactgccttcagccggtgacccaacttttaggacttctactgcaggttttagtttggcgaccaattcatcggccaccgcctcgttgaccagtacccgtttcaccgccgtacatcgttgaccagaataggcaaaggcgccaccaataatatttttggcagtgcggtccaaatcggcgttctggcacacaattgccggatccttaccaccgagttccaaaactagtggaatcatgatcgacttctgtgagaggtgctttcccgtttgggtgctccctgtgaaactaatcatgttaatgccgggatgttccgtgaggtaatctccgataatagcgccgcgacccgttaacaggcttaagacaccggctggaaagcctgcgcgatcaaacgcctgaatcattttaataccacaaatggatccttgggtggctggtttgaagatcaccgtattacccgccatcaacgcgggcgcaatttttgccgccgagagattaatcgggtaattaaatggcgaaattgctaacaccgtcccgagtgggacccgggtaataatcccgagcttatcttttgatccaccggggaaaccgtcgcctctcacactctgaccatgcatgtgtaaagcttcttggacggtgtaatgaattaaatctaccgttcgcaaaacctcttttttagcatcttcgaaattcttaccgacttcatccattacggccatggcaagtgcattaacatcggcttcgatttcatctgcccaccgatctaagtactgtccgcgctcattcattgataagttggcccacgatctctggacacggtgtgccgccgcaattgcctgatcaacttcgttttgcgtcacggactgtaccgaaccgatcacctcatgccgccatggtgatcgaatttcaatcgtttcttgagattcactctcctgccactgccctgcgaaatatgcctgataacttgttaaaacatccacgtcaaatccccctcgctcgtttgcttatgtattatcagtttatttgatagtcaataaacgttatttagtattctaattggccaatattcaaaagtaaagtctaattcttgtatattagtttcatatattatacttttatcttatttttgcacagttcatttgcatttgatgatattcatgcaaatggcagctaaaaagaaagcgtttcacttatgattaaaccagtaatcactgtgaaacgcttattttgtatttttttcaaacgtgcaaaaaattaatttttaactttttttgaggatgggtcgagacggtgttccaaaaagcctaatacaccgtcggcaataattgccattaaggctgtcggcaaggcgccggcgagaataatcgccccaccgtccgtcgcattggttccccgaatgataatatcacccagaccgccagcacccacgaacgagccaatcgccgtaatcccaattgccaggaccaaggcgtttcgtaagccagccatgatcaccgacatcgataagggcagttcgacgtagtaaagtcgctgccaagaggtcatcccaatgcccttccccgcatcgatcacgtccttattgacgttttgcatgcccgtgtaggtattcttcagaattggaagtagcgaataaagaaagaccgtcacaatcaccgtattgacccccaaaccgaggccgagcatcaaaatcgatagcatcgccaacgacggaattgtttgaataacgttcgctaatcccaccaccgtcgaacttagttttcgataccgtgaaataaatattccgaggggaatcccaacaattgccgctaacaagaccccgtagatcgagatcaaaaagtgccggccaaactgttgcaagacgtacatgccattttgcataaagtacgtgattaattgctgccataaattcattccagccattagtttgaccccccttcaaaatagtgatgcgtcttcaaaaacttcgctgccacaacatccggctcttccaaatcattatctacttggtaattgagcttttgcatcgtcttaactgaaattttgccggccagtttatttagcaccggttttaactctggatgcttcttcaaaatcgcctcggtcgccaccggtgacgcctcgtacggtgggaagtagtgtttgttatccttcaacatcttcaggttataactgctaattcgaccatccgtcgaatacccgagaacggcatccatcttgccagaagccaacgcatcgtaaacgagtccgatttgcatcgagtacagatggttaaacccaaacccgtagatttgcttgaaaccgtcatacccatcaccgcgtcgatcacgccaagcctggtcgatacctgctttcatttccgcagcgtgtgctttcatatccgatacattatttaagtggtactttttggccgtcttttgcgtaaccatccacgaataggtatccgcaaacccataggacttcagataaatgagatgatacttattcttaaacgtattcaccaccgtccgattatccttcgtcggattatggctggtagttttaccaagaatatcggacaaatccgtaccgttataacgaattgccgaaatatcagcatccccattacgaagggccgcaaaactaacattcgcagagcctaagttttgaataatggtcactttgagtggcgtataatgttcaatcatttgtttatcaatcgccgcgacaatttgttgttccgtcgtactttgcgccgcaattcgcaccgtgttactcgacgaattgcttagtccgggaaatccacaaccggctaacgtcagtgtgagtacccccacaaggctgagtaagaatgcccattttttctttttcatctgggacctccttacgcgcgtgccgtcttaggcgtcacaagctgttcaactttgcctaagaggtaatcggtgaccagtgccaatatgataaccggaatcgaaccacctaaaataagatcactacggtacaagttcaatccattaaagataaagtcccccagtccaccagcgccaatatacgatgccagtgcggcccaagcgatcacgaacgtggccgatagtcgaattcccgacataatgacgggcgccgccagtcgcaactcaacctgaaaaattgactggatattattcattccaatcccctttgccgcatctaaaacagccggattaacatttttgattccgagataagaatttcgcaaaatcgggaggagggaatagataaacagggccacgatggctggcaaattaccgattccaaaaattggaatcatcatggctagtaacgccatcgaaggaactgtttgaagcacacttgccagaccaatgacgaaaccggcaattttgtcaaaccgcgttaagacaacggctaacggaacggcaacgatgatccctaaccccagcgaaataaatgaaatatagatatgttgccaggttttctccaacaaatcaattccattagcttgcaggaaattaatcatctaatgccccctttgccggtgcaatcgtatccttcttttgctgggcggtaaccgcatttttcagttcaggaacggcatcatccccactatcctcttggccccacaacgcgtcatacaccatattcacgagggtggcccgggtcacaatcccgacgagcttccccgcttgattaatgaccggaatgtttcggtaacccaacttcaggattcggttcacggaatcacgaatgatcgagctttcatggacaaagtagatctcacgattcatgacttcactgaccggccgtttccggtgatatcccagatccagctgctcgatatcaagcacaccgacgagatgatcttcgtcatccgttactaggagcgtatcaactcgcttctcatgcatggtttgaagcgccctatgtaaggatgcattttcagaaatgctaatcggcgccttcagcataatttgaccaacggtcgtcacacttggccgcgcttgaatcaaccggtcctccccaatcaaatgcttcacgaagtcatttttaggatgctttaaaatattatctggggaatccatttgaacgattttaccttctgacatgattacgattttggttgctaatcgtaatgcctcatccatatcatgcgtcacaaaaataaacgtcttccctaaccgcttttgtaaatccaatacaagatcttgtagcgattcccgtgtgattggatcaagtgcgccaaacggttcatccatcaaaataatatcttgattagccgcaaacgcccgcacaactccgattcgttgttgctgcccaccagataattcagacggataacgatctaaaaattcagttggtagttgtgccaatttaattagtttttctgctcgctgggcccgcttttccttggaccacttgagtaatttaggaactaatgtgatgttgtcacggatggtcatatgcggcatcaacccaacattttgaatcacataacctaatttgcgacggagtttcaccggatccattttggtgacatcctcatcgttgagtaaaattttacccgacgtcggattaatcatccggttaatcatccgcagtgtcgtcgtctttcctgatccggaagtaccgataaagcagacaaagtcaccagcgttaatatccactgagacgtcttctacggctacttttccaccaggatattcttttcttaaatgttgtaatgatattagcaatgagtacctcctcttttaccaccatttctttcttatcgtatcgtacttgtgcacttcatttcaaatgatacacgtttttcatcatccattttgtcgcaaaaagagcacaaaaaaaacggaaaaacttcttttatctcaaagtttttccgtcaataaatcatcttacgatctaattaaataatcaaacgcactcagtgctgcactcgcacctgctccggtagcaatcacaatctgcttatacgctgaatcagtgcaatccccagctgcaaatacgcccgctaaattagtggcatttttggcatcaacaatgatttcatgatgctggttttgatcaatcgtcgctggtaaccactccgtattcggttggagaccgatctgaacgaatacaccatctaacgcgatttccttaatgacctgcgtggcacgatcttggtaggtcaagcccgttacccgaccatcaccggtaatggtctgtgtggcagcattcgtgattaaggtcacatttttcaattggcctgctttagcttggagcacttgatcggcccctaaccgtggtgcaaattcgagaaccgtgacgtgtcggcaaatcccagccaaatcaattgcggcttcgatacctgaattgccaccaccaattacggcaacgtccttgcccttatacagcggcccgtcacagtgtggacaataggcaacacccttattcttaaactctgcctcgccgggaaccccgattgtgcgccaacgggctccggtcgcaataatcgctgtcttcgtctgtagcctatcacctgacgccagtgtcacattgatctgttgagactgcttagcaatggccgtgacctgctggccttctagcacagccaccccgtattttttcacctgactggcgatggtggtcattaactgttcacctttaacatagtcgataccggcaatattttcaatccccagcgtatcaaggggctgaccaccgaaatgatccgtaacaattgctgtacgaattcccttccgtgccgcatagattgccgcacttccagcagctggtccacccccaataatcaatacgtcaaagagctggtttatccagtcttgttcaatcttttgggggccagttttaccggccgctttactgatcaaatcactcagcgttgcccgaccattatgccattcttcaccattcagaaatactgtcggaaccgctaaaatatttttttcagtcgcttcgtcctgaaacatgccaccttcaatcatcgtatgcgaaatatgagaattaaggacgctcataatattcaatgcttgaacaacatctggacaattatgacaactcaaactggcaaatgtctcaaaatgtaaatcagccgtgatggcttcaattcggtgacgatcctgttctgaaatcttaggggcatggcctgaaacttgcagcagtgccagtacaaatgatgtgaattcatgtcccagcggaatacccgcaaattcaattccacttgccggttgccccgtctgatccagtgcaaaactaggttggcgtttcaaatgaccctgcttgacattaattttcggtgacatcgctgccacttcattgacgaacgccagcaccttttgtgatcgatcatcatcgcctgcatcaactcggatggtaacttcgtgttccatcaactttaaatacgccgccagctgttgttttaccgtgctatcgattgccattttctcattgtcccttcgttaccctaaatcttaccaactaagtccaaaccaggtgtcaaggtgtcttcgccttccttccacttagccgggcaaacttcaccaggatgagccgcaacatactgacccgctttgattcgatcaaggtactcacttgcattccgaccaattccgtcggcgttgatttccatcgcctgcacggttccctcaggatcaaggataaaggttccacgctgtgctaagccttggtcttcatctagcacatcaaacagccgtgaaatatgctgagaaggatcaccaatcatcgtaaattcaatcgtgcccacggcatcggaattatcatgccaggctttatgaacgaaatgggtgtccgttgaaacagaataaacttccacaccgagcgcttgtagttttgcatactgttcttgtaaatcttgcaattcggtgggacaaacaaacgaaaagtccgctggatagaacataataatactccagtgacctaataaatcttgatccgtcacgtcaataaattcaccttggcgataagcttgagccttaaattctccaaccttttttcctactagtgacattctaaggacctccaaatattatttttaacagtccctattctaaacgataatcattctaagtcaagaccatgtgataagtgaataaaaagaaaagaaccgccatcttaaggcagtccttgttaatattcatgttatttttttattttatactaattctaatttagagcattgcttaatcatacttttagtaaaacattcgaatattatattacttaaaggcggcaaataagcgatcaatttcagcatattcctcgtcatttaactgaacatctagtgccgctgcgttgctttgtacttgagcgggctgcttagcccccggaatcacaatactaatcagtggattttgcatgtaccacgctaaaatagtttgggcgaccgttgcttgatgcaagtccgcaatcggttgaacccgtttaacggccgccaaaatttggtcgtatcgtggtgcttgaaagtccggatttttcgcgcgaatatcgccatcagcaaacgaaactggcccatcgtatttacccgtcaatagtcctgaagctaatgggaaatacggaacgaaactaatttggtggtcctttaggtaggtcatctttgccagattatcttggtggagcagactgaactggtcttctacaatgtccacataaccgtcagcgttagcctccttaatctgatcgagactaaagttcgaaaccccgattgcccgaatctttccctgttccttcagtcgttgaagtgcaccgactgcctcggccttaggcgttttttcatccggaaagtggatgtaatagatatcaagatagtccgtctttaaccgtcgcaaactattttcaacctgtgttgttagaaactgggggtcattattaaactgatctccatcatgggcccccttagaggcaatcgtgatctcatggcgatcaaaattctgaatcgcctgaccaatcagttcttcagaatgacctaatccataggcatacgccgtatcaatcaggttgataccacttctgagtgccgtctgaacaatttcaattcccgtttcatccttcaaatttggaaataggtttcgaccacctacagcgtttgctccaagtcctaatgccgttgtttcaacatccgtttgtccaatttttactaatgtgcgtcccacgagacacacccctttcgtttcagatatagtagagataccatctgcctgtcattgttgaacacttcccagattgatgcaactattttggcttaaggattgacagtttacggttacagatgtaaccttaatttgtaaaagttacatttgtaaccgataaaaattacaaggaggatttcaaatgacaacacacgatcacatgcctgacaaaatggccatgccagatatggatatggacatggacatgactatgagtgaccacgggtcccacgatatgatgatgcacgggggacacatgatgcacatgggcaatctcaaacgcaaattctgggtatctctcattctcaccatccccgtcattatcatgagccccatgatgggtgttaacctgccgttccaaattacaagccatccttggactgatttgctcgtcgccattctgggaacaatcatttttgtttatggtggtgcccccttcttcagtggcgctaagggagaactggctagtaaaaagccggccatgatgactttgatcgccatggggatttccgttgcgtttatctatagtatttatgccgtcgtcgcgaaccaggtccttcatctccctggtcacgtcatggactttttctgggaacttgtcaccctgattgacatcatgctgctgggccactggattgaaatggatacggtaatgaatgccggttcggccctcgatcgactcgctaaactactccccagcgacgctcacctcatcagtgatgataccatcactgaggttcccattaagcaactgcaactggacgacaccgttgaaattcgggcgggtgaaaaagtaccggccgacggcacaattattgacggcacaagccacgtcaatgaatccatgctgaccggtgaagcacggcccgttaaaaaagcccccaatgacaccgtgattggcggcgccattaatggcgatggcaccttacgcgtcaaagttacgggaaccggtgattccggctacctcgcccaagtaatgaaactggtacaaactgcacaaaattcaaagtctgctaaggaaaatacagccgatcgggtggccgggctactcttctacgcggcactcaccgtcgccatcgttgcctttatcagctggctgctaatcgataacctcgccatcgcgctctcaattgccgttaccgtgctcgtaattgcctgcccgcacgcactcggattggccattcctctcgtcgtggcgcgtagtaccgccatcgcggcaagtcatggtctcctgattgctcaccgtgatgttttggaaaccgttcccgacttacgctatgttttgatggacaaaacgggaacgctaacggaaggtaactttaccgttcataagacacacagcgtcagcgatcttgatgatcaacgcgtcttgcaactgatggccagcctcgaaagtggctccagtcacccccttgccgtgggcattctcgaacaagcgcagcaagtccaactcgacttacttcccgtaacggatagtcagcaacaaaccggggttggcctgaccggtactatcgatggacaatcctatcaaattgtctcttccggctacgttgaaaaagcccaactgactcaccctcatttttcattagagcagctgctgcaaaccggggacaccgttagtttcctcgttcaaaatgatcagattctcggatatgtcgcccagggagataccattaaacctagtgcggtgaccctcattacacaacttaaacagcaacacttgattcccgtcataatgacaggtgataatgcgcagagtgcccaaaaggttgctcatcaactcggcattgaccacgtccacgccggtcttcttcccgaagacaaggaacaactcgtccgtcattaccaacaaggccacgccaaagtgatgatggtcggtgacggtgtcaatgacgcgccgagtcttgctcgggcagacatcggtgttgcgattggttccggcaccgaggttgccattagctccgcggacatcatcttggtccgcagcgacccgcacagtatcattgaatttttaacgttagcacggcaaaccaaccgcaagatggcccaaaatctttggtggggagctggttacaacatcatcacaattccactcgcagctggcattctagcaccatggggattcatgttgaacccgatggtgggcgccgttgtcatgtccttgagcaccatcattgttgccatcaacgctatgaccttaaaagacgaggcacatactgcctgatgatggcactaaaccgtcaacttgataccgacaatgccaatcagtaataacaccacgaatccccaagtcagtggcgatagcttgtcgccaaagaaaataacccccacgatgatcgtcccgaccgcaccgattccggtccataccggatacgccaatcctaacggcaacgatctaatcgctcgggcaagcagccaaaaactccccaccattgccacaatggtataaattgcaaaatcggttttgtgaaacccctgacttagcttcagtgtggtcgcccacacggtttccaaaatccccgcaattaatagctcaatccatgccataataattttcctcctgaaaacacaaaacaccggtaccattcctacaagacctaaaggaatgatatcggtgtttaagctacccggtggtaactgtgttatgattaataaaattattgtatcaactcggatacgttttagcaactttgctgaattcgttcctctccgttgtcatacaagttaaattaaacagaaatgaagtgatcaataatgatggataaaaatgttaaatatcccgataccgccgccttcaactacgtccaaaaagaatttgaagcccgtggcgtcacgatccaaaaaattgcggatgtcgcttacgatttacagcaccggcatattcccgaagtaacaatggcagaaattgtcgatgccgtcattgatgtgctgcacaaacgtgaagtgctcaacaacattatggttggtttacaactcgataagctcgccaaccaagggcttctcgacgaacccctccaaacgattgtcggtcacgacctcggcgtctttggtgtcgacgaaaccttaggaaatcagatttcgacggtttacggccaaattgggacgaccagctatggttatgtcgacaatattaagccgggcattatcggcgaactagacaaggatccaaacacggtaaacaccttcatcgacgacttggttggtgccgtggcagcggccgtatccggtaaggtcgcccatcaacacagctaaacaaaaaaggatgactgtcactcactacgcaaagtagccagcggccagtcacccttttttatttcattaaatgaactgggctacaaatttccagagcaggcggagaccgtagccaataataatcacgccgcaaacccggtttagcaaaagtaaaaatttcgcttgaaaccgatccttgagtaacgacgtcacaaacgtcaaacctgtaaaccacagcaccgaagccgtacaaacaccaccaataaacagattacctgcattgcccaccatcgatacccggaaggctcccaagagcatggtgccatctaaaatcgcctgtggattaagccacgcgatggcgaaggccgacgccaccaccttccagtagctaaaacgctcgttggccgctgcgtcaggcatcgtcacatcttgggccttcagtaatgacaccccaatcgcgagtaccatcagactgccgacgatcaggatcacctgttccagcaacgggatgacttcgagtaatttaccaatcccgaaaaatgaggcgagtgccagagaaatatcaaaaaatgtgataattagggcggcgcgtaatgcccgtccgcgcggctgggccaatgccgtattaattgtatagagattttgtaccccaatcggggcaatataagcgaccccgaataagaggccctgtccgtaagttaacatttcaattaccatccaaatttcatcatacttatgctaagcttgtagcaacaatccctattctaacgaattaatttatttttatcccagccaagtcaaattaaatgaccagccaaatgatcggaggattctcatgcgcgtcactattaattggcaccccaatccacagcttcatcaacccctttaccagcaactcgtcaattactgcctccaagaaattgaaaccggcaattgggcattgggagatcagcttcccccacagcgagaactagcagtgcaattacaggttaatcgcagtacaatcggccaagcaatgacccaactcgtcgattacggcgtggtcagtggcaaacgtggtggtggcaccaccatcatcagtaatacctggtcactgatgatgaaaaaagcgcccgtcaactggcaagagtacatccaaagcgggcactttaaggctaaccttcataccatccaaaccattaacacccatgaaacccaaatgcccatgcgcctcatcacgggcgaactcgcacccgctttcttaccccaccagctctttgccgatgccttgacccgtgttggtcaccggttgcaacagcttaactacctcgaaccacagggattactggcgctccgtgaacaactcgctcagcggctacaacgatggggcattcaggcgagtgccgacaccattttgattacgtccggttcactccaagccctgcaactgatttccctgtccctcctcgatgagcacgcgaccgtctacacagagacgccgacctacctaaactcgctccaaatctttcagtctgctggggtccatctgcgtggcctccccctcacccgtaatggcgtcgcctactggcagcttccccaaactgaacagcaaaaactcctgtacgtcattcccagttttcaaaatccgactggtcaggtcatgacccttaaacatcgccgtgagctgctggccttcgccaaccggcggcaacttccgatcatcgaggacagtgcgtatcaggatctttggtttgacacgcgtcccccacagccactcaaggcactcgatgatcacggtgccgtcatctacctagggagtagttctaaaattctggctcccggactacggttaggctgggttgtcgcgccccggccgattatctcccgccttgccgacgtcaaaatgcaaacagactacggcgccagttcgctatcccaactcgcacttgctgaaattctggccaattccgattttgatcgctatttagtccaaacacgaacacggctacaacaacgagcccaagcagccttgcagagccttcaaacctatttggccccttatgctaagtggcaagaaccaaccgggggcttttacatctggctaaaactggacccacgcattaaaattgacgcgctgtttgatgctgcccgtgctcaaggcgtgctgattaatcccggtgatctctatgcttttcaacacgtgcaagccattcggctttcctacgcctacgccgaaccagcagcatttgcagccggctgtcgtatcttaaaacagctgattgagactcaacttactcactaaaaaagggattatcacactcagctttgcaagtgcgataatcctttttaaatggcggcgtataagaccaccactaagatggctggtagcatattggcaacccgtatcttcatgtcaaatagcaagttaaggccgatacaaaaaatcatcatcgatcccaccaatgaaattccatttgtcatggccgtcgataataatggagcgatgagcgtggccaataacgtaatcgtcatttgaaaaatgaacaccggcagtgcactgaacaccgctcctaatccaaacgtcgccgcgtagatcgcaataatgaccccatccaaaattgccttcgtgaatagcatgttgggatcatgctgcaaggcatcttgaatcgggccaataatggccattgcccccacacagaccgttaacgtcgcactcacaaaaccgtccacaaaccgtgaatcactccccgatcccactttttgccgcagccactgaccaagcttcacaaactgtgcgtcgatattgattaactcaccaatcaatgtcccaagcgtgagtgaaatcgtggccatcaaaatccccgtcgtttcaatctgggtgccgtgaacgaccagcatctgtgccagcgttccactaattccgataaacacaacggccaccccgattgcctgcataatcgatttttgtaaactttgcttcaacaatcgttgaaatatgtaccccagtacgccaccgaccacaattgcaccggtattgacaaatgttcctgttcccactatgtaaatcactaacacttcctctcatagtatcctaattattatactatctagcatcaataataaaagtacttttcctcatgaaaatttaagattgacatccccttcgttgccccataaaatagatctaatactgtttttcattactctttgtacgaggaggttttaccatgaataatcggctcgacgccacaaccgccgtcaaagataccctaccgacggtttttggctatattggtatcggcttagcgttcgggattgttgcccgtgcctcgggaattaatccacttttagtacttttaatgtctgccattacatatggaggttccgcccaattcgtcgcggtcagcatgctggccacacatagtcccatcctatcgattgttttttctatctttctggttaactcgcgcatgatcctgatgagtaccaccgtggcccgttactttaacaatgaatcgctcttcaaaaacatcgttatcggcacgcttttgacggatgaaagctttgcgttggggatgaacaaacgtaattataccggtgacacactgagcttcacctggtttaataccgccaattttatcgcctatttaacttggaacgtcgcttctctggtgggcgcactactgggtaacttcatccaaaacccagaaaagattggcctggattttgccctcgttgccatgtttatcggtctgttgtacttgcaagtcatttcggatcgttcccttaaccggcttctgcaagtcatggtcattacgctgactttgattctaatctatgtcggtctcattttcgttcctagtaatctattaattttactcgtcaccttaatcgggtgcgggtgtggggtggtgcttaaacatgccttcttctagctttattttactgaccattgttgggtgcggtctcgccacgtggctgtcacgcgttgcaccgtttatcatcctcaaaaaataccaactatcacccgccatcattgaatttttatcattcgtgccgatcgtaatcatggccgcgctctggtttgaaaatcttttccatcaaaatttaggtcacctaccaagtatcaactatgaaaatttcttcgcatccattccaacggtgatcggtgccgttattacgaagagtttactggttatcgtggtcattggcattatttctttagccgtggttcgctggctaatgtagtttgggtggttaaaatggcctcttttttaatacttcactcgcgggcacagacgcctatcgtataagaaaagaacatcactaattgcaaactcgcaattaatgatgttcttttttctccctattttgttcgccgaaacgcgttcgcgggcacagacgcctatcgtataaggaaaaagcgccactaattgcaaacccgcaattaatggcgcttttttcttataccacggcatctaatcgtgcccgctcacgctctattacaacaaatacttcttatcaaattctggatcctgactcgttagaatcttaggaccatcctttgtgatgacaatcgtatgctcatactgggcgcaatccgagccgtcttccgtaacatagtattcccacgtatcattcggcgccgtcttcgacttgatctcccagccgcccgtcgtaatcatgggttcgatcgtaatcgtcataccttctttgagccgcaaaccatggcctggttcaccgtatgccggtacatctggacgttcatgcatcgttggttgaatgccatgcccgattaattcgcggacatccccacaacccatttcttcttcagtgtaatgctgaattgcgtaaccaatatcgccaatccggttaccgatcacagcctgatcaattcccagatacaacgacttctttgtcacatccatcaaccgttggcgttctggcgaaatttcacccaccgcaaacgtccagcacgaatcgctcatgtatccctgccagttcacaacggtatccaccgccacaatgtcgccttctttgagcatcaacccacggcgaggaaccgcatgggcgacttcatcattaattgagacgcaagtagcatacttgtatccttcgaatcccatttcggcgggaatcgcaccgtgactttcaatatattcacggccaaacttttcaatttcccagcttgaaacaccaggcttgataatatcttgtaatccgatgtgcatgccagccaaaatagcacccgacttagccatgccatcaatctcacgttgtgatttaagtgtgatcacgattttgcatctcccatgttaatttgaacttcactaaccagctattagtgtaccacaaagttgttcttatcgtggttggaaaccttagtggaccagcgtggtgtagatcgtggacccgaccgccaacaccatcagcacgcctaccatcacgacgtggaaccatttatgtcccagcaaaatcgcgacatattcccgaattagagcgttcggaataaagaagttactggttttagcacccaagccatcaatatttaacccaacgtagcgggcgtaaccggccgcgcggtacgtatgatagtcgcttgtcgcaaacagcccctttgtgagatcgagttgatgatcactcacaatttgtttagaaaaccgcatattttccaaagtattcgttgaccgattttccatcaaaatttgatcgcgtggtactccaattgattccgcatactccatcatggcctgcgcttccggtaccttttcgtccgccccctgaccaccggacatcactaaaatgggtccccgccccgttttggcaagttgtagatcacggaattgttttgcgcggtcaacccgtgcggccagtaatggggacacggttcgtccctgtcgtaatcccgcccctaatacaataatatagtccttgtccagactgggcttaaaaattcgggataggaaaaacgacgtcataaaacagagaaaccagaaaacagcatagagcacaacaacgtccaccacattcgaaatcagttgcacaactaagctgggaaaaattcgatttaatatgccaaagataaacggactgagcacaattaacagtcctagaaataacgtcagcatattcggaatcgtgtgactttccttacgccaaacaatcgcggcattgatgagtagaatcacgcccaaaaagacgtaaatcaaaatgatggtcatcacaaccaacgccatcatcaccaagaaaacaaccgtgaacgctcggttatgcaaaaacaacaccgttgcactcagggccactagtatacatcctagcagcaagtttcctaacaccccatttaataaccggaccttattcgttctcatacttaatgctaaacacgctagtacaactacgactaacgcccagctaccaccaaataaccacgcactcatttttgccactcctccattattatcctcattcaaattctaccgatttctcgcattaatgtatagcactatgtccaagttgcttttaaatagtaataattactatttacattcattactttttccgttatagtggagaatatcaggacacattactagccattcggccacgacttctggtagactagtcacgacttcggcggtgactgacaggtttcgtcatcaaacaggacctgttttaaaaatctgtaacaatcacggtccaccttgttcggcccggattgaccctaggtaccactattaacccaacccacaccaatttagaatggagaaccaaaatggctaaaaaatcaaaaattgccaaagcacaaaaaattgacgccacaatcgaaaaatacgcagcccttcgtcaggaacttaaagctaatcacgactacgctgcactcagccagcttcctcgtaatgcttcgcctacacgccggcaccgtcgcgatgtcctagatggtcgtcctcgtggttacatgcggaagttcaacatgtcacgacttaactttcgggaatacgcccacgctggtcaaattccaggcgtcaaaaaagcaagttggtaatcaaaaacagcaagttacactccttcaacggggtataacctgctgttttttgatttctaatgcgctgaaccaaacaggttcaaaataatacttcccagtaaaatgagggtaataccgatcacactggctaagttgattgactcgcgtaggacaaatactgaaatgagggtaatgacaaccgtccccactcctgaccacatggcgtaggcaatgctcaaattaatactacgaaaggcgagtgataggaagtaaaagcacatgacatacccgacaaccactcccacactcggccacagatgactaaagccgttcgagtatttcaaaaaactagtcccagcaatttcgccgactaccgccagacctaaatataagtatcccatcataccatctccgttgtttcaaatgttctcggagaatatcatactacttttggcggtgactgaaatgactaattaccacttctgcgacgcctgccacaatcccgaccccaatactgagcggccatttcttggttaaaattccgcatacaaccgcgatcgcaatcccagttgtaataccatttacaatatcctttgattgtatgttcattacaacgatcccccttagtttcccctttatcataccagattcatcgtcacaaattatgctatactggggcaaataacacgaattgaggttttaccatgattaaacccatcaaccacgatctgacgtttctagctcaaaaggcccacccggccactactgtggatcgccagatcatcaccgatctgctcgacaccttagccgcccatcacgatgactgcgtcggaatggcagccaacatgattggcatcaacaaacgcattatcgttgttcaaatggggccctttgccgttccactggtcaatccgaaaattacacaccgcgccaatccccattccgtgacggaaggttgtctttcaatcagtggacaaaaaacgaccacgcgctaccaatccattaccgttagctatctcgatcggcagtttcaaccacaacaacaaaccttcacggactggatcgctcaaatcatccagcacgaactcgaccactgtgagggcattttgatttaaggaacattattttcccaaaagggccatgacgattgtcatggcccttttaagattgaagaaactaatcttccgtatccgtatgcttaataattcgagctggattacccgccgctaccacgttacttggtaaatcatgggtaaccacactaccggcgccaacgacgacattgtcacccagtgtaacaccaggcaataaaatcaccgagccgccaaaccagcagtcatccccaattgtgattggtcgatcgtattgccaaccttcgcgacgtaatttgacattcgaaggatgatggttcggtgtgtaaagctgacaatttgggccaataaaacaatgcttgccaatcgtaattttaccggcacttaatatttgaagatttgcgttaatgaatgttccctctccaatatagaggttattaggatgctcaatagaacaaattggataataaatatcaacgcccgcttcaatgtttggcaaaaaatctcgtaccatctggtcggccttctcaatgtcagtttttgccacatcattgatctgctgcacaatttgagcacttcgtttaacaatggcttgcatttttggctcatgcccatattgataccaatccccatcggcaactcgttcaaatatatctttttttagcaattcttctacgtttggatctgctggtcgtttactcatttgcaatactcccttgcggtttcgttattgctttttatcttatcacaaataagtaagcggtttaataaatttatccggataattttgcctatattaaaatttatttgatgatttaaatttaaccttcttgaaactatgcttataaaaagcactcatcaatatctgtgagtgctttttataccagcaattgtcttagacgattttttacaattcattcttaaaaatttttaggtccattttgataattaaaatatggctcttgttcttcacttgttggatcagcgccatctggtaatggtagtctatccttaacaggcaataaaggttcaaacttcaaatgtggttcattttgataccaataggctgttgaagaataatcatcagatctgtgattatcatgaccgtgctcaatcgtcactttaattgattcatcaaacataatggggtcctgaatgtggtaatgatagtatgatactttcccgctccagttaggaccgccgcctaatataattccaaagtaaggtgaattgtactcttgggttggacaccaagacgtattgaaatagtcttccatcccagttccgtggatagttggctctttatcaccatcaataaagatcatatcatcaccttcaccgtaccaattccacttatcggtaaagcgtaagttgtgaatatttaggttggttccaatgtattggcccgaccctttagcatttaaaataacataattatctttaccaactggatttttcccaccaaattcaaattcagcgttactcatagttttattagattctgaattttttgttatttcccgatgccattgtgcatgaaaacgcatcggctcatccattttttctaatttcacatagtcaatataaaaatagaattttaaatcttgagtagcattattttcaactacaatttttgcttttttaaaaggcataggtaagtagcagtttaatgcctgtccatcttctggagccatttgaaagggtgcagaaacaaaattctttgtaatgccatgtcccatgccaaagaagtcgccgattggtgcctccacgctcggattatcttcaccatcccaatacattctgagcacaactttacgatataggttctcttctgggccgttcattccaaccattgtaatccatatgtggttgattttacctgggtcttgattattaaaaatttcaagtttttttccggcttctaacgtgtaaaagtctttattaccacccgttctgtcgtaacttgattccctcaatctttttcctgattgctttttataaattgactctaattctaaggacataatcctacccccaatttaataagtttacgatgctgcaccagatctagtgttctcacgacggttatacatgaagtagaagattccgaaaccaatagccacggcaaataatacaaatgaccccattgtaattggaagtctgaaagactctgtatggaaaatgcttgcaaccaatttcaggaaataatgtggtaaataattaccaaagccttggaaaacaatttgaatggccgaaattagcgctgcattttcattattcgcacaagcagcagttttcatgtaaaacgacgactccattgttccaataccaatgccaaccacaccagcactaaaatacagcatcggcagcgtatgcgccatagaaatcattaatgatccaatccccaatatcgctacacataatgtaatggtataatttttgaaaaacttttgaataaatccaaacgagagcgctgcaaacattgctacaaacgttgcagtggatagtaccgttgctgctgttttcgcatctcctaaatgttcggtcacaacaatactagacagattaacttgatatacagtttgcataattgcacaaatgcataagaaaataacaaatacatacaaccgctttggaacgtttttaaatgattcactcaacgactgttgttcttccaaaggcttaacttgtggttctggtaaaaacaaaagtaaaagtccaaagcttaacaataatgctaaatatgcaccccaactaatcttaattgatacaccaactaaaataccaactaacatttgcaaactgattagagaaagatttttaacaacttctccaataccaaacataaatgctcgttttgagtcagaaaagagatcaataattaatgcatttcccaagggaaataacaatccaagtccaaaacctaataccacacgggcagccactacagcattaaacgaatgtagcatcattggtgcaattccacctaaaataattaaagtaaatgaaacacttaatgtcgttcgatacttccaacgtcgaccagtcaaaattccggaagtaattgatgctggaattgatgcaaggttgggaatcgtaattaatgaagcaatttgctcatgtgtaacatgtggataaagggcagtcaaattttgtaacgctggatccataacatttgcacccacacatgcaaaataaatttgaaagaccccaatggcggttagtatcaattttgtcctaccactaaatctattggttaacataaaagtgcatctccttttttcaactacttatttccgtttaccatacaatgggccaaatgtctgacatgccaaaacatccgccgattcaatatcatgtgtcccaaaagcaccccacacactaggcctgaataccctttcattttgaacgttgtgcataactactggaattcgtaacattgatgccaatgtgatcaaatcagcaccgatatatccatatgagattgcgccatggtttgaaccccaattattcatagccgaataaacgctcgtaaatgcaccttctccagttaatcttggtgcaaaccaagtagttggccatgttggatccgttctatcatcaagtatttttgtaatctcatcaggtaacgcaacagtcgtcccttccataatctgcaaaactggtcccatacccgccacaagattcaaacgcgtcattgttacaggcatctcacttttagtaacaaatcgtgatgaatatccgcctccacggaaatattcagtatcagccggacaccacgttgtttcctttaacatattctcttcatcttgtttattggtattccaaaattctttaacaacacttttattgtcacttttttccactccgctaaattccaaagcggccgagccagaatttttcaggtgaataataccatttttcgctttccccactaatgtaaatccagtagctttttcaacacttttcgaactccaaaaagtccgtacatccgcaaatagttgcgatttatttgttagtaagtgattaaatagcattgaaacagcgtttaaatggtcattttcagtggctatcaaatatggttcgcgggccccatcccaatcaaattgagtattaagaattgcttccataaaatcgccatttggaaaatggtcagtccattgtctttgaccttgaaaacctgcaattaaagcattatgtccatcagcctcctcaatatgattaagctttgctagtttgggatttcctaccatgagatctttagcaatcagtgccatcttcacaacaaattcccaatcttcccgcttctgtttatcagatcttgtatgttgcttgtcatttttatcaaacccaacactacaattatcctttacccattccaatgcacgttcgtattcatcaggatcataaattttttcatctattctgcgaataaattcactcatatcaattgattcatgtcgcattcccaagtaatcacttaagaacgatgtattcacatcagaaccaccaattcccattgcaattccgcccatttgtaagtacgatttatctttcattaaggcaaccgcaacacctgctttggtgaactgaattagtttttcttttacgtcactaggaatttcattgtcatctaaatcttgaacatcttttccatagatgggaaagacatttaaccccaattgatcatgtgctgctttggcggctgcgaggtatacagcccctggacgttcactaccgttaaatccccaaattgcttttggtcgcgttaagtttgtatcaattgtttctgatccataatcccaacaaggtgtgacactgatggacaattcaacattttcttgttgaaatttatcctcacatttagcagcttcagcaactccaccaattgtcgtatctgccacaacacattgaagtggctgcccatcaggatatcttaaatttgtttcaattaatgctttaactgacaatgccatcgccattgttttgccttctaatgattcacgaattcccaagcgccgtccatcaatgattggacgaattccaactttgggatacctacctattaacttcgaatacatatcaaaaacttcctttttccgtttcacataaaaatgaaacgtttcatttttgtttaaaaaaatatatcgcctatatctttttcacagaactaccctgcaccaatgatgcctcaagtttaattgtcttatgacttttaacctttttatccttaagtcgttccatcagcaccttaacaacctcactacttatctcttccaatggctgttctacaatcgtcaacgatggcgtaaacagtctggaatacagcaagttatcaaatccaacaatagaaatatcttctgggactactattttgtcttcttttaccgcttgcatcattcctagtgtcagatcaaaattggtggcaaatactgcacttggtcgatctcttaaagtcaatatctccttcatagcttcgtacccatgttgatatgaatactcaccagacttaatatattcacttggaactgtaagtccttgcgcattcattgctgtcataaatccattttttcgatcaatagaggtactaatcgtgtctgatccaagaataattgcaatttttttatgtccttgttcaacaagataattagttacctgtgttgaaatttttacactatctatccccactgtgtctaaatctaaataattaacatatcgatcaaccaaaataactgggcgatctgacactgaatctaaattaaaagcactatcattagttgcatttggtaccacaataatgccatcaaccattcgagaagcaagaaaatctaattttctttgtatcaactgcgggttattttgatacccacatactaataagctgtagccaaatctatacaatgttctttcgatatcctctactagatttgtacaaaaataattgtctagtgcaggaatcaaaattccaattgttttcgacttttgtgttttcaacccccttgcaaaggtattaacgtgataatctaaattagcaattgcctcatccaattttcgcttattatcatctttaacttgtccgccatttatatactttgaaacagttcctaacgataaatgcgtatattcagcaatatctttaacagttgtattttttaatttcataggagggccctctccaaaaataaaacgtttcattttttgtagtcataaaactacaacaacataataccacataagaaaataaatgcaagcgctttctataaaataaaaaaagagcagaaatacaattattccactcttttacattttttatacaattagcttccaatctatccttgctgttgcttcaattcccgctgttttcctaactcagccaaatgaacttcgtgagttaaaaaggcatgggtcttggcatcgtagttatgccgacgaccgattttgacgaggtagccattaatgtagtccacttcggttggccgatagttatgcatatcctgatacattgatggataatgtaggggcatcgcctccttgctgacatacatgatgctagccacttcgtcttgacgcgtgttgatcagcttaaccccgtctcgttcacagacatcgtaggcttcatcaatcaactgacgcgccatctcttcggcaccatcgtacgcggcgtactcacccatggtcatttcgaacatcgtgcaaatcgtgttaaccaccgaattgaagaccacttttgccaacaaggttccggcaaagttggttgtcagcgttggatggaactgcgctttttctaattcagccactaattgatgcgtgaattcgtccggcttttccgtatagttggctaagttcattgagccagcaccgcgcttaccgataaaatcaacatccccagcgccattaagcaccgtggcaaccaaagcggtccccgcaatcaacttctgtggttcaaaatacttagctaacttttcgatatgtcccataccgttcatgcaggtaaatgcatattgggttggtttaaagaagtgtgcacagcgttctagcatttctgccagttgcatttgcttcgtgaaaaatatgtaacagtccggatcaccttggtactcttctggatagtaaatgtcgatgtccacaaggtgcttgtcttcatggtcacgggacacatatacgccaccctgctcacgaattttttcaacattgtcttcccagccgtccacaaaatcgacttcgttaccggcgtccttcaacaaaattccatagcgcaaacccatcgcgcctgatccaatgacagtaaacttcattatcctaccccctaaagtaatggctcattaaaaaagtttaatcagtcactaattattttcctataaaaatgagaaaagtcaatgtattttgccataattgataagtttatatacttttagttataagggacaacttatttatagttatatcattagaattgagttaatttcttaattccagccactattaagacgatcattcaacttactaatcggcgcattattaatcgctagcaccagtttcctactccagaatccccctaaccacactgcgttccgatggcttgctaaattacctttaccaaattctggacgttttgaattgtattttggcacctcctgtactaggctgatgttaatttaatcaatgggaggggtattcgaatgaaaatcgggtcacaatcggtgtctaatctaggcatgggaacttggtatctgggcgaaggggacgcccaacaaaacacacaggagattgccgcgcttcgctacggcattgagcacggtatcaacgtcatcgacaccgccgaaatgtacggacaaggtgcggctgagtcccttgtcggccaggccattattccctatcaacgtgaacaactttttctgatttctaaattttatccgtggcacgcaacccttaatacgatgcgaaccgccctcaaaaacagcctgcagcggcttcaaaccaactaccttgatctctacttacttcattggccgggtgacacccccatcaaggaaacgttgcagggactgcagacactacaacgcgaaggactgatcaagcaatacggtgtttccaattttgacacggccgatttacggatggcgcatctcgccatgccttcggccacaattagcaccaatgaagtcctatacaacctcgattcacgcggtatcgagtatgatctattgccctaccatcaggatcaaggtattgcgacaattggctattcgccgtttggttcgggcgacggtcaggagattcaccttcccgatgcactggtggagctcgcacgggccaagcagatcactgttcatcaactattactcgcttgggtattacgtaataatgatgtcttggcgattcccaaggctagttctatcgaccatgttcaggccaatattgcggctcaagccgtcacttggacgccacaggaattggccgtcattgatcaggcttttcctcggccgacacacaaaacaccgctcaaggttatttaacctcaaaaaaatgcacgcctccggttaaccggatgacgtgcattttttattacgcagtttgctcttcatctgcctgagcatcagcaatcacttgatcaataacatctaaaacgccatcccgattattatccggtgccagatgatgtgccgcggtctttgccgactggtgcgcattttgcatagcgtacccgtatggcgtcatttccaacatcgccacatcattttcgttatctccaaacgtcatcacttcgtcatcttgaatgcgatacttcgcctgcaagtgcgcaattcccgttcgcttattaacacctctaagaccaattaattccgtattgaatcccgatgcgaggcttttcagtttcgccggtaacgcctgcttcacgcgcttcgtttgtgcggcaaaatcgacgtcagcattaaaccaaatccccagcttcacgatgggatcatctaaacgcctactcgacacgtctaaaatatgatcaactcgtgtcaattcgttatagtaacgctgtttaatcttaaaaatcgtcggtgattcttgttgatcaacatacgcactcctgacaccagaaaccaccgtcgttgctagtggcacattaaagtccgccttaacgagctgttgtacttgttgcaacagttcctgcggaatcgtctccaccgccaataattgatcatcagaatacacgatcgacccattctcagagatgaaatccatctgatcggccacagccgcaaacttactttgaagtcgttgccgctgcgacccactcgcggcaacaaatcgaataccaagttgccgtaatttcgcaaactgctggttaaaccgttgaacatcatattgatcatcgtcacgcaaaaacgtgccatccatatcgacggcgatcattttaattgtcatgttactccctctcttatcaaacctgtgctgccaacacattaccggaccatcatatcaaatccaaaagagaagggtcaaacaaatggccgcaaaaaaagcgcaccgaaattcagttcgatccgcttcacccgccttgacgatcatttgtagtcatccccagtttatccagtttatacataagctaaattcctggataggtttaatataaatgagttggttgcttcgtcaagtattccttaattaattgctctaagatgcctgcaacactagtattttgttccaccgcaacaatctttaactgtttgatgagatcgccatctagggttgttgtaaatttcttcttttccaccagtgatcatcccctttgtacgtattttatcgttttcatggcgtcaggtaaatacgtacgatagtacaattcacaaaaaaagtggatctttttacttagttaagtcaaaagtccacactgacggttcatcaccgattaattgattaatataattaagttattagttaaaattacccagaaacatcgccagaccgccaccaataaggactgccagaatcaagatgcccgccaataatacgttaaatgcaagccctaatccaccacagaccagtagtaggataaaaataatcggatgccgaaaacaaaatcggataaatcccatgattagtttgatgaacaaaattgcaaatacgagtatcccggccgcgacaccaattttccccgcattcgccattgcgagtggtgctactaacattgtcattttgctttaattccttccattctaattttgatagattgatttcaacgcattaatatccgcggtagacagtgtggtgaccccttgatcgactggatacatgaccgaggtggtgctcgtactatgatctaagccaagcgcgtgtcctagttcatgcgtcgctactgactgtttgattgacgccgaatagtccacattgatgcccgccttcgcatggtttgcggtataggcaccccagcccgtttgttcaataatattggggccaccgtatcctagctcaatcgtctgtgcagtctgctgattcactgccttatggtacacaaaaaaagtgatttgattttgcttagtcgttccggttccagccaccagcttcacaattccggtttggttataggtcgctaccgcccgctcaaattcctgccgaacggccgccggtacattatctttaaagtgataataataggttgtcgctaatgtttttccctgaacgtttgactcaattggggtggtatcgctactagctgttgtgctactcgtcgaggttgacgatgacgcactactactggtggtcgaagatgtcgtatccgccgtctgattacttgattgggttgcctgatgactggtaatcatctgctgcgcttccgtcagccaagtcgccggcaacgtttttaactggggatcgcgataaatagctaccgcaacgcccgctaatactatccatgtcagtcctgtactcagcttcactgcctatttccactccttcttgttactcccgccatcgtcgtgacactatcttaatcagtttccctagtcaccgtcaatcttttcagatgatcaccatcaaacttaacggtttatttattcttttatcgcacgaaaatcaaaatatctccaattccaagattgaacgcggtaaaatagacctaagaaactcagtttggaggtcagccacatgtacatcaccgctaaccgtgatcgatggcttaacgttaccattgccacgctcattttactaattattatcgcgctactaaagtacgattcttacgcgctagtttattgggacgcccatcttcaaactcacttggctgcgcagggaacaacgcttttcaataagctcttttcagccctcgccaaccccattatgggtggcatttacgccgttgcgctgtggttttttctctggggatttaagcataagctcatcgcaacttgggttctcggaacgtacttcattggccagctctggtttgtcgtcttgcgttggtgggttgctcgaccacggccagccgctcattcggcaaccttaacgagtgctagttttccgagtcaccatttcttcaccgtcgtgttgttgtgctatctcgtttggattgccgtctttccatggattactgaaaactggcaccggtggttattgaccattctcatgattgcgctctgccttctggtggccctggcacgaattcgaataaacgccgcctttcccatcgacatggttggaacccttctactcacctatatctggggtcaggttgcccaagccatttacctcaactggttcgcccggttacaaaacctgaccatttttcgtcactccgattttaactaggacggaaaattatgaaacctaaatttaagattaatctgatcattattttactgctcggcctaatttgtgtttggggtagtcatgtcatcggcaccaagcaccattcccagagcgtgcaacgaactcaggccctgtatcaaaaacagaccagttctaataaatcagcccgtcaggcaacggtcaagcaccaatcagcgaccaccacggtgaactggcacgcaccatctgaaaagcaggcctatcctgtacttgccaattatccacaggtctattttgatgttaatattgcggctcagcgtgtctacattcgaaacgcggccgaccataatcacgtactttacaccatgtactgtgccaccggtaaaaataacgccactcctcgtggcacatacacgattcaagcggaacgcggcttacatttttacaacgcgtcggagcaagagggcgctaactactacgtctcttggcttaaccacggtgaatacctgtttcataccgtccccgtcaaccaaaacggtgactacatcgtcaatattgccaatcaaattggccaacgccccgtctctcatgggtgcgtgcaactcacaattcccgatgccaaatgggtttacgaaaacgtcccctacggcatgaaagtcattatccactaactcttatcgaagcgaggaaattatgcccgtcttaattgtcatctatatcgcctttatcggactcggcgtcccggattcacttctcgggaccgcttggcccaccatctatcgacaactcaacttacccatctcagccgcaaacttactgactatcctagtctcgtgtggcacagtgatctccagcctaatcagtgcccgcgttattcaccgattcgggaccgccaaagtggccaccgtcagcacctttttgaccgccgtttcgttgttgggtttcgcactttctggcaacctttggacgctgtgtctagcagctattcccctcggactcggtgccggatccatcgatattgcgctcaataattacgtctcactgcactatcgcgccatccacatgaatttcctccactgcttctacggcatcggtgtttcaattagccccgtgctgatgtcgtttgcgctgcgctatggtcaccagtggcggcacggctacatcgcggccatgctcattcaaatggtgattgccatcattatttggatatcgctaccacgttggccgaaacctgcatcccctgtcaacaccgccacaccggtcaaaacactctccctagccgaaattgccaaactcaaaactgcctggtgggcttggctcatcttcatcggctccaccgcactggaaatgacgtgcggtatttggggtggtacctttctcgttaactcacgtcatctgagtgcttcaacagccgcactggtcgtcacgctctactacgtcggtattaccagcggacgctttattgcggggctaatttccacccacgtcaaaagttggacaatcattcgtgttggcatggtgatcgtcatcatggggattgcgggggttgccagtccatggacggctgctggcctatttctcattggtttgggcaacagcgtcgtttatcctaacatgaactacctgaccccgctaatcttcggaaaaaccaattcggccgccgtcatgggcacccagatggccgcatcgtacctcggtattatgatcatgccgcccgtcttcggctttttggcccaattatttggcacctggctgtttcccctatatctatttggcctgtttatcatgacggtcgtggccattgggctgatgaacgcaacggttactgcgattcacgattaaaaaagatcccgcaaaaagtttgcgagatctttttttactaactgccaccagcgaaaattgtttaattccgttagttaattttacgtttagggtttaagatccccattggatccagcagcgccttaatctggtgttgcagttgatcaacatcggggcctaattccgcattgttccactgatttttgagcattccaaccgcatgttccccggaaatagtgccttcccaagccagcgttttttcaaacatcagtcggagggcttggttcacagcctctggcattgcctcatcctttggccaaacgatcgtgggatgcacgttaccatcccccgcgtgacccgccacataaatctttagccccaactgttcgccgacatcatgaatgtaatccatcatcggggccagctttgacagcggcattgccatgtcttccataatgtggttttgaccggcaaaaacggctggtaacatgtcccgtcgcaactgctcaagggccgtctgacgggtcgcatcagtcgtcaactcaacattttgcgcctcatacttttgcaagagttccttcaaaaccgccatactctcatcggtgctactttcgatcttaaaaatcaacatcgcaccactgttatcactataggtggtatgctcatagcgatctagggctaccatcgtattaccatcaagggcttctagcattgtcgggtaaaccccagaaatccggatcgccgtgacggctttggctaacttcgtcatgtcatcaaagaaggccacgcccatgattggcgttccgagtgggatcggtaatagtttcaccgtaatttcggtcacgattcccaaagtcccttctgaacccacaaacaactgcgtgaggttatacccaaacgcctgttttaaggtccgtccgccaaccttgatttcacgaccgtccgccaaaacgaccttcaatcccagcacgttatccttagtggccccatatttgacggtactcataccaccggcattggttgccacattgcccccaatgccggacaatggtttagaacctggattgggagcataaaacattccctgctttcgggccgcttgatccaaatcaccattgatcacacccggctggactaccgccaccgagtcttccttatcgatttcaataatctgattcatctgtttggttgataaaataaaactatgggcaaccccatcggctcccactaccgtactagtaaactgatcttgaggaacaaccgcaacgtggtacttacgagcggtctgcagcgttccttgaatatcagccgtcgagtgggcctcaatcactgccaaagcccgttgactttctgcactagtctgtcggctactaaacgagcccttcgccaagctctcatcgtccgttaagacttgtccatctggaacattttgttttaaatctgcaataatttctgcgtcgtcaaatgcggcaaaagctgccataattatcagatcctttcattaatatcatcgttatagcgaaattcgcgccgtgagtcaaccatttgtcctcgcccaaaaaggccgttaggtatcaatcatcctcgttgatatctaacggccttaccgttgctttattttgtaattagaaactgactgggacaccgcagcttagtcctcatcgtcatcatcttcttcaaccaagccatcccaagcagacttacctaaaacggcctgcaagacgcgaatggcatggttgttttggccgcgtaacgttgtcaaaaaggcagccatcgctgggcgactttccttttgtgccaggataattgcccgatcaatgaacatgttttgcgtcgcaaagtcgtgcgccgtaatatcgactaacgctgcagccgaacggtacttgttacggccatcttcttccagcatggtgtacttctggtattctcccaccgtcgatggcgcaatctcattttcatctaagagtacgtcggctaattgatcaaattgttgccggccctgtgcaatcaacttttcgtatagcggtttgagttgtaacgattccagccccttcacgtaccataatgtctggtgtagcttaacattgttaaccagcaagttagctagaatgtggccggtcattgcgccggcggttggtgtgtggtgatcaatatcggtttgcttttcttctgcttcgtataatgcatcaatgtctgtcatgtttgtcatcctctttgatttagtctttcacttttactttttcaacggtgtagccgagttttgtgacgacctgtgccaaatcagccgcactcgttttggcatcatcgaaatccgccttcactttaccggcattgaacaggactttgaccgtttctacaccatcctgattagataccgcgtgttcaattttttgcatacatgacggacaggttagtccatcgagttgtaaaattgccttttttgtcatcatcaattcctccgtttcgttttccttgattgtctttattataacgagccccgttgggtaaaaaattgatctaaatcaagttttatccatttatttggttgttgttcgtggaaccggggttggcgccacgctagttgcatgaccataaccaatcaaccgcatggcgttaaagatgaccaccaaaatgctggcttcatgaacgaacatcccacttgccatgtagataaagccggcgatcaaaccaatcagcaaaaatgccacgaccgcaattgcaatggtaatattttccttcgtattcaataccgtcttcttagccagtccgtaagcatgcaccaaagcctcaaaacttgactgcatcaacaccacatccgatgtttcaatcgctacatccgtgccgctccccatcgcaattccaatgtcggccgtcgcgatagacggactatcgttgatcccgtccccgacaaaggccacggtacgaccagcctgctggaactgcttcacaaacgtgaccttttgttccggcattagttcggcgtgaacctcatcgatgccgaccgtttgggccacgtaatcggcggttgcttggttgtcccccgtcaacatcacgaggtgcttagcgcctttatcccgtaactgttgtaattgagtagccacttctggtcgaataatatccgaaatcccaattagggcggccaattctccggccactgccacgagcaccacggaactgccagtcgcctgtaatgccgctaaatccttgtgctgctcatcattgagtggcacttgttgggcttgcatcagtttcaggttaccagccaataccgtttgctgatcgatttcagcaatcattccctgacccttgaccgtacgattatcggtcacgttcagggtctgaaaattagcgccttgttggtcggcgtacgtcacgatcgcccgaccaagaggatgatcagacaaactctccactttggcaaccaatgccagcgtcgtttcgcggtgtcccttataagtcttcatcgtcgaaaccgacgtctttcccgtcgtcagcgttcccgtcttatcaaacacaaacgtatcaatcttcgaaaaggtatccattgcttcgccgccctttacgaggattccccgtttggcaccattcccgattccggcaacgttagaaactggcgcaccaatcacaagtgcccctgggcatcccagtaccagtaccgtaatcgctaacttgaaatcccgtgaaaagagaaagactaccagtgcaatcaccagtacggcgggcgtgtagtattgggcaaagcgatcaataaatttctccgcatgggatttagtatcctgggcgtcttcgacaagttcaataatcttggcaaacgttgtatcgtcaccgaccttcgtcgcttgaatcttgaggtagccatcgctcaccatcgtgccagaaaaaacgtcgtcttgaatctgcttgccgacctgccgcgattcaccggtcacaactgattcatcggtatagccatgcccgtcaatcactttcccatccaccggaatcgagccacccgttttaaccagtacaatatcaccctcatcgacatcatcgacgtcgacttcttcagtcgttccatccgcctgaaccaccgttgccgttgtcggtgccatttcggttaacgacttgatcgattgccgggtcttagccagcgtccgttcttcgaggtaactcccgaacagaaagagaaaggtcacaatcgcagattcatcatattcgccgatgataaaggccccgatgaccgcaatactaacaagcagttcaatgctgaccacctttacgcgaagcgcttgataggcgtgaatcacaattggaatcgccgcgataatggaagcaacggctaacattatcgcttctcccgtcgtactaccgagcccatacttggttaagtaacccgcaacaatcaaaattgcggttaacaacgtaatttggtgattatgatcttggataaatttttgaaacttcatttcattcactcctcatgtccacatgcagcggtttaccactgctgttccgattaactgtctctatcatagcggccgtcatgagagaaaaaattgatttagatcaactttcatgaaataaaagtggctaaaaaaaggcgccaaccgaagtcgtcgtcctttaattcatatcaccataaaaacttaatccataatcggttcacccgggtactttgatgcagcccactatgggtgaggcccgtcattttcacattttttagctgaacctttcgcccacgtaacagataattgacggattgctccgactgcaccgtcacctgaccatcggaatgcgtgccatcccccaaatcactataaatattcaaaattttaacgtgcttgggaaaatgctgggcatcctttaatagttggcggtaactcgggtaccagctattagctgggtaaaaggtttggggccgatcgtgcgctaacagcttattttggttaggttcatcgttcatcccaatcaccccattaaacggccccgctaatatcacatacttgttgagcgtcggtagagtttggtggtgcgccgtgaccgtttcaaacaaggtaatatttcccgccgaatgggcaacaacgttatacttttttacaccatcgtttcgttttaaatcctgtaaaatagtcgtcaaccactgcgtctgcgtcgcaatactagcagtattgttttcaaaattaatttgaatcagtggccgccggacttttttagaatactgaccagtcacctgcagggtaccatccgccgccacgttgatcgtcagcacctttttggcacccttctgcttttcagccgcggcaatcatactatcggtagacttatgcgacccttgaagaccgtggataaaaatggttggcaccggttgggcagtcgttttagcgtgtgccagactagtcgttgctcccagcatgccaccgatgaccaataacgtgattaacattcgtttcaaaaattgcatctctgttcctccaactatttgcaactgatattaacacaatttgacgatttcacaaattcattcaattccagttatttgcccattagaatctcgttacttaggcccgcccttgctttataattagggcaaaggagggatcgccatgaaccgtcaattactcaagcgtgaatcaaagactttattgcaccagcactattcatttttctttattctttttattcccatcttcttgctgaccctgttcaccggcgtcatgaatttaccctggtggaacaatcccaccgatgtctggaacagcaccgacactggtagtttgttactcaacctactcctgtccctagtttcggtcggcgttaattttgtcctcattgatctttttcgggatcaggccactgcgacccagcccctcaaaaaatcgatgactattttcaccaatgcccactatgttttgggagtaatcgtgattggcattattcagttcatttttattgttttgtggatgatcttactcattatccctggaatcgtgaaatccattgcctactcacaggcctactatatttaccgcgatgccctagatcatgggcatgggatctcatatctcgatgccatcacccagagtcgttacttgatgaacggacacaaaatggactactttattctcagtctgagtttcatcgggtggatgctactcgttatcattacgtgcgggatcgcacttctctacgtccaaccctacttcagtctcacctttgctaatttctactgcaccttacgggaccaagaagcacaaccaagtcatgcgtaaaatgagaatttcacagaaaatcctcagatcacactacttgaaccggtgaaacgcacgtagtacgctaaatctggtcatgggatattcctttctaatatcagtgttacaacactgtatcgccacccatgaccaacttacatagaaaacaaactaacgatgggagttccaaagcaaatgacaaacacagtattactcgtggaagacgaacgtggcttggttgattcgctcaccactgaatttcagtttgaagactaccaggtcatttctgcctttgatggtgaaagtgcggtcaccacctttctgagtcacctgcccgatatcgacctcgtagtgctggactggatgctcccaaaactcgatggactcggggtcttacgccgaattcgtaaggaaagtgatgtccccgtcatcatgctcactgctcgtgattacacgggtgataaagtcgcgggactgttaggcggagccgatgattatgtcaccaaaccgtttgacaccgaagaactactcgcccgcatgcaggtcgttttacggcggccgcgaatggggactggaacaccggaaaatggtctttatcgccttgatgatctgaccctcgacgcgactaaacgccaagttatccgtggctcacacaacattcagctcactcagcgagagttcaatctccttcacgaaatgttcaaggacgtcggcaaaaccttcacccgtgacgagctactcaacctcgtgtggggcgtcgatttcgaaggacaacccaacgtggtcgatgtctatatccgctatttgcgcaataaaatcgataaatttgacggcaagcctaagctcatccacactacgcggggtgttgggtactccttgtcgctgaatcagtaaggaaattgcccatgaacaaaaaaaacagcctatcccaaaacagttcgtccatcatgctccgaagtttcaccgcgctcattatcgtcattatgctcatctccagtttggcaaccgttgtcgcagtgggccaccagttattggaacttagccaaaccaacaccacccatatcattacaagcctaaaaaagacggtgatcgatggggatgacgattgggagaattggcgtaacaatagcaccatggataccagtaccagctacgttcacgtaaccaacatgcgtcgagatgcaaaggttaaaaactactactcaccggatacggacgacctattagaatccaagattcgtaaaattccgtttattgatcacctctactatagtaatcgtgacggctttgtctactacgcgtccggccatgcacggggaatcaagtatcaactctggactaaattaggcagccagttagaaattctcgaacatgtgattatcgtaaccgtcattattctggtcatcaccctgctgattagtccgctctacattcgctcgattgccaaccgcttgaccgaagccctagagcgtctcaccgatcaggttcacaaaatctcctcacaggtgaacgagcacggtattaaaaatgaaattcagctatccgtaccgacaaaacccaccgaggtcacgaacctcaccaccagctttaatagcttacttcaacagctctacgatcaaactgaaaaggaaaagctcttcgtttcaaacgccgcccatgaacttcggacccccatcgccacgattcgcagccatgcccaactcattaaacggcgcggtgatgcgcatcccgaaattgttccgcattcgattgactatatcgatgacgaatcacatcagatgcaggccctcgttgaaaacctcttggccctatcgcgggccgatcgcctcacctatgatcagcaaccgtttgatttgagtgccgccttacagaccctcgctcaaaaaatgacgcccgttctgcaacaatccctcatcactcagattccggcgggcataacggttaccgcccatgcgccaagcattgaaaaaattattaccaactttttgagcaacgctgggaaatattcacccgtaactagtaccatcacactcaccttacaacgtacgaatcaggggacgcaggttgccgtcacggatcagggtccgggaatcagtgccgaagatcaggcccatattttcgaacgtttctatcggggcagtgatacccgcggaacgattccgggaactgggttaggaatggccatcgctaaacaactcgcggacgctaaccagtgtacaatcacgattgaaaatcaacaccccaccggtaccaaattcatcctcacgtttcattaaaacaggtcccgcaggtacgtcaataatggcgttcccgtgggaccttttaatgataaaactgttgggcaaccgcaataaatttctgcagacgttgggactggtattcctgcttgtaatacgatgctgccacgtagcggggttgttccacactttcaattcgataaaaatgcatgcccgtaaccggtgtactatgcttgatcaacgtatccgttacaaaggccgcaccccagtttcggcgggcaaactcgtaggcgctaatttgttgattcacaatcatggcggtggttggtttaaaattggccgccgtaaataatggtgctgtccgctgtgcaatttcattggatggcgtcatcagtacaaacggtagctgcgcaaacgttgctagggcaactctttgtggcgcctgaatgtgctgatcggcgagaatatcagcgtactgatagcccttggtcaatatggtgacgtctgtgatgaggtgatccggcactgccaataaaacgtgattttcaaaaagtttcacactattgatctgcggattcagcaccaaatccgtatcaaccgccaaatcaatttggcgatctcgtaatagtcgtggcaggtctggaaacggggcttctagtacggtaagttgcacattcggaaactgttcatgaaaccgacgaagcagtggcggtaataaataagtcaccgaaataaacgcgccaccaattgtcagattgccagtgaggcggtgctccaaatgagttaagtcatccgttaacgattcttcgagggccaccacctgacgagctttagccacgtataattctcccgccgtcgtcagtgcaagcggtgtttgtccccggtcaaagagcggttgaccaatttgagtttccaattttttaaccgcaatgctcagcgcgggttgagaaatatggagctgcttagccgcctgagaaaacgtcccttgtgccacaatcgttagaatataatcactgatattaaacatggcgtcctccataaataatatttatagcttgaatatattatatatcttatcttttatactgccggcgtgctactctaagtttatgttatttgagaggagtacgacctttgattagtttaacgacctttttaattgtttgtcccttagtctttctaggcggctttgtggattctatcgccgggggcggcggtctcatttcattgcccgcctacattatgacgggtatgccaattcatttttgtatcggtaccaacaagctgtcctccgccatgggaacgacggtgtccaccctccagtttgcacgtagtggctacatgaaactcaaactttcgctcgttgccattgcgtccgccctcgttggttcgaccatcggtgcaaaattagcgctccacatttccgatagttactttcgcattatcttactcattattttaccgctcaccgccatttacctcctattcaagaaaaacgcgttgagtgccggtgggttactcaccgatcagctggcccctcgtcagctcggactcacactcattattgcggttttcctaggaatttacgatggcttctacggtcccggaaccgggacgttcctgctgctttgcctaaccgggctggctaaactgcccatgaacctcgcagctggtaccaccaaggtgatcaatctgacgacaaatatcacgagtctcaccgtctttttattcagtggtaaagtcattcttctcttgggtgccgtagccggcatttttggaattgcaggtaactttttgggcgctcgctactttaaacgcggtggctcaagtgttgctaagccactgattttgatcgttctggtcatcttctttattaaattaattcatgattttctgtaaactaacagagggccccactacatgagtgaggtcctctaagagaatatttggattaggatataatccgcataccgattacgttgtctgatttcatcaagatcagacaacgtttattttatcacaattttataattccaaatatataaaattcgactattacaacttactaaccgcgtcatcgccctgactcttccgatgactagttctgtacccgataccgcaacagtgtcttacgcttagcttcttcgacacgcctaaaatcagacagatagatttccctatgccaatactgatcgacaaccggaatacgccttaagttattttcagttaaatacgcatccattttggcaaaagtctctccctccgtatcaaaacttcccacgtgcagtgcctgtacagccgccgcttcggggaattgttcaaatgtgacgttggctaactctgctaatccttttttcttggtcgccgtagccactgccgcctcaaatagagcggtcgttacctgagccggttgacgaatcattaaccggtatgccaatgcagctttattcaaatttgctcctcgtgatccgtcggtagtcgtccacaccccttccaacggataaacggtatacacgtatggttcaccagccgcaccgcctttgagtgcaaacctcaaggtgtaagctactgagtatagcgtcgtgatattagcagaaaacgccgggtgattaggatctccgacacccgttaatgcaatatagttagtggccggaaccgtcacctgttcaaccccttttggaaagtacaattttttatccgtcttgcgccatgattctgtcatttagaaatacccctcatctctgttttagtgccaactcagtcgtatcctgaagcgtcttaattaatttatggagattcgccaatggttccctttgaccagataacatccattcacgccagataccataaacaccattggtcatgaacacactccaatatcgctgcttaactggatccaaaccagtccaattttcatagtaatgactcatattttcagtaaataaatcgcgtattaagtactcatagttacgttgcgtggataaccgtaattgcgctgcaaactcatcgaaaaacgtctgcatatcttgtaattttatggtggccgatttttgaaaaataacattatcaaacattcgactcaatttaggtgcgaaatactgtcgtataatgtcttctaatccttgataattccggtaaaaggccatccgactaacgccggcgcgtgtaaccaattctgtcaccttaatctcctccagagactttttctccaacaattgaaataacgcttccgtaagataatcttgtgaatccttttggatcagttgcgcatgtttagtagctgccattacaccttctccattctgtcacagatgccctgataacgcttgtgacgagcttacaggcagtgtacattattgtcactgacgttacaactatctcaagcaaaagaaggagaacaaaatgtccaaaaaattagttgttgttaccggtggttcaggatttattgccagtcatattattgctcagttactccaagcaggctatgctgtccggacaaccgttcgtgatgttgaaaaaaaacgtcctttgatcgagtcaatgttacatcaagctggcattcaaaaattaaccgatctaagtttcatagcggcggatctcactaatgaagctcattgggatactgccatttcgggtgccacctatgtcattcacccggcttcaccaacaccgacgttaaattttaagaacgagtctgaaatgatcgatccagctatacaaggtgtcttgtatgtactgcgtgctgccagccgtcacgatgttaagcgcgtcgtactgacctccgcctacggtgccattttcgcaggtcatcggcaccagaaaacgcccttcaccgaagaagtctggtccgacctcacccagcccggtgttcacgcctatcaaaaatcaaaaacactctcagaacgcgccgcttgggagttcatcgccaatgatagttccaaattagaattcgcgactgttaatcccgtcgccgttatgggaccggtactagcaaatgactactcccattcaaatattcaaattcaggaaatgatgactggccaaacacccctagtacctaaagttgattctggttatgttgatgtccgcgatgttgctagcttacatctactcgcaatgacacgcccagaggctgctggtcaacgctttcttgcgaccactggtgaaacactctcaatgctggaagtagccaatatattacgaactgcatttcccaccttttctaaaaaactacccaaacacgagattccgacgccagccttaaaactcgccgccaaaacaaatcccatgctcaaaatggtagcctcagtcgcaggcacctatgctgcaacttcaaatgataaagccgttcagttactaggatggcaccctcgatcagctaaagaagccatcattgccacagcacaatcgatgatcgatttaggaatcatcaccgtgaaataacgtcccaacggtgctaaaataaacctatcttaggtacttgcaggcgatacctagaacaacattgccgttgatggaaaggcgaatatgcgcataagtatcctgcaacataccccgaatgaaggccctggagcaatctacacctgggcacacgaacacggacacgaaattaccatttatcatccgtatcaatttggtatcttacctgaagctgatagtgtcgatatgttaatcttactcggtggtccaatgagccccaatgataacctagcttggattactgcagaacgagtcctaattcaaactatgcttgatacggataaaccgatgtttggtgcctgctacggtgcacaacaaattaccaagacgcttggatatcccgttactaaagcggcagctaaagaagtgggctgggcacctgtctatcgccaaagtactatcattcccgatttaccaaaacaactcacggctttacactggcacgaagagcaatttgctatcccagatgaagctcactggctgttttccagcgatctagtacgcaaccaagggtttgtcatgaatcaccgtgttattggcttgcagtttcatcttgagccactaccagatgacgtgcgcaccattgtcgctaatgatgcgcaatacgtgcaagaaaataagttgcaccaaacaccgcagcaaattttggcatgccgtgtgccatccgaaaatcagatagtaataaatcggctgttagactacattacagaataataggaatcccgcaactcagtgatcactgaattgcgggattttgacgtgctatttctcatatcaaaaataaattcatgaccatttgattttattggtgggacacaattgtacgtttcgtatttgactcaaatcccattcatgtatccgattatgatctacttgaataagaactcggatgcactctaattgctttacgtaccctgtcacactagctatcgtttcgccctgctgtaactcactcaattggatatgcacctgatattgatactcaagtgctctaaaaagaagcgcttctatttcttgattagtttgctgcggtttgactatctccgcaatggccttcttttgatccttcttgatagagctagtgtgatcacttaaaaaaaccttgccatttcagcattcctcgctcttcatagtcattcttgaaaaactgttgcgcggcatgatcatccttcatttggtcaattggtccatatttgtgtttcattacgttcacctcactaatcaaatacatttccaccgttatgtccacccaccagcccagcgcgttgtaaaaaagtcccacccttttttaaattttttgctttaaacacggctgtactgccgaaacggtcgcgtacgcgatccaacacggcatcagtggctgccgtcttaatttgtctttctggttcttgaaataaatctagttgtaagccactattgtcggtcaatcgacttagcgaaaccgcaacatttctgacaacttcaccattccactgatcttcgaacagcttgcgacaataaccaaacagctcacgactattatccgttggatcaatacgcatggatcttgaaaatccctggcggccatcatcttcagcgctagcatagccaaaaccaatggagagtgcgacacaccctgcgagttgttgatgatgtctcattcgtgaactggtctgatccacaatttcactgatcaccaattcgatttcttcgcgcacagtatagtcgctagggagtacctgcgagtttccccatgatttatcgttaatcttcaccaacttatgtacatcagttcgatcaatcccccacgccaaggcaaataattgctctcccatgaggccaaactcatcctttaattgatacggatccgcatatgctaagtttttcattgagtgaatgccaatgcgattcaggtggctcgccgtccgagacccaatactccaaacttgatttagttcagtaatcggccaaacagtttggggatacgtttcataattcaagtcacccaacaggtcaaaatcatgcttcgcgactagatccaatgcgactttagcctgcgtcggattttcaccaatcccaacagtaacgtaaagtcctaattgccgttttacttctaattgaatttttcgtgcgacttcccgtggtgttttaccgaatagtcgccaagaatgctgcatctggagtaaactttcatcgattgaatacggcacaatatcctcaggtgccgcgaattgttgaaaaatatgattaatttggatgttgcgatgaatatataggttcattctaggcgcaactttaattagacgaggatccttaggaagattccgagcacgagaaacgttcgtgataccaaatagtttttttgccatcggcgaggcagataaaactaagcccgcccctgtgttggccgtcatcgatacaacaaccaatatggatttcagtggattgagctttctttcaaccgattcaacgctagaataaaaagatttattatctatcataaaatacaacccgtgtggttcgttgccataatccatcatagtcacctcaaaataatcaccgatcacgttccctttcacccttagattatacaaacatatgttcgtgtagtcaaactaaaatttaatttcaattttcggatttttttagggacacttttccaacaattcgtgtataatatccgtattacttttttcagaatcgaggagtcatgccatgcatatcagacttgcacgcattagtgacgctgctgcgttacttaaaatttaccgtccttacattacggatacggcggtttcttttgaactcaccgtcccgaccgtctccgagtttgcggaccgcatcgctgaggttttagccgactatccctatttagtcgcagaagatgacgacgggcaaattctcggatttgtctacgctcaccgctatcgtccacgggccgcctacgactggaccgtcgagaccagtatctatacggacaaagccgccagaggcaagggcgttggccgtcagctttatcaagctttagaaacagaactggcaactcaacacgtcacaagtttattagcctgcgtgaccggtgagaacctggcaagccttgcttttcatcagcatctcggttacgagttagtcggtacattcaagcaagtcggttttaaacacggtaaggggtacgatacctactggcttcagaaacaactgagcgcagctactggcgaagcgttcattccatattcacaactcccccatagtgcataacaagagcccatcacgattcggtcgtgatgagctcttttaaatattaactcgcagtccgttccacaaatacccggtgccaagtaataaacgttaaaatcgtccaaattttgcgtgaattatcccgacggccctggcaatgttcatcgagaagctgtaggcagtatgccttgtcgagccactgatccacattggccgtttgaatcatgtccacggcccagtcgtgaagctcatttttgagccacacacggatgggaatgggaaatcccaacttttgccgatctacaatgccggttggtaaaaaggcctttgccgtctcacgtaaaatatacttcgtggtcccatgcgccacccgtaaattagttggaattttttgcgcgacgctaaagacctgtcgatcaataaacggcgtgcgcagttccaatcctgacgccatcgaggtccgatccgcattcagtaataaatcacccggcagccaagtatgcatatccacatcttgcatccgggtaatcgcatcgagctggtgattgcgttgataaaccgaactgaccgcctgataaaacggaaaatgctgatcgtactgtttcaatagctgggccttttcttgttcattaaaaatcttcgcgttaccgataaagcggtgttccaacggcgtcgttccccgcagtaaaaagttgcgtcccttcatcgttggcggtaactgcgccaccgatgcatgtagcatcgtcttgagcggttggggaatccaattaaaacactgtagtgactttggctcgtgataaatacggtagccgccaaacaactcgtcggcgccttcgccagtcagggccactttgcaatgttcgtgcgccaaccgggctaaaaaatactgcgcaaacgccgcgggatctgccagcggatcatccatgtagtacacaaacttagtgaattctgtcatgaagtccgttggtgtgatcacccgactaatattttccaccccgagcatggcggccgtttccttcgcgagatcaatttcactgtacccaggatgttcaaatcccaccgaaaaagttttcaggtggggatgcagttgactggcaagggccacaataatcgatgaatcgattccacccgataaaaaggccccgaccggcacgtctgaacgcatgtggcaagcaacactcgccgttagtgtctgctgcagttcggccatcaatgccgtcgtcgaagtaaccttgtgcggcttaaactgcgcatcaaagtattttttcacctgaatatcctgatgaggtcgcttgataaagtagtgtcccggtaagagttcgttcacactttgattcaaagtttgggccccgggaacgtactgaaacgtcatgtaattttgtaaagcttcctcactaatatcctgaaaatcattaatttgagcaaacacctttttctccgacgcaaagtaaatactgtcgtcttgttgctcaaaataaaagggtttgatcccaaattgatcccgggcgccgaaaatttcgtgcgtctgggtatcccaaatcacaaatgcgaacatcccccgtaaatggtctaataactgaataccatagtgctggtaggctgctaagaggacttctgtatcactatccgtcgcaaagtggtatcccagttgcttcagttcatctcgtagttcaatatagttatagatctcaccattaaacaccacccagtaacgttgctgctgatccgctagcggctgcttaccgtgttgtaaatcaatgatactcaaccgccgaaatccaaccgtaatatcttggttgtcaaagtaaccctcatcgtccggaccccggtgatagatcagctgattcatttgcttaatatctgttaatcgctcccgctgttcgctgttatcgttatgaatcgatccaacaaacccacacataaaattcctcccacgtctttgccaatcattattctcaaattaactcgcaatccagcatagtcaaaatgagcgtggcaaaaaaggatagaaaaattaatttaaaatgaaaaaatcacataaaccgccggcaacccccgttttcatcacatcatccaataaaaaactgcgaaccagattaaccataataatctgattcgcagttttactttaacttgcctctggataggtaacccagccataatctaataattgatgataatttttaccaactggaacccataaactggattccaacacccgtttgattgattcccagaataatggatctcctttttcttgggaagatagattaacattcactaattcgccggtttcagtttttgcaatgacgaagggataaaagactttcacgatttgagcggcaataatatttttaattttttggtcttgatctaataacataacttctcactccttaagtgtatgatcctatcataccctccgattgtgaacaccagccggcacaaactatgaatgaatcatgaccttttccctgagaattactttagaaaagtgacgatttcttaatgactgtttcgttatattaacgcatagttctacctaaaccctaatctgagttgctttttggggtggttcgcgcgacaataactaaaacttaattcttacgaaaagatctgatacttatgcccatcgttcaatacaccatcgcccacactgacgctcaatttcaagtggctcgtcagcttattttacaatacgcccaagggctcgatctcaacctagacttccagaactttgatcaggaaatgcaacaccttgccaccgaatacaatcgtccccatggcattcttttactggcacacatcgatcaccacccagccgggattgttgccctccaccagtttgacggcccgatcgccgaaatgaaacgactctatgtggtacccgcctatcgccatcttggaattgcccgcgaattgatttctcggttactcattcaggcccagcatctcgactaccagtccgtccgcctagataccctacccacgatgaccggtgcccaaacactctatcacgccatggggttcgtccctattgacgcctaccggtataacccggtgcctggaaccctttatttagaacatttttttaatccaaaaacacactagcggtacgccaactttcggcgcaccgctagtgttatttaatgacgttttggacatccgccaacgtttgctgcaactcccgatagtcggggacgtgttgctcttcaatgacgtagttcaaaatattagccaacagcgccactaacagtgctttttcaagtggcggcacctcatgtttcacgatttggggcatgtacatcccaataatttcttcgagtcgtttattcagggttagcgcgcccacctgaatactttgtaacgccctcagctcatcttggcgattcacaaataatgcatttagttctggcgtcatggcttccaagatatctttaaaagattgattttcccgactcagctcaagccgcttcttgattacttgctcatacatccgaccaaagttttcaatcatcgtctgcgccagatcgtatttatcggtgtagtgcttataaaacgtgagacggttaatcatggcttcttgggcaatcttggtcacggttaccgattcaaagccatcctcattaaccagcttcacaaaagtggtttggatcgcggtttctgtgcgtttaattcgtaagtcggtcatcttgcttgcctccccaaggcattaatttgggttcattataacacgtgtcgattaaattaacacatgatgatcgtagctgatttacgcaagatcggcgtcaaaatgggcgagcattttgaggagtgcttccttaaatagttgccgatcaatcgacagcagtgccgttacattcttggtctgctgagcgtcttgaataacccgtaaatcggcaatggtctggccctttgcaataccatcgtttgtttcaacatcgacaaccgtctgaatactggtaaacatttcaggattggttaacgccagaaccgcacaaacatcgtgcaacggcatttcatccacacgctgttgcgtaaaataatgcgaataaaaatcgagtagatgatagaccatggtcgtcgctttacccgttccatgacccagtgcccgaatttcatctgccgttaaaaaggccttttccgtcacgtctaggccactcatggtaatcggaataccggcattgaatacgattttggctgcctctggatccgcataaatgttaaattcggccgctggcgtaatatttccgtggtgtagcccaccacccattaatgaaatttcttcaatatttttaacgagctccggcatacttttaatgaccattgccacgttggtaagtggtgccgttgcaatgatggttcgtggtcccgcactaagttctcctcggtaaaaatgcagataatcatggtcaacttggctttgccactgcgtgttctcctgaaattcaaagccgcctaaacctgactgtccatgaatcgcatccccatctccagttgtcgtttgactcgccaacaaggccccactttctccggccaccaatggcacatcccggtgcaggtaacggagcacattaaacgcattatgggtaactttactcaatgattggttgcccgccgtcgtcacaactccggtgacgtcgagatcgtgcgtttgatatagtgccatcatcagggccaagacatcatcatgccccggatcacagtctaagattacatgtttcattcgtattctcgcctccatctttcttcagcgcaagcataccatgtaatcgatttcaaacacaacggatacgattacgataagaaagtcattaaaaaaccaatggacaaatcccactttctcacctatgatgggccatattactcaagaaagtgagattaattcacatgcaactcgtactcgatggctttttaggtctgcttttcttcatttggatcgtccgcatgcaattgcgcacccgcacacttcgacaacgtactaacctgctcttttacgttatcattggcctcatcggcgtcattcaaatcgttaccagcgtccaacatggcaccctcaagctcaatgccctaaccctaagtggactaacgctgttggccgtttttgcgatcacaatggggtttctgcgggccgctaccctagatatttggcaaactaatcaccaatactttcgtaagggcaacctcaaaaccatcggcatgtggctcattacattggcgctccatctgctgatgattcacttcatccacggcacgagttcgacgtccatcgcgtacctgctcctaacgctgctcagccaaaactatgtcttcgcggccaaaatcaaaaaaatatcaccgatgatttagtctattttaacggccccatggtgtgtgaagttgcagcgatcgcgctaatttgttcgtcggtgaactgggataacacctgctgataaggcaggcagtgattagcgtaaaaaaaagggctgggaatttttcccagcctcttaaaattcagttaattaagcttcttcatgtgtggtaactgcggcagtcgtgtcccagttcaacttttgacgggcactgctcttttgttgtgccattgcagcacgcgctgtggcactttgcgcatctgtataattcttggcaatattgctccagctcaagttattgtgcttagcagcagcggagttcttgaacgtcgaaatttcagcattggctgtttgggcagccgcatagtcttttacaaaagtgtgccagctaagcgcactcttatgagaagcctgtgctgtggcaacacgggcgttcgccgtttgtgttgatgtataagcacgcgcaaattctttccaactagcagcactatgctttgattcagctgtcgcaacgcgggcattcgccgtctgagcatccgcgtagttcttggcaaccttatgccaggtgattccatgggcactcgacacatgtgctgttgcaacacgcgcattggccatttgagcatccgcataattcttagcaatgttatgccaagtaaacttctttgaagcagcgatttgagcatccacacccttagccgtttcggtttggatcgaagcagcacactgggtgaacgaagaggcgtttgccgtccccgctaaaccgaataacccaaagctaacagcagccgttgttaataatgcattctttaaactcttcatttcaattctcccctatgccaattaatcattaatttctcttttgactaactcaaactagattcaacattcaggctcacttggaatgttcattttcatgtttcgatcacttgtttcccgaaaaatcttcaagtcatcagccacaaacactagtcttcatcagtttttctcaacggttttatactatagcatcttctaccatccttgtatactagttatttttgctcattcagcttcgttcagtttgtattttgtctagaagtcttgttatatcaatattttttaacaataaaagcggatactaactgtcatttattatttatttcacaaaatcaagatttttgtagaaaacgctttcgaaatcatgtaaccgttttgcaaatgaaagtcggcaatgaaagcttattaatctccgttttcattgtttctttcacgatgcaaaaatagttcgataagtaagcggtttcgtattttaagccgctatctgtctcattaaactgatatacaagtttaataaaaaagaaccacgattcaaatcgcagttccgtcgttattctattcagtaatattgtagcgttcaatctgccagcccgctggcgtaaacaccatcgtcgtcacactaccattctccggcaccgccaatttagccacgttttgatcaccaaacttagccaccatcgttcgaattagcgtaccatgggtgaccaagagaatattgtgctcctgttggtcctcaaataacgctagaccatgccgcagtcgttgccatagttccgtcgtattttccgccgcgtggcggggatcagcttccttcatccagtctcgggccgtttccggactcgtcgcctgcaggatctccgccttacttgtaaatccgtggggctttcccacttgcgcccaagttgcttgtcggtcaaggccctcaaaagacccaaagtttacttcccgaaaatcaggattaatcgtgacgtcagcctgcgcatttgtatgactttggtggacaatctccttcgcggtccgaatcgcacgcatcatgtctgacgcatatacggccgcaaatggtacatcggccaaccgttttcctgctcgagtggcgtcggcgaatcccttatcagtgagcggtgaatccgcccacccctgcatcttttgcatccgattaaaaatcgtttcgccgtgacgtaccaagtacaactttgtcatgttcaacctccacgtgtcatttcgttaccattactcgtctctattctacaatagttaacaaaaaattaaatcccttaaattaatctaaatctcggtttaaattcccacttttcatcgtaaaccgtgttaagctaaccgcacaaatggttgtagcaccacaattaacacccctaaactagctttctaaacaacaactaatttaatcaatttttctccgcaactacatcaactacaatcattaacccccaaaagcaggctatcaccccaagagatagcctgcttttacttgcgccgtgattgcttgagttggggaataaaccgggccgcaaagtggtgcttgtcccgatttttaaggtagagatagccaaacactgaaaaaataacagcccccacaaagttcactgctaagtccttcatcgtgtcaatcagaccaatgtctaaataaccgtgcagggttaccgtccggccgttatctaagagcaccttagtcgttttaatgtgctctaaaatcaccgggttattttgtcccgcaggattcagctttaccgagacaatcttttgaattagggcatccttttgcatgtccatattgaaaaagatgtccatgccaaactcaaaaaattcccacagtaccccaatcgtcatggaaaagcaaaaggccaccatggtcacgaacaccggcgacatctgaatgtagaaccgatcttcacgatttaagatatcgatcatcgaaaacccaatcgcggccgctaaaaatccattaagcacgtgcaggctcatatcccaatatctgaacaacccgtaaaaattatgaatttcgcctaaaatttcggcggcaaagatgaagagtaagaccaccatttctaacgtcactggcagttgaattttggtcgtcttttcaaccgttttaggaatcataaataagatgagggtcagtagacacatgaagagcccctctaggttacctagaaagaactgccgcaccattgttgcgacgacaatcacggccagtatcatgtgcagtcgccagtagggactaatgcgccatcttttccgtcgtttcatctcgtcgcctcccaccattcgtttaccttaatcatagtcgaaagtacccgctatccgttaacgtttcggcttcacgacgcaataatttacccaaattgtatgccttacaatgtaacgattgttgtcaccggcaattgccggtatactaaccgctaacaagtaatcgtcagaccaaccattgagcaggtcgctttcctgaaatacctgcttgatcgaccgtctcgcgtattacttgtgccccctgaaagtgccccccacaccttacatatccgctatcaccgggagtcactttcaattaaaatctgatatggccgccttcgttgacgtacgagggcggccttttgagttattctgccccgaaaaaaagatcaacactcgccaccgtttcagtggcttgcattgatctcattgtctttacaactgcttattcttcaacacgccgttgctcaaattttttaattgcattgtcaaaggtctcggttgcttcaatatcatcgatccccttaaccagccggtccttccaaaaagcattaatctcaaactgggcggtctgccccgcgaacgttaccgtttgttggggtaaatcgatcgtaaccggttgatcggctgggagactcgccaactggtcacactgctcatccgctagtttaacgggcagtaccccattgttaatgcagttcatatagaagatatcattaaaatccttggcgattacggcttgaaatccgtagtctcgcaaggcccacaccgcgtgttcccacgatgatccgtagccaaagttatgtcccgtaatcaaaatttgtgcgccttcatgtttaaaatcattcaatacaaactcgggattcagacgaccatcccctaaatagcgccgattggaaaacaagacatccccgtagttttttctcgtcgtatccttaatcgcttgtttgggtaccaactgatccgtatcgatgttatcatccatgaccgcgacaaccgtactcgtaatctgcccaatcggtttcattagtctgccacctttctaatgtcaataaagtgaccgttgattgctgcataggccaccattgcgggactggctaagtgggttcgggccccgaccccctgacgaccttcaaaattccggttcgtcgttgaagcacagtgtaccccagccggaacttggtcgggattcattcccaagcaagcggaacagcccggttcacgccagtcacatcctgcatccttgaaaatttgatctaaccccagcttttcggccgcgttcttgaccgaccgtgatccaggtaccactagtgcggtcacacccggtgcgatgtggtgccccttcaaaacattcgcagcgactttcaagtctgatagacgcccgttcgtacatgagccgaagaacgcaaattcgattggaatttgttcggccgtctgccccggtttcaatccaatataattgtaagcttttttgtcatcatcattttgaatttcagggaagggacgatcaaccggaacggccattcccggattagttccccaagacacaattggtgccaaggtagtcacgtcaaagtcaatgacccgatcgaagtcatcttcgctatccgtgtatagcgtctgccaatcggcaattgcggcatccatgttcttcggtgcgtacttacggccccgaacatagtcaaaggttgtttgatccggccgaatacttccgtacttggccccaccttcaattgtcatgttacagatgctcatccgctcttccatgctgagcgcttcgatggtatcgccgtagtattcaatcgcgtacccggtcccaaaggccaccccttcacgagcaatcaaaccaagaataatgtccttggcatagacaccgtggggcagcttgccgtgaacatgaacgcccatcgtcttgggcttggtttgccaaatggtttgggtcgccagcacatgttctacttcactggtcccaattccaaatccaatcgaaccaaaggccccgtgggttgccgtgtgcgaatctccgcagacaatcgtcataccgggctgggtcaagccaagttcgggcccgatcacatgcacaataccttgctcgtcactcccgacatccgcaaaccgaatgccaaattctttcgtgttggcacgtaatgtttcaatctgcttacgtgaaatcgcatccttaacgttgaaaatatcctccgtggggacgttatggtccaacgtcgcaaacgtccgctccggactatgcacttttcgatgattttcgcgcagtccctcgaacgcctggggtgatgtcacttcatgtaataattgtaaatcaatatatagtagttgcggttcaccgtcatcgccagcaacaacgtgtcgttgccacaacttatcaaacattgtttgagtcacttgacttcctccttcaatggatccacctaagcgagattaatttccattactatccgatatattctcttactgtcagtatatcggagcaccggtaaaaatcaagacccttaatcatttttcctagaatgattctaaaaaagattattatttaatcatattcatcagtatcccgataaaatcgcattgtattccgtaagaatcccttttcaaggtctcttttacaggttagattcccctgataattctaatctagtgattattcatcataattgatgtcaattccccaaaatccattgacaatcactggttcgattactaccatttgtaacagtactcaagatacatagtttttatcaaattcagtgaaacggacgtggtgaacagatggtcaaaagatacgacagcacaaaaattaacgacttaatttacaacatttatcaggcatacggcttttccgacgcgcaaagtcatcaagttgccgacatgttagtctacaccgacttgcatgggattgaatcacacggagtccaacggttggtcatgtacgaccactttattcaaaacgggaagattcgggtcaacagtaagccggaaatcgttaaggaaaccgacgtcagtgccgttgtcgacgcccacttcggcctcggtcaattgaatggcatttatagcatgaacattgccattcaaaaagcacaaaagcatggcattgggatcgtcacaacccgtaattctggccactacggcattgcgggctactacgctaacatggccgcagaattaggcttaatggggatgtcatcatgtaactcccgccccgcgatgctgccaacccacgcgacaaaggcactagtcggcaccaaccccatttcatttgccatgcccgccaaaccacacacctttatttttgacgctgctaccaccacggtgccacaaggcaaaattgaggtctaccgtaaactggaaaaagacctgccagccctgtgggtcgccaaaaacggagaagagcccgtttacgaccacaccgatgataccgactttgatctgcttcgagatcccgatgctaacgtcgggttggcgccgttaggcggtgtcaccgaagataccggatcccataagggctttgggttgggagtcatcgttgaagtcttcacctcaatcctatcgttaggcaacgtctcaaacgaaatcacccctgaggatctctccgtcgggccgtgccaaagtttcgtggccattgatcccgctatttttggtgacaaggacgcgatcatcgacaagttctcgcggtatctgcaagatattcgctcattacccgccgtccccggcaaaacgatctacgtcgccggcgataaagaagccctcgcctacgaagaaaatcggcaactcggcattcaaattgacgaccgcaccctcgaagaagtcgaatcaattgccagtcgcctgaacgttgactacgcgccctacatttaatatcaattatgaagttaccaaaaggccccaccggattaaattccagtggggcctttttcagatacgcttatttagcagtaccatactttgcttggatgtcttgggcctgttgtaagaccttatccatctgaccattcttttgcatcttagtaattgtcttgttgacctgcttcattaacttcttatcgcctttccggccggccgcactcaagtgttgatcagcttttggcgtcttcagttgcaatttggccttcgcatacttatcagggtagttcttgacgtagttatcggcgatttcactttcaaccacgaccccatctagcttgccggcttgtaattcggtcgtcaaactcgtaaccaatccttcagtaaccacgtttccgctcgtttgggccttagcaatatcttcttgcgttgatgcctgttgggccccaatttgagcgttcttggtatccgccttggtgttgaacttgttagcatcagctttccgaactagcaggtagttgttcaccgtgtaatagctctttgaaaatgctacttgtttttcacgggccggtgtatcggtcattcctgacaaaatcaaatcaattttgtcacccttcaaatccgaaatcaacgatgaaaattcagtgttttcaattttaagcttcacacccatatcctcagcaatttgtttagcaatcagaatatcatacccggtaatttgctttttaccattcttgacaatcggaaattcaaacggggcataatcggccgatgtcccaacaactaacgtccccttatccttaaccttttgtaagctagtgtcctgatccttgctaccacacccagctaggcccactgacagcaccatcaccagtcccattgcgaccaaccaactttttttaatccattttttcataccattgcctccctagcagtcatccatctatttcgcatatttattcaattcaccaattaatggttattagtcttattactgctacatcagcgattaataaatcatttgcaaaatattgtatgtataaatttactttttatgttgaagctatcataatcccatttatgaataaaatcaagatattttttgaatttattgcataattattcttaaaaatcgttaaagtgccgttttccattcaaaaaccaagcctcagccgcatagaaaaacgcccctttaagttagtaggctaacttaaaaggacgttcgatttaatttgcttataagtcaattaggtgtagttgcagggctttagcaaccgcctccgcccgggagaagacgcccaatttattgtagatactcgtcaaatgtgccttaaccgtgcgctcactgaccccaattgtttcagcaatttctttactatgaaagccttgagcaacctggcggagcacatcgtattcacggggcgttaacacgatctcgttggtcgtggcgctggttgtaaaggcctttcccgcaatgcttggttctagatacgtctcccccttcatcgctccccgaatcgtcttcagaatcgttgcttgatccgcatccttcaacaaaaagccgcgcgcaccgagttgcatcgcctgttgaatggggcgctgatcgtcaaacgttgtcagcacaacgactggtaggttgggagtggtctggtggagctgcttaattagttcaatgccatccatctcgggcatccgaatatccgttaagacgaggtccggctgcaacttggtaatctgcgctaaccccgtcaccccattgtcagccgtcccaagcaccgcaatatcatccatcgtttcaaacatcaattccagtccggcacgaatgatctgatgatcgtccacaatgactagcttaatcatgctaactcctttctggtcgtcggcaacgtcaaggtcaccgtcgttccctcgtcttccgcgctaatcacggttaacacaccgcctaggcgatcagcacgttcctgcaagccttgcaggccgaaatgccccgccttcttatacttcacaaaattcttcatatcaaatccccgaccaaaatcgatcaccttgagtttgaaaatctggtcgtgacagtcgccctgaattagtgcttgatccgtttgtgcatgcttagcaacgttcgccagtgcctcggtcacaattcgcgtaatttcagtcagctgctccggcgaataatccggcacctgattcaaatgcacatcaactttcaaatggtaatttttgtccaccgcctgagaaactaattgtagtcgcgccggcaggctttcttccgtcgtcgcccgtaaatccgtcagggtggttcgcgactcgtgcaaggtgtgtcgcgcatcttgaatcgtgttgacgacaatttcctcggcccgtgctggatcaccctttaataagaaactatccgttgcttccagttgcatcacgatgccggctagtccctgcgtcaaggtatcatgaagttcccgagctacccgctggcgttccgcccgtaccgctgattcttcaacttgcgaataagccagttgcaattcactatataaatcctctagctgctgggtcttcttgacttgatcacggtaaaagctccaataatacatcacaattgccatcaagaacgcaaatgcctgaatcactaccagcccatgtaaccaacccacgtacaacgcatatacacccagcaatatcgcgtaaataaacgtaatcggccaaaaaatcagtcgggaacgttgtcgatcgtcgtcataaataatgatcgcttcgatcataaaaacaggataggttccggccaaaataacgggcgcccctcggttaaacaacacggtataaatgctgactaggatcatcggaatcccaatcaccaaccacggatgccagcgataaatgcgagggctaaaccagatactggcaataatactgagcactgatgtaagtacaactgccggatctaaaaagccatgatgacgtgcctgagcattaatcagagtgatatgaactaagcccgtgcccttaatcgtcgacatcacaaaaatggcggtaaacccaatcatgaccatccaaatgatgaggggaatccgggccgtcgttaatgtctgtaaaattcgctgattattacgcttcatagttgtactcctataacttattgatagaatcatacatcaaaaactcgtgaggatgggggctctcacgagttttttaatgaattctaatctgcggctaatgcatcgattggattgagtttggctgcgctacgggccggtaggaaagcggccagcaacgcgatcacaacggcaatcacgaaggttgtcacaacgtttgtcaacgaaatttgaacaaacgcgtaattatcgaccgacgataatagttgattggttaccgtctgcccgataaaggcaatcgccgtggctaagatcgcactcgccaccccgataatcagggattcactgataaacaggcgccgaatatcccgtttactttgtccaagtgctcgtaaaatcccaatttccttggtccgcgaactgactgacatatacatcgtcacaataatcatcaatgcggaaacgacgagtgaaatggaggcgatcgctgccaatacatcggtggccaacttcacgtaggtctggatcgtactgatcatcgattgaacggatgttgcactgtaaacccgcttttggttagtcttcaactgattaatcttcttcgttaccgactttacgttgtcgagatgatcgatcttaacagcgaggctagaggccgtcgtatccacgttggcgttcttcatcgcggtcgctaacgtggttccaccaacgtaattatcactcatcacccctgctctatccttagttgttgaaataccagaaactttggccttaaaggttaccgttaccatcttgttatccttgttcagggtcttgtatgacaacttaatcgtcttgccaatcaagctcttccagtgcttgctagaaatctttttagccacactgtcacggtcaatcaccacttcacctttgccaggcttgctcccgtacttaacggtattgctggtatcgctggccgtccagttcgtcagtgacgagatggtggctgagtgaccattatacttcgttgctacactgctagcggtgtaaactttgtccacttgtttaacgtgggccacctgttctagacgtttgatctgtttatttgaaaatgagattttcgtacttgccgtcccactcgtcgccgtagtggcgcccgtttgttgggccgcggccgcctgctgctggcttccctgcgatttcttctggtaacgactcaccgtgataacctgaggatttaccatgtcattaacctgcttattgatataaccactgatcccattacccagtccagaaaacaagatcaccgcaaacaggccaatcgatgtccctaaaacgatcagaaaattacgccaaaaattaaacttaaagtgtttaaaagccgttttgtaggcgacactggccggcagtagccgtgattctaatcgttcaacattggccacttcatacggatcgcgcaaatgctcatcatggtcaatctttccgttttccatgtggacgattcgcgtgccggcatcggccaccgactgtgaatgggtgacggtgatgactaaccggccctcttccgcaatttcgtttaagagttgcaacacttcttcggtgttttgcgcgtctaacgcgcccgtcggttcgtccgcaatcacgatcttgggatcactggcgagtgcccgggcaattgccacccgttgtttttggccgcccgaaagctgactgggatacttgtgcgcctgttcgcctaagccaacccgtttaagaagatccagcgcccgcttttcgcgttgttccttattcaaggtggtcatatcaagagaaatcaaaacgttatcgatcactcttaggtgactaatgaggttataagcctgataaatgtatcccaccgtatctcggcgatacgtatcaagggctttttcgttcttgtgatccaatttatgcccatcaacactaacactgccttggaattcccgatccagaccgccaataatgttcatcaatgtcgacttaccaccgccggattccccaaggattgacacaaactcgcctaaattaaagtcgagatcaatgcccttgagaaccggaaattcttctttgcctaaataatatgatttatgaatatcgcgtagttctaagtaactcatgctttctccctccgaaccgggacttactcgtaacggcccaaacattaactactaattccgtgcccgacgattagtagttaatgttcaaggcgttagcgcgtgtcccaatctgatgacactagcatacctgtcattgccacgccccacatcgaccattcgtacatcaaattactgcccgtttgggcaatttagcccccttgattaagcgacgacacaaaaaaagcacgtcaaccctctaatttaatagaagactgacgcacctttaatctagtttttaacgaacccggcccttaggattaatgcctaaggtaatgcggcccactcgactaatcatcgataactgccacactggttcccaaacaattttggtagtcacttgacgaatgccatcaatcttggcaagcgactcgcgaatcgccttcggaacatcctcgctacatgcgcaacccatttctgaaaacgtcatcgtaacctcacagtcaccggcctcgtcaatatcaatcccgtaaatgaagcctaaattatagacatcaagccccagatcgggctcaaaaatatgttcaagctgctcgacaatctgctcatcgaaatcggcaacccggtcgttaaccgcgatactttcacgcatgttactcaatccttccgtctctaaaaatgaattatgtattagaatgctattttgaaatccccgacgattaccaagcacgatcatccggtcccgcaccagcattcattaaactgaaactattgatataagtattaccgatcttcaggcttccagaaatcagtaatggcacccttagcagaactagataccaagtgcgcatacttaccaagcaccccacgagaatacagtggtggaatggtcgtttctgctttccgcttagctaattcttcatcagagactttcatcgttaattccttcgtatcaagatcgatcaccactgtatcgccagtatgtagataagcaatattcccaccatcttgagcttcaggtgcgatatgaccaataaccaatccatgagaaccaccggagaaacgaccgtcagtcatcaacgccacagtttcgccttgtcctttaccaaccaacataccagaaagtgatagcatttcaggcattcctgggccaccctttggtccttggtaacgaacaacgagcacatcgccatcaacgacttcgtcagccaagaccgcatcaacggctgcttcttcggtatcaaagactttagcaggtccttcatgatgacgaactttaacgccagaaaccttgatgacggcgccttcgtctgccagattaccatgcaaaatgatcaatggaccatcttcacgtttaggatgttcaagtggcataatgatcttttgaccttctgctaaatctggtgcttcggcgaggttttcagctactgttttaccagtcactgtcatgcattcgccgtggatgtaaccattttgccagagatacttcataacggctgagacaccaccaacgttggacaagtctttgaacacgtacttgccactaggcttcaagtcagctaaatgcggtacctttgcttggaacgtgttgaaatcatcgatggtcatttcaacgttagctgcatgggcaattgccaataaatgcaaaactgagttggttgatccaccgagtgccatgatcaccgtcagggcgttttcaaaggcttcacgtgtcaagatatccttagggtaaatgccctttttcagcaagttcaaaactgcttcgccggctttttcaacatcttcgcgtttttcttttgaatcgccaggatgtgaggctgaaccaggtaagctcatccccatggcttcaattgcggaggccatcgtgttggcagtatacatcccaccacaggcgccaggtccaggacatgcattacgttcaatggccgtcacttcttcttccggaatgtcgccgttgttccattgaccaaccgcttcaaagacggacactaagtcgatatccttaccatctaatgttccgggtgaaattgtgcccccatacacgaagattgcaggaatatcagcgttagccatcgcaattaagctaccaggcatgttcttgtcacagccaccaattgccacaaaggcgtcacagttatgaccgccaaccgctgcttccatcgaatcagcgatgatatcacgtgatggtaatgaataccgcatcccctgggttcccattgagatcccgtcagacaccgtgatcgtcccgaattgtactggccagccacccgctgttttgacaccttccttggccttaccaccaagttcaccaagatgcatgttacaaggggtgttttcagcccaagtactgatgacaccaacgattggtttcttgaaatcatcgtcttgcatcccagtcgcgcgcatcatcgcacggttaggggctttgacaatgccatcgtaaacatgacttttaattctaagatcttttttatcagtcacttcgaaatgctcctttcaaataataaattaaattagcccttttctcatgctaatttaataacattctaacataaatccgtcatattttaacattaattttaagttatatggaagattaaggcgttgttatccaacaactgggcccccttggtcgtcaacttaaccagcctattcatcatggttacgactaacagttcaattaagcttaaccacgctcacctaattttaatttcaggcagcttcctcatttaattaatcggcctgtctccacgcaacgcttaatgttaaaataaacctactattaactgacgaggtgctgtaaaaatggactacccaattctcctgtttgatatcgataacaccctcctagatacccacgccaacgaaaaaaatgccttgattaagctttgtgcccagcgccaatttccactcactgcggcaggcattgattactatcacgccctcaacgagcgactttggaatcagtttgagcgccaagaaattacgcggcagaccttgctcgatcaccggtttcagctcttcttcgcccacttcggggttacggttgatggtccggctacccaagaccagttcgggactttctttcaccgtgaatttcaacttgttccccatgcggaggcgtcgctaaaacaactcgcatctcatcaccagctctgtatcatttctaacggtaccaaggctaaacaaaccgctcagatgcatggtgccaaccttgatcactacttcgaacacgtctttttgtccgaagatctggggtaccgtaagccagatccccgcttcttcgatgacattcgccagaccctaccaaatgcaacggaccggcagatgctcgtcatcggagattcactcaccgcggatattgcgggcgccaaccagtcccacttggacagtgtttggttcaatcccacccaattgccaaatcaaacagcgtacgtgccaacttatgaaatccaagacctcctcgaaatcacaactttgcttcagtaaaacccacaacagggatcacaaccgcatcattgcggtgtgatccctgtttaatattgtatggattacaatttaaagattgtatgcttttggaaaccattctatactaattgccattgaaaggaggcgttaattaatcaacgggcctgcttgctgtttcaacgccaacaaatcgtgtttgagtgtaaccagtgacgatccagacgcaagcgaaatacgcaaatagtttggctgactagtcgcatccccgacgataaagcgatcagagtgaaacacccgaatatgattggccaacatttctgcctcaaactgttgcccattaacccgttggcgaagcggtagccaacggaaaaacgtatacggattatggggaactggttgctggtcgaagacctgatcaaacactaggttagcctgcaacgcaagctgctttttcatttcgattagccggtacgctaccccggataagatactattcgtaatcacctcaacatcgagcgacgaggttttaacggtgatgttaaacaatgcccgcaaaatttgttccttataggcgggcgcaaatagcatgtacgccacccgcaaacccgatgaaattgattttgacagactacatacatagatactatgtgccggtgtgagtgcgctcaccggtgcatcctgctggttgcttcccagatacgtaaacccgagatagtcgtcctcaattaaaattagttcgtaccggttaattaactgcgcaattttttgacgacgagcggccgtcatataagtagtggtcggattagcgccgttcggcatcaggtaaattcccttaatgccctgtaacttgcaagcggcaagtaacgcctgatcactcattccctgctcatccccagcgatgggtaccaaccgaagatggtgcagaattgccaactcaataaagttagcatatgtaaattcatctactgcgattcgatctcctggctcaaacattgccagtaccgcaaccgccagcgcgttttgaccaccggaagcaatcgccagattttccacgcttcccgtcatcttcatccgtttcaaaaatgacagccccgcgagcttttgcttcaaacttcccgtttgctcatcatagttcaatagttgtgaaatatccgtcgtcttgacggtttgctcgaccaccttggcgaccaaatcattacacgattcgaacgatgaattaaaccccagctcgatcatttccttcgagctcggctgactcgcaatggtaatcggcagcgtcgcgttggacgccacaaacgtccccttacccacaatcccataagtcagtcccttatgttcgctaatcttataaactcgcgtaatggtggtgaagttcacatccaagaaatcggctagctcacgttgcggggggagcttggttcccggtggcaggctgccatccgcaatgtcttgttctaactgctgtgacagcgactggtagatcggtcgtttgagtcgacgacggtctggcttccaggtcagtacgtaatcgttaaacgaattaatcggcatctcattacccccttctatttaaattatcaaccattctatcatacttattccattaaccaaggaggaaaattacatgacaccacaccaagttcgatggcgagcctttaaagctgccgtcccgtatacgcttcctattttagctggatttgcatttcttgggcttacctacgggatctatatgcaccaatccggattcaattttatctatcccatgctcatgagcctcactatttttgccgggtccgccgagttcatcgttgccaatctgcttttacaagctttcaatcccgtcggcgtctttttcattacactcattatcaattcacgacatctgttctatggcctgtcgatgctcgatcgctatcgccataccggctggaaaaaaccttatctcatctttggaatgtgtgacgaatcgttttcaatcaactataccgcaaccattcctgatggtgtcgatcgtggttggttcatgttttttgtgaccgcactcaatcaatcttattgggtcggtggtgcaacccttggcggcctatttgggagcgcgattcccacccacatcaagggcctcgactttgtcatgaccgccttatttatcgttttgtgtatcaatcaattacgccatgaaagtaatcacctaagttctaaggctggggccatccttgcgattattatgcttctgatcgtaggtcaaacctacttcattcccgccactatgatcttagtcattctcgtctttacaatcgtttaccgtcgaaaggagcttactgatgaccatcattgaacaaatcatcaccgttagtatggcggtgttagcaaccgttcttactcgctttttacccttcctaattttccccggcaatcgccaaacgccccgctttattcagcaacttggtaccttcttaccaggcgccattatggcaatgctcgtcgtatactgctataaagatcttaactttggtaccccatcaggttacgttccagccatcattgcgggcctcgttactgctggattacatctttggaaaaataacatgtttctttcaatcgccgtcggtactgttttgtacatggcactagtaaactaaaaggttggcatttatcacatgccaaccttttctttgtctatttcgtttttattgcccgatatttcagtaactgcgtcatcatctcgtcaatcgtggtgcaacttacccagccgaaaatttctatctacgcttcatcaaccaaatattccggatggcactttcccgaacgggcatccttgattttttgatccagcactttttcggtattctcgagttctgcaatttgatcatgcagtcgttgctttgtctgttgaagacgattcaagtattcatccagcgtcaagtggccgtcaaagacctcctcgatttctttcagcgtcaatcctgcacagcggtaacaacgaatcatttctagtcgctccaatgcgttatgatcaaaatcacgaacaccatttccatcccgtttaacatttaggagccccttcttttcgtaaaaacgaatcgaataggcatttacgtgtgataccttttctgcatctttaattttcatttattgtgcctccgtaatcatacttcgacttagtctaaggtttcggttatgacttgtcaactttcatcgtttgacaggcggttgattgggtgtcttgcaccgtttagtgcacaggcaaaagaagggctcctcatgctcaaagtgaatcgtaaggtcagcaatcaacacgctcgtaagctgttggactggacaccgctcagtaataatgacgcgaccatcttgcaaaccgtcgacaccttggtgaaccgccatttaatttaataacttcaacttgcattacctcccgattctgctaaaatagcatcaacgatctgatagcgagttttcataaattcgtcatgttactagcggggctactgctaggcgagaacgcctagtttgtagtcccttttttgattctattatggaggagtcctttaccttgaataagtcacaatccaaattatcatttaccgttgccctcattttaattgccaccaacttacgaatggctattattagtattcccccgcttaccagcattctggaaaaagggctccatatgagtcagccccagatcggcatgctgacctcaattccgctgatctgcttcgggatcttttccgtgatcattggtgccctcgcccaaaaatggaacgtcaaagtgcttatcgcaagttttctcgccctcctgatggttttcaacttcttgcgggtctacaatcaaactctgctatacattggcacctttgccgtggggctttcgatcaccgccctgaacgttttgattccggttatcgtgcttcaaagtggtcgcaccgatacgaaccggctcaacggcatttataccgcaactttcaacgtttgcgcggccattgtcagtctgatcatcgtaccactcgcacacctcatcagctggcaaatcgccattcagctattatcattaccagccctaattgcactcatcggctggacaatgacaccccaaaatcatcaaccagcaccagctcacacggcacaacctctatggcaccgctacgggcacttcatcacgacacggcaggtgtggtttttaaccttctttttcggatttcaatccctcattttctacgtcacttccgcatggttacccagtatcatgaccagtcacggcatgtctagcacactggcggggatcttctttggtattttccaattcatcggcgtgcccgcatcctactttgcacctcagctaatgaactctcgcgaacaacttcaccggatgttttggctcatcgggattggctacctactgggatttgcactcttagcgctcaataccggtcgaatcaccgatctgctcgcctgcctgtcactcggcattacgagctcggccagctttgcgatggctctaaccctcatcaccatggtctcccccaccccacaagacgctggtgtgatcggtggcatcgttcaatcctgtggttatctgattgccagcagtggcccgctactggccggtattatgattaaatcgctaggaaactggcttttgattcttggcgttcttggagtgattgccattctgcttctcacgatgggcctgtcacttgtgcgtaatgtcgatacattcaactaacacagaaggttaaaaataatgaatcttaaatacttacgtactattcaaactatttatcaaacaggtagttttcaaaaagctgcaaatgctcttaactatgctccctcgaccgttacttttcaggttcagcaagttgaaaaacaattacaattgcaacttttcactaaacatggccgtcgaatgttactaacttcagccggacaaaaaattcttccattaattgaacaactactagatgatgctgacgctctgtcaacctttcataattcagatgattcaattcagggcacactatcaattgctgtacctgaatcattgcttacttatcaattacaaccagtcctacaggcctttaaaaagcaggcaccgcatgttgcattaacaattaaagtgcttaattgttatgatatttttgcacaaatggttgatcacaatgttgatcttgcgattcactacgacgtccgtcagtattccaccaatattcatacttggcctctcaaaacctatccactaacattagtgggatcaccacaactatctctcactgagcaagactttattacgccacaccaaagtaaattaatctgtcaaattcaaaacgaccctcacgcccgctatctagaaatctttaatcaatatctccgtaatcgccagatttctttagcaccacctcttgaactatggagcattgaatccatcaaacaaagtgtcattagcaatctaggcgttgctttcttaccaacatttacagtagctacggaacttgaaagcaatcagttagtttctctgcataccgaaattagtcaaccaactcttaccgcaattgctgcaattgaccaaaatcagccacaatccgaggcacaaaaattgtttattaaaattcttaatcaattttcattacgaaatcgctagcttcaatttttttgaaattataatgcgaaaagttcaactttttatatctaagtcaatgccatatactctttgtatcacgtacaaaggagatatattaatgcacattcagccctacaaatctaatccacaacatttagcacaattagtcgatttgattaactattgtcaaaataccgaagcccacctatccattaaaatggcggagcaatccgatatttttgatattaattcatattaccaaaaccctggtggccaattctggattgctcttgataaaaatcaagtagtcggttcaatcgcattgcttgttttaaatccgcacactgccgtacttaaaaaattttttgcttatccccaataccgaggtcagccgcaccatcttggtcgtcaactttatcaacaattattgacctttgcttcccaaagtcacatcaccagaattgtactcgatactccagaagacgaaattcgatcgcattacttttacgaacatcacggatttcaccaaattgatggttcagagttacaacattcatacgtttatcccgatcgaaactcgcgattctatgagcttattttataatctctattcgaagagcattaacatttacacattatcctggttgatgctatgatcggcctatccccaaagaggaggtgccgtgcatggcagaagattttgatcaacaaaaacaacagctctcgcaacttcaatatgatgttacccagcacgcagccacggaaaggccattcagtggtcagtacgatcaatttgatgaacccggcatttacgtcgatgtggtcagcggtgaacctttgttttcatcgacggacaaatacgacgccggatgcggctggccatcctttaccaagccgattacgccactaacaacccactccgatcatcagctcatcatgccgcgtaccgaggttcggagtccccaagcaaactcccacctgggtcacgtcttcgatgatggccccactgctgccggtggattgcgctactgcatcaactcggcagcactccggttcatcccccgtgaccagcttgacgcagccggttactcggcctaccgtactttattcgatgactaattttatcaaaagggactgagaaaaaattctcagtcccttttttaggtttacagaaatcagatggcatccagttgccatcttcatgttcacttttgtttcttgcgtagtagttccatcattttaacaatatcattagcgggcgtactcgtttctttcaatttcagcgtgggaaagcttcgcaaaagccggcgttgcacataatttaatcgcaggccccgccgagtttcatccgagctattccggtatgcttccaaccagttacgatcttgatccaatttcgtactttcgtcagccaagcgttcccgtagctccagcttctttgcctcgatggtatccccaatccgtttagtggcggccccaaacgccattgcattcgctaccgtaaacccacagtcaaacatcaaaatggcgatcagaacaattcccgcaaacagcccgtacgtcgttgataggtgcaagacaacctgcgatatcaatggatgaatccacttaacgattacgaccaccccgaatccccaaaacagtgagattggcagggctacccgaccgtttagattcagcggaatctgactataatcccaccaccgggcgtgaaagagtttttccatcaaccagcttgtgacgtattcaattaccgtgatgagcagggcactgagaacatacagcaccaccacgttattttcaaacggttcgataaccgccagaacggccatcatactaaagccgtataccggtaccaccgggccaatcagaaagcccgaatttgtccaacggcgtttgcgcacactaacatagccgctttcccataaccatcccacaaaagcataggcaaaaaaatatagaatccagacggcaaattgctgttcgagcactgatacctgaaactgttgcatggtcacgtcctccccttttttctaatatagcacaaacaaataccccctaccaacgacaattcacatcgttaataggggggattcagatcaagttaaccaacgttttgtttgatctcgtctagtaaagcgtccatttcttcgggttcatcgtcacagtcaaacaaagcggcgtgatactgatcacgaatgggatccttgatgtccgcaaacttagactcaaatttgtgcgtttcgtaggtgccatctggctgaattgataaaattacacactgtggtgcttcctttttcttgtgcgtgaacgtaattggaaagacacagggcttgaaattgatgtcttttcgatcctgtttacgctccaataaaatgctcgtaatgttactgacaatcatctcgcgtgtcattaattcgtacctcgatttttagattgatcgactgaaacgactaaagcgtttattatcgctaaacactttaatcaaccaattaataacttaacacacttcgcgatcaaccttcaatacacactcacaattgtcatcaaacagttaattggccacctgttttgtcagcgtctgacagtccacgccatcttcctgatacaccgcagagctggggcggtaccccaacgtctggtaaaagcccttcgctgttaattccgaatggatgatcaacgtttgcttgccatcctgacgagcctgatcttccagtgcttgaatgacttgggctcccaaatgttgaccacggtacgctgccagcgttgcaattcgcgtcaggcgggcctgatcagcatcgattggtaaatagcgaccggtggccaccggctgatcgcccgcgaaaataaccgcatacgtggtcccatcccgatccgcttgatcaaattcatcatcaatggccagcccccgctctaacacaaacacctgcatgcgaacataacagctcgccgcacgatgccaattttgatttccaatcactcgtttcatctgcatctcatcacaaccatctttttgatagtagtatactgcagcattgttgcaataacaacattatcttgttacttattctgggcgagaatttgtgctagatcttgatactgggacaacatccactgcttgtacgtcatattggcaggtaaggtttccgttacttttaacaccggaatatcgttttgcttggctaatgtcacaaaattgcgcaccgtcttgctcgaaacttgcttgttatccacaaagaaggcaatcttacgggccttaatcccatcttgcatcgcatggatggctttcggcgacggatcggttcccttttccacggcctcttcaaacgagtgattgcccacgtggtaccctaacgcctgaatggcgtagtcaaacactggttcactgacatacacttcgcgagttgcttgctgtgcacggttctgcttcaactgcttaatttgctgattgacaggctttaacgattgaatataccgtttggcatttcgctggaaataagcctttgattttggttgaactttccctaattcggtggctaagtatgtggcatacttcgccattgtggttggctgataccagatatgcggattcgcacccgtctttttattgaggacgtcttcaccgacccgaatgtactcactatgatggctattccgggttagcttagtcatccatgcatcgtagttgagaccattggccacgacaaggtcagccttgctgacttcactcgccaccttggttgtcggttcgtaatcgtgcggatcaaccgcgggattatgaatgactgcggtcaccgttccccgattgccgacaacggctttcgcgacttcaccataaaaatcggtggtcgtcaccacccgaattttacgattagtaacctgcgttactcctttatcagtcgtctgaccacagccggccgcgacgactcccaacatgacaacggccacaagggccaataaaattttgcgaaacttgactaaaatcatgatcactcctaattatttgattttgagttgcgcgcaatatttaccatacacgacccacctaaaaatgtaaatagtaattattactatttaataagagcgttcatttaaattaaaaagaacacgccatccatcacggataacgtgttcctcatttgtttaattgggcttaaataccgattccattttgaaacagttgctgatacagggctaattcgtccttcgtctgccggctgctcataaattcaatttgctgtgggttgtgatcctgccggagtagctgacgctcatccaactgcttaatcaggttatggccgaggccctcataccccgtaaacaaggtgaccggttgggcaaaccgttgggccaccaattggccaataaatgggtagtgtgtacatcccagcaccaccgcatcaatcggttgatcgcgataaggcgccaataattcatccagccgggcgttaattcggtcaaggccgtcatgaccctgctccaccaaatccgccagaccagcacaagggagtgaatgaatcattgtctgatccttgaaacgatcaacttgggcgcgatacttcggtaaactgatcgtgagcggtgtccccatgaccaaaatattgtgtttaccggcatcgacggccatctttaaagcgggctcaattcctaaaattggcatttccggatattgggtcatcatctgactcttagcggcactggtcgcggtattgcaggcaatcacgatggctttcacatcgcgctgtcgtaactgctcgatcaccgcactggttaagtgttgcacggtggcggcgtccttttcgccgtagggggcgttagcagaatcgccgtaaaaaataaagttttcgtttggtaacatccgcgttaatgttctcagggtactaattccaccgacccctgaatcaagaacaccaatcgctgcttgttggcttaccatgtctattcctcctcgtataactttcagcacagaggttgaaggtcatgactccatttgacaagaatgcttcaatcatccttgcgacgagttctcgaagtgaatattataccgcacttaaccattattttcattactttacttcgtcgacttagcagccagccaagcaaccacaaaatcatacagcgggcgacttaggttagcgtattccaccgccgaacgaaagtctgcactcaccatgtcttcgtcttgccccaacattagtttttggacccagttcggatccatgatgagctgccgcgcaacggcgactaaatcagcggtctgcaaaacttcgttgacgtcatcgcgggttcgcaccccaccgactccgataagtggtttacgacccgcaatcgcttccgccacgtattctaacaatggtttgtcgcgatactgtgggtcaattgacacatgccgatgatccactaacgatagatgcagataatccaagcgggtctgtacgagctgctcgatcaaaaacttggtatcgtcaaaggaaattccgggtgtggaatactcttccggcgaaaaccgatagccaaccgcaaatggccgcttcgcatattgatcgacggttgccaaaacttcatcaatcacttcaccgataaaccggtagcggttctctaaactaccaccgtattcgtcggtccgccggttagaatgtggtgaaaagaattgctggaaaagatacatattcgcaccatgaatttccacgccgtcaaacccggcttcaattacacgccgagtgccctcaccaaaggccttcaccgtctcatgaatttcagctagcgtcatttcccggggaatgggcgctggcgccttgggatcacgatgctgaactggtacagcacttggggcgatcggttggtgatccgccagtgcggctggatcactcatgcgaccaccgtgatagatttgcacaatcgctttggccccttgattttgaatggcactagctaactgctttaattcgggtaagtactgatccccggctatactgagttcaccgggccagcccttccctgcatctaggacgttagccgatccggtaataatggcacccacgcccttcgcgcgttgtgcgtagtaacgaatctcatcttgcgtcaccgtcccgttagtaaagctctgcaccgttgtcacgggcgacatcacaatccggttacgcaacgtcacaccggagttaaaggtcatctgctctgtaaatttagtcattggttgcctccaaattatttttttgcgatgacgctatcctaaccccttagagtaagtctaagtcaatagtattcactcactttttattagtaatttagtcaaggcgtttcagggggcagtctcaataatcgacttaatgcgtaataagttatacaataagggtgtacgtcgttaagggtgatgacccagctttgccggctgccatctaacctgattttgtagaaagaaggactatgcatggcaaaaaatcaacaaatgggcactaataccagtctctataaaccgaatgaagttaacgaaaagtaccacgatggtgaagaaaccctcttttactctagtctgactaaaaagaccgctaaaggggtcatcaaaaagcggtacgaacacgcctgtctgattgatttttccgattccaaaaagctttccagtgccatcaaagatgagctaaattccaaaattattgttagctatcaggcactgaaaccacttcaataatgatttgatcctctaaagggtgtgatttaacttaagtcacacccttttttcaaccttttatcatgttatcatcccattagtgggcttataatagccttattacttctcaacggagcgtctgtcatggataccaagctactcaccatttcctacctgtcttccctcgtggccaattgcattgtgctattgggaatcacatcactttttatctggatcaaagaaaacgtgcaaaccccttggattgcacgccatcgtgatctttttttagtttgttttggtctactattcatcctctttttgttcagtgaggcatggaccaacgcccatatgtcgaccgtctttatcggcgatcactggacctacctgaaccttgaaatcattgccctcttcaacctaaccgtcatcaatcgttcagaatggcagcttgtcagtaccattggtatcaccatcatctggtattttgccaacgctcccacatacagccttcaactgattacccaagtggccggtttagtcatcttggaaattatcgtctttaaactacaacgccagttactagcccatgtgtttttgtacagcacggtatttgttgcggtcgccggattagcccttatcgtgactaatcagatttatcgacaacaagacctcatcgcctggatgcggcaaatcggggccctcgtcattctcgaagcctgctgtgcgatttacggggcatcccttctcaagcgtgctcaacaagaacgagactatgagcaccttgccaagtacgacgaattgactaacctgcgtaactttggtgcgttcactaccgatctcgaacaggtttatcaaaatttcgtcacccacgatgtccactatgcagtctataccatggacattgaccggttcaaatcaatcaacgacacctatggtcatttcgcgggcaatgaggtgttgacggccgtcgcacagtccctacacgatctttcttgtaacctcgaaggcaccgctcacgcctaccgcaccggtggcgaagaatttaccatcatctacgtgagtgcggcacaagataaccatgaggctcagctcatttcacaggccattcaaacccagattggtcagttacaatttcagtttacgactgatctaaaaattcgggtttcaattggtgaagaacccgtccgcgttggtgacgataactatctcgatacttacaagcgcgcggataaatcgctatatacctccaagagaagtggccgcaacgccgtcaccattaacggcgaaacgaacgctccagccactccccacctttaatgtaagacttggatcaaaatccagccaatcattccgacgagcccgaaaatagcccaccaaaatcgagctaaaaagtcccacccattcatttgaccgtaacgtcgtgtagatagtccggtggttggattaacggtgaactggtcgtgatcagatgacgccggttcaatgccacggactagggtatccaaattaacgttcaaaatatcagctaacttcactaggttattcaggtcaggggtcgcatccccttgttcccattttgaaactgcctgccgtgatacaaataattgacttgctaaagcatcttgcgacagcccttgggcttcgcggtgcttttttaattgggcagcaaatgctaacatgctcatccctcctttggtttaacttcagcatgccggaatccgcagcatttgacaagcaattcaggccgtttgggccgcactattctaccgtgccttgcgcaaccggtagtagcaactacgtgtctaagccttgattgaccacggatttagtcggttgcggatcgttgtgctttttcgattgctatccgagactgccactgggctgttttttgctcaatcgcctgccaaacgcccgcaggcaggtgtttaatttcgatctcggcgcccaaaaacatcaaccaatcagcgtacatggttgcgccagctccctgatcgtccacgtaatccacaaactgggccgtttgctggaacgagtctaaaaagacaagccgacttccgggttggtgcagtcttttaaatcgggtaattgccgtgccatgaagaactagctcaatattaggggcatgatgatcggcacgccatagttggtgcgcctgctcgcctgttaatatgggtagctgaggagactgaagatcgtgaattcgatcaacgcgaaacgtccggcgcgcctgccgcgtgagatcgtagcattcgacgtaccagcgctgttgccgattgtaaaggtgaaagacgtaaatctcatgatcgaccggcgccaccgctgtcggcttttggtaactgatgcgaatctggggttgtgagaccaccgcactaatgagttctccgagcatggcgggggccgtatcggccagctctaacaaattcggattatccggattcgtattttcaaaccagagcagctgattcaactgcaacaagtcttgtttttgggatgtcgaaacaattgaaagtagcttctctgatatggcctgccggttttttaaatagggcaattgggcgttcgtcgtcgctaaaaaagccacaaacagcgcctgcacctcggttggcgtaaacgtcacggcgggtaaaacttgatttcgtaacacccgatacccgccattatgccccggtgtcgccgtcaatggtagtcccagctcctccatttcctgtaaatcacgaattaccgtgctacgagaaatttggaactccgccatgagctcagcaatcgtcacctgctcacggttatttaaatatcgcatttccgttgttaaacgcacactttttttcattttttctccaaacgtgtcattaattgatacctttgatcagtattatagcatcattaacaaaggaggttagtcaaatgtctaactatgaattacaaaccaaggctgcatttaacgtcatcggcttcggaaccaccgttcaatacggagaaggagccgacaaattcagccatatcgtcgctcagaagcaagccctctggcaaagtgtcagtcaggatggtcgtttggagaccctcaaacaactggccacggacggtcgcttactcgccgtcaacgaggcggtcaaccaggaaatgtggtactacgctggggtcatcagtgacgctcccaccccagccaacgcgcgcagcattaactttccggccggtgattacctcgtcgttaagggtcacgcagcaacccctggtgaactgtttgggcaactagaaggccaagtctttggtcaaattttaccgaacgccaccaacttcgcctacgtcggcggccctaataccggtgtccaaacgggcacgaccgccgatggtttcgccggtgaaatgtgggttccagtggtcaaaaagtaaccgtttcttcaattttctcgcagtccgcaaacattacattacaaaaaagctggtgtcttccgtcatggaaggacaccagtttttttgatttttattccgttgccgcgaggcgctctaacgtgcgcccgcgaagggttatcgcattacgcccgttatacttcgacgtgtataaatactgatcggcgcgcttataagcctccaaatagttagcatccgtctcactcacccgttcctcacccaatgatagtgtaatgcgcagttgtgcatcaaattccagccgtaattgggcgaccgcctgttgtaattcccgcgagatggcctccgcccgctcggaatcgtcctgaatatcgcgcaggatcaccgtgaactcttctccccccgttcgataaatgcgggcccgaaattcaagattgctcaccacttgattgagctgctcggcaactttttttaacacgacattgcctgccggatggccgtacgtatcattaattcgcttgaaatggtcaatatccatttcataaagtgcgtagcgttcgcccgttgtccgaaactgttggtataggtgttcaagatcatgatcaaaagcgccaaaattccgtagcttggtgagttcatcatacattgcccggtgctcaaaaagattattcaaaatcacccggttgatgagtgctttgccgtataggtaacagaataggttaagaaccagaagtgcactaatttgtcgcagccagctgtagatatcttggtgcgcgtatatcaaagttgcgataacaaacaccagcaccgccgctacccagaagccaagttggtaggtcgccatattttttgtcagccaacgactcccgatgtagatgcaaccttcaacgatcaccaacacggcaaagaccgcaacggccggccagctccaaattttcatattcataaagaaccatagtcccgtcaaaccgacggtactggcaagctgccaccgcgatgaattttccagcgttaaattatacagtgctaaaatttccatattcaaatacgtccaatggaatccgatcaaatattgcgataaatgcgcattagaccaagcttcggtatgaatgaacagcagaaaggcaacacctaatactgctaaaaagccaccacgatgctgttttaaccaccggctatccgtttgctccttaaaccatacaaaaatggagataaagcctaacagaacaattaagttagccatcagtgatgataaatatgaaatgataattaagttagtatccataagtcctcatttgtcgatttaattgattgtcagtttaatatcaggcatatttttcaaattaataatagaaaagtatgccaatgggtttatttatggttcattatacattactctaaagtgcatagtataacttaaccatttaatttctaaattatttcaactaaagctatattttaaacacttagatcgctataatgtgaatattataacatggcatttattaattattactacttaggaggtcggccgtcaatgacaatgtcattatttggtgtccatatcaggatggttttacaattggatgcgcaaagtgcccccatttggttcgcccaactacttatctcaatctttttcatctccggttttattcgctactatcagtccctgtaccagtacgccttcaacgaccatagccaccccacgtaccccatcggtgcgcgcgctttgctgatgatcatgtcactgggcacggcgttcatcctgcatttcatgggctacatggttcataacgacgccctgatgtttcataatgttgggctcttcttgctgattttcccgcttttggatgcctccattaataagctcgagctccttattcggttggcgggggccgtttcggtctggttcatgcatcacaacatgcattttgaccgaccgcaattcgtaatttccttggtactattggcttttggtgtgattttaatgcgcaaatatccgcgtcaaattcgggataatatctgggccagtttggcgctgtttgcctatattgccatcatcttctgggcgcttttaccgccctatgctgagcatccccaagacgcaatctgggtcaccgtccaagtcgtcaccatgtttttgggaatggcgggggccgcctccctcctgtggattcggcagtacacggaagatgccaacaatgcccgcatgaagcagctcgcaaactatgatcagctaaccaatgctaaaacctattccttgtaccagcacgatgtcacccacatgtttaacgaggcgcgggaaaacaaccaaccgctcaccctcgtatcattagatatcgatcattttaaacaaattaacgatcactacggtcacctagccgacaatgcgattctgattagtgtggcctctaaactaggggacgtgctcagtaaatacgggcgtaatcaccagatctaccgaaccggtggcgaggagtttaacgttgtcttttacgggcaaactccgaccgatattcgccccatcatcgttgaatgttgggatacgattcgcaagaataagttcacctaccaagactttgacgtgaccattaccatttcgctcggggtcaccgccatgcgtaccaccgaccactccattgacgacacctataagcgggccgatgataacctctatctaagtaagcacgccggtcgtgacaccatcacaattgaaggtgaaaccatgcataatgatgcgcaacatgaacttgttgccacatacaccttctttacccaagcaatcatgcacgtcacggacttagatcacaccaacagacaccgtagcgaactcctcttgcggatgtacgatcacgaacacgatcgttgggtactgcccgaattatttgatatctcagtcgaaacccagattgatttaatgcgtaaggcactcgctaattcaccgacacggcggctcgcaattaacctcaccaacgcccaattcatcgatcagtcggtcgcccttgccctcacccaattttgtaatagtgaggatggacctgatgaactcaccgttgaaattaccgacgttcctgacatggtcacgacgcgcaacatcaccgccatttaccgagcgggaggaattcgcattgacattgacgacgtcggtagtgacaatagcttcgaacttgtccaacatctcttaccttacgtggatggcgttaagtttgcgatgcaaaatctacggcgcaataatgacgaggcgatgttgcaggaacggattcgtttctgggccgatgttgcacaagaacacggcttaaccttcattctcgagggggttgaaaacgccgcggaagtcaccttcgcccacgacacactcgggatcgatttattccaaggctactacttcgacaagccacaactaccttcgttatagaccaacagcgtattccatcaatcggaatacgctgtttttggttgctagccctagtctaacttctgtcgcgcagcctgcggaatttggttgaaggccacccgttcataacttttgacccccttcgctgctgaccaggtcacctttaaatagtgacccttcgtcaaccgttgactgttaaaagtttggacggataagtgcttggccgccccctgcttgttgtaaccgaccatccggtatgtgcgtacctgattagccgtctttccggcattcttatccgttcgctggctcgcaacatttcccacccgcgcgtaataggccaccccgtgatacttctggtaagcaagcgccccaccgattagcacaactacgacgacaatgatccaaacccactttttcttcatgagcatcctcccgcaatgattttctatgtcatcattatatcttatttattcgccgattggaccccaaaaacgccccacgactcatccgaaagtcgtggagcgctcattttgttttactcaaagtgcggttggttattctgtttgttcctgatactcgaagtaatcaaagtcggctggcaactgactgcccgtcaaatcggaactaaagacgcccgtaaatgcgccggtaaagaaggcgtagccgccatagttcattaaaatgtaatcatccgaaagttttaacgaatcgaaggttaccggaatagtctgccatttctgcccatcaaacgaataggcatatgtgtagttctcatgacgcacaacggttttaaagtacaccgcagtgacatcatctggaattttgatggcattatccttcaagtagaacgtaaagttttcagcatcacagctcaatacttcaatacaacggccctgcacttcgttgtacgtgatatatgccgcggtgtagttggtcgtatcgtagtagttcacaacccccgccatttgctgatagttggttggccgatacgccaccttggtcacggcctcgaagtcaaaggcctgccaccggtgagccacgagggcgacgttaaacagcgagctcaaagactcgcggccgtacagtcgcaggtatcccggccgatcggtcagtgacaccccgagttcttcctttggtaaccgtagcgtattgagattgatatctaactgatcgtcatcaaaatccgtcttcaacgtattattgattggggttccggccgtcgtcacagaccgtggtgcagcgacttctcgtgcccccgccttaccaccaaccacgtggggccaaccggcttcgtcccattcgattttctggatcgacgtttcccgtcccagtggtgcccagccacgaggttcgatgaccgattcgttaggatgatgtaatggtcgggccatcaggtgggctagataccattcgtgatccggcgtttcaatcaacgacccgtgaccacacttttgcaagtagttatgcgaagcatccatggcggtgagtaacgcttcaccgggttcaacttcgtagtctccaagcaagtcggtggcccgtgcgactacttcttgatggggccagtttgtcccaccctgcgcacaaaacaggtagtaataattgttgatgtagtatagatgcggtccctcagtgatcttgtcggccgtcccgttccaaataatgtgcggctcaccaaccaatttttcttcggtaaccgagtactcacgaagttgaatgccgttaaactggtggtggtagttacgctgatcccagaccatgttaatcaaatacttcttcccatccggtgcgtggaacagtgacgcatcaaatccgttactgttgaggtagatcggatcggaccacggcccgtgaatattttccgcggtcgttaagaagttaggcgtatccttaaaggctccgcgcatcgacttgacgttggaataaacgagccaaaacttgccatcggcatacgtcaaatccggtgcccataccccaccagaatctggcaccccggtcatgtcgagaagccgcttgctatcaaggggcttttcgattaattcccagttaatcaaatcctttgagtgatgaatttgaacacctgggaaccagtgaaacgttgaattcgcaatatagtaatcgtcatcaacccgcaagagactcggatccggattgaagccgcgaataactggattaattatcttcattacaaatgactccttctaaaaaattagatgccgtcggctgattgttcggtactccctgaggcttccaattcagcgttcatcttattcacatcttcatccttcaagttatagaaggcaaagtcgatcatggcaatgaccaagaacgcaactgggatcaaggtctgcacgagtaaaatcccctgcatcgagtgtgcgctttgggcagtattgttagcgttaaaggcaaaggctgctaagacgtaccctggtacaacgcccccgagcgccatcccaaatttgaagaagaacccaatgatcgcattaacgatcccgttttcacgttttccagtcttccattcaccataggtaattgtttctggaaccaaggcccacatgaaggtggttgcttcagtaattcccatttgtgccacaatccgtagcgcaaagacggcaacaatgttggtcgcaggagtaaagtacatcgccgtcaaacaaactgcggcgataatcaaacttcccatgaccaaacgtttctttccaaacaccttattcatccatggtgtcaatggaatcaagatgaaggctggcaggcctggcaagaggttataaagcggtagtaagtctggtgactgcatgttatacgacacgtagtaagcaccaaccgagttaacaacggacatcaacccaaatgtgataatgaagaagattgccaatacccgtaatggtttgttgatcaccaattggtggaacaaatcctttacgtgcacatcattttgcgtgttagtaggcattttgatcctttcttttgtttgtgagaaacagaagatcaaaatcaaggcgccgacaatgccgtacatactgagtgtgatgaaccagcccatccgggcaccggtaccagaatatgaaccgccagagaaaagtttaacaaagattggaattccgtaagaaacacacatcccaccaatgttagccaaaaacatccggactgaactcatcttaacgatttcgtcgttatcacgtgtcatcgctgcgttcaatgaaccgtaaggaatattaaccgtcgtgtaaataattgaaagaccaacgtaagtgatgtaagcgtagattagcttacccatttgaccgaggttcggcgtgtagaaacataaaatagccatcactgcaaaggggatcgccatgtaaagcaaccaaccacgatacttaccgaaccggttcgtatgtttgtcaataatcgtgcccatgaccggatcgttaatcgcatcaattacccggactaccaagaacatggttgccgccgatgctggattcagcccgtaaacgttcgtgtagaaaaataataggtatgttgaaaccgtattgtaaattaagttttgtgcaaaatcaccagttccgtaaccgaacattttcaagaatgacagtttaggtaattttgaactgactgtttgattttccataagaatacctcccaaggatttgaaccaacgcgccattcgaagggcccttccaaacgggttagttgatttcataaacatactagcaaatactcgaaagcgtttgcaattcaatttatatcagcatccacgcaaaaaatatcatcaaatgatatgagtcactttcttcgcgtctaattgttatatattctcaattattgacggtataattgcattagaaaataaagattgagagtggttaatttgactgaattattgaaggacgcccagcacctgccagcgtttaactggaactacactttctttggctctcatctccagaaggtcaaacaaggttggtactatccgcaagaatctcacgctgcttttgaaatcatttacgttttagaaggaatcgaacagattgaatttaccaccctttcctatcagttaaaggctggcgattttaccgtgatcgcgcccaacaccagtcaccgctgcaaggcaatcgaggatctcacctactttgtctttcactttgatctggatgacccatcactggaggaaatgctcattggtaatccgaaactggtctacaatcaaaacagtaccgcgaccaagcccattaccgaccgactggacaaaatgattgaactgattgcccaaaacaaagccgaaaacttcacgttcggtgatcgaatcaaaattcaggtggaactctctcttgtcatctattcactctacgaaagtattaaaaccattaacgtcaacgttaacttgtacaacgtgcagtacgcgaaacgaatgcgaatctatattaaaaatgcgttgcaacaacgtgtatacaactcagaagatcaggctaacctagcgagcaacgatattatccaagacgtttgcaagcaactgaatctcagtgtggggtacgcctcgcgtatttttaaggattcctacgggctttcacccaaggcttacctttccagcgtcaaacaacaaattgctcaaaatctactcctcaagccccagtacagcatcaatcaaatcagtgaaatgctcggttacaaaaactcgggtaactttagccgccagttcaagatttggaccggcttttcacccaagcaatttcgtaatcgaaatgctaattactttcttgataaaaatttgttctcacaaaacttcatcacgtacaacgaagatcccgataacgacgtttaccgtagcttcgacgacgattaaattaaaaaaaggccgttttcgccggtgttttccgatataatgatcaacaaactatccagttaaaccacccgaaagaaggccgaatctatgccattagctaatccagattacatcgccacccgcatcttccatcttggcatgatcgaaggcgactacattgctgaaaagcgtcaagaatggggcttaaaccgcgaccaagggcgcgccctcgcctacattgccactcaccaagaggtacaacaaaatcagctggcgaagattcttcataaaagcgaagccagtacgactaacatgctcaaaattttggaacatcgcggactgatcacgcgcatcatccccgaagacaacgcgcgcattaagcttgtttccatcaccgaaaagggcatcgagattgatcgccaaaccgatgtttacttcgataaagtcgaacagcaattaaaagatcacttcaccgctgctgagctagaccaatttcagcaactactggcgaaggcccagcaggtcgtgacgaagctatcctgaccatttcagcagtgtcaagacaactataacctctcaattatctaaagtcctagttgtaattaaaatttcattacagtaaaattaaagcaacataagtttctatttgtttaaatctttcgttcaacatcagcagcaacataacttattgtttaaggagtgatcaccatgttggcattttttggtcaaccgaaatttgcactcaatgccacagactacctccctgtcggctatgaactctttatccgtgaacaggcagcgtcagcgtggcatctccccgatgacttcaacgcaattaccgtggaccagttctaccaactcctcctgaacgttactcgtaatttacccagcaacgtgcaattgctatcctttaatttagaacaacaacaatttatccaacctgcttttgctgatatgatcgaagaggtgcaacaccaaaccgcactcaatatctttacggaacttaccgaacgaaatgatcctctggtcagtgaccaacaacttttagcggcggcacagggttttcatcggcgggatctgctggtttgtatcgacgacgtcggcaccggcgaaaacacctccgagatggtgctcaaacttgatgattacgtcgatgaatataagtttgcctttcagaatttccggccgtttaccagtatccataccattgaaccggaactgaaattttgggccgacctgcgccgacaaaaccataaaatactggccatcgaagggatcgaaacagcagcagaactcacatttgtccggcgccaatacccgtgcaacctcattcaaggctactacacgggccgcccagaactactcgcaactagctaatcaccagtacccacgacggggctgtgacgacttgatcgtcatggcccccactttatgctatttttttagaaaggttcctgcattatgcaatcacatcagtcatctaaaacgacgcttggcgtgctactcgccagtagtgccggcgtggcctggggactctcaggcgtcgctgccagcacccttttttcacactatccccaattcaccccgctgtggattagtcaggtgcggatggtcagcgccggcatcatcttgctactactgagcggtcttcggcaccaacatcccctctcaatctggcgtgaatggcggagtgccgtactcgtgatcgcctacgcgctcttagggcttatccccgtccagttcttttattttctggccgttcaagcgggcaacgcctccatcgccacgattctacagtacctcggcccatttgtgatcgttatctattacattttgcgctaccggcaggctcctcgccgtgcagaagtggtcgggatgctcctcgccttttgcggtaccgcactaatcgtcacccatgggcatctgacatccctctcaatttccccactggtcttactgtggggtggcctttcagcagtcggcgttgccaccaacgcccttattccgcgggccattttaccacggtttggtgccctcaactgtaccggttgggggctgctgcttgccggtctggccatgaacggctaccaccccgtttggcgccatagcgtcccgttttcttggggagcgaccgccttagtggtggccatcgttttggtcggtacggtgctcgccttcattcttttcacgagcagctttagctatattttgccaaccacggccagtttactagacgccttcgaaccactctccgccaccgtcttttcgatcctgcttctcgggaccccgttgaccggctttgatattggtggcgggctgctcgtcattattgccgtcatgtgcttgaccgtcgatttcagcaaatatttacggctacttggccaaagaaaaggataaaaaaagatcggaactgtgactagttccgatattttttactgaagcacccgttcaccaacgccctgaatcgcatgctttgtgagtactagcggctgcagtcgcgcctgtgcccgccgcgacacgagataaaagtgccgtcgttggtgcggcactagtggtaccgcccgcacatgtgggaggtgcgctggaattgcaattccagggagtacgccgatcgcaaaatggtgttgcaccgccgcgcgaatagccgcgtaatcctgaaaagtcgccacctgtcgtggttgatagccggcatcctgacatagccgccataaccggtcggtcagatatgcgccttgcggttccatcgcccagtcttgctcccgtagatcagcaatcgagacgcccgtctgcgcagcaagcggattacggtcatgtaagagtacctgtaactgatcggtccccagttcaatcgcggtcagctcgtctggaattgtcatcaattccccaatatagccaataatcgccaagtcaatctgatgcgaactcagcgcagccagactttctggcggttccatttccgatagtacgaaggaaatgccggcatgctgatccttaactcgggtcaccgcaggaaccaccaacgtctgcagggaactcgaaaaagccccgatgcgaacaatcccccggtcatcattgcgtggcgcatttagtgttcgctccacctcttccaattcatctaaaatcggtcggacctgcttaacgagctgtttaccggttgccgttaacgctacgttacgccccaccttttcaaacagcgttgagttggtttgcgtttccaacagcttcagttgggttgacaccgtcgccgtcgttaccgccatgacctccgctacccggtgcatcgtcttcaacgtatcaaactgcaccagtaactttaatcgccacatgtctagcatctgttgcctccattcgttcaagatcattaaagtaattgttaataatcatttgattgttatctattttcgttaggttatcatgaagtatatcttgggatgacgaacacgtcaatcccacttcactattaatggaggtcattttatgtcaatcgtcacagaacctttaatgcaacactatcccttacttgaacccatgagtcactacgaaccgatcgactggcagaaccctgaattcggcgacgacgctgaattgccgttcacccaagccgacgtctttgatgccgccgcacggttccaacgctttgcgccatatctcgccaaagcctttcccgaaaccagtgccacacacggagttttgacctcaccactgatttccattgacgccatgcaacaacaactcgaacaggctgctgacacgccaattccagggcgcgtcttcctaaaggccgacagcatgctgccaatttccggatcgatcaagtcccggggtggcatctacgaagtcctaaaatttgcagaaaaaattgccatgcaagaaactcatctgacctatgctgatgactatgccgtgctggcatcaccagcatatcaccgcctatttgctcactacggcatcatggttggttcgaccggtaacctcgggctcagcatcggcatggctgctgccagctttgggttccaaaccaccgtccacatgtccgtcgacgctcgccagtggaaaaaagaattacttcgtaaaaatggcgtgaccgttgttgaacacaacgacagcgtgtcagttgcgatcgcccaaggacgggaagaagccgccaaagatcctcacacctacttcatcgacgacgaaggatcacgcgatctctttctcggttactcggtcgccggcattgagctccaaaagcaactcgctgacaacggcatttatcccagcaaacagtcacccgttttcgtttatctaccagctggcgttggtggaagccccagtggtgttagttttggcctccaaatgatgatgcccgagggcatttaccccgtcttcgccgaaccaacccatgtaccatccgtgacgttggggatgatgacccatctctatgaccaaatcaacgtgatggacttaggaatggatggcaaaacggttgccgacggccttgcggtacctaagtcttccaaaattgccggtcgtgttatgcggacccttttatatggctcacacaccttcgacgatgatgacatctatcgctacctaaccatgctagctgacactcaggacattcgcgtagaaccttcagccgccgctgggttttcggccattgttccaaccgtgcagcaatttgccgatcagaatgtcttaaaaaacgccacccacatcgtttgggccaccggtggcaaactcgttcccgccgacgaaatgcaacgctactacgataaaggccaacagctccttactgattgggcctaattaagccctaatttataccagcaaaaaggcgaccattaagtgggccgcctttttgctattcttgatcctgttttttgtcgtgtgccagcacgccgtgaacgaccatcacttcgccgtcttcggttggtgcttccaaccagtgaaactccatgggttccatcacgattgcttggccgggaaccagtgtggtctcctcgtcatcggtatgaaatacaatttgtcccttaatggccaccaccgtgaccgtcattagtgaccgatggcgcttaatggttgtgccttggggaatgactaaccgcaccagactgtaaaattttttagcaaatagccgttccggtccctgcttaatttctgggtttcctgaaaatacctgcatgctttgacctccgttagtggacccgtctgacaggtcccgagtatgtacgtggtaccacgagcgatcgatatagaattttaataaaaaaataccatcattttatatggaaagcgtcgttgattcgattataacgggtttttaataattttcaaatgtctttttaatcttctccagcaacaattagattaatacgatgtcaagcccttttatcacccaacttttctggtatgattgacattaggaaatctactcaatgaggtgaaccagtgtgaaccatacccaaaattttcatgaaaatcagatcctgcccgtctgtgacgggattggggatggcctctaccttgtcttattgggcgccagcgatgtccccgcgtattttccgatcagtaatgaagaattagtgcccggggattaccttaaaattctccggcaacacattgacgatgtcggggggatgcttagcgctgttcattggatcttgtatggcgtcatcacaaatggccgcatgcagctcgtcaatgtcattaacatgctggcaggagccacggtttatcccaatttttacgccatgcccggccgaacggtgaatgatggttactacctcgctctcgtcaaccttgatcgctccacaatccagtacttccctattgacgggcaacaacttctggaaggcgaacacgatatgttcaagcttctatcagagcacgtagaagacgtgcgtaaagaattgcaaactagcgacatgttcatgattgggcaggccaaacataactactttcatgtgattcaacaaatggaaattaatgatttttaactgaacaaaaaggcgtccaactcatcattcaaatctgagttggatgcctttttcagcgcttaattctagcccgcgcttaaatactgaatttgattcatcaatgcaattgttgcctcaatattgggactttgtgtcatcattgaaattactgacgcaccagcgaccccggttgcgggtaaatcgatgatattagtctcatcaattccaccgatggctaccacaggaacccgacttaactgcactagatcacggagcccagctaaaccaatcactggcgaaccgtgcttggacggactcggaaaaactgcgccgctgccgatatagctaatttccggcacttcattggcgacccttatttgagccgccgtgtgacaggaaagcccgacaaacatctctgggccgactgctttaatcacgtctcgaatatccgtatcggtctgcccaacgtgaattccgtcagcatgcaattgtgctgccaaatcaatgtcattatcgataatcaagggaacatcgtagtcatggcatagcaccaataactgttttccaaggttcgctttcgccacgccggtgagtgcgtataggcctttttcgcggtactgaaaagccgtaattcctgccttgagtgcccgctccacaaacttgaacaactgcccatcaggcacatctgcggtgcccgcaatgagataggtttgcaacatctctggtttaaattccattatttcgcctcccgcaacgtttcgtaccgcatgtgctggctaatcaaatccggtgttacttcgctgagttgatcaattagcgtggctgagaatacacttggttgagttgctttaacggttgccgctacgagttcaccagtcgtcgcgtagatcgccgttgctgcttgtgcggcctcaaacatatcatccgtgatgccacaaaagcagccaatgagacttgataaaatatcaccagatccgacacggagcttaaatagatcggtttcattgtgcaccttgactaccgtttgcccatcggtaataatatcggttcgaccgctttcgacgacaatacagtgatactggttcgccgcagtcttcgccagttgaactgggtctgacgccccggttccggcatcgatccccttagcttgccagtctgcgccaatcaatgccgcaatttcaccggcgtttcctcgaataaccgcaatatctcgtcgtgccaaaatcgctaacgctcgccgattacgtgatggtgaggctcccacagccaccggatcaagaatgactggtttgtgatactggttcgcaaacccaataatttcatcgatgtgatcgacctgtggatcaatcaacgcccctaagttgaccgtcagtgactgacacactttgatcaaatcttgtgcctcgccaagttcttcattggcttgcaccgccgctggtgacgcaccaattgaactgatggcattgcacacatcctgaattgttacaaaattggagatgttatacgcaatcggattaacttctcgtagctggtccagtaactctaacttcataaaatagcctcccaaataaaaaatgccgacaacaattgtcagcactgcaaatggaatgtttattgtggtctggttcacgtcaccggtcgttccccataaacacattccctacgcaagcactaacttaacaggttcaaaggggccgggtcgcacagactcatctcagccgctaatggcggcatccctagtgttatttgattcaacgataatatactatgtttaacgaatcgtgtcaattcaaattattgttagatgatattcgtctaatcgtatccgttgagtgtcgtaatttatttctattcgcggtacactaagacaactaacgagttcacccataaggagacccaaacaatgcctaccatccatcagcgactactcaatattacccacggtgttaacttccgcgaattaggcggctaccaaacagccagcggtcaaaccattcggtggcaccacctcattcgtagcggctcacttgcccacttaactgccacggaacaagcctacttagcacaatacggcgtgacaaaagtaatcgactttcgatcaccggctgaaattcagcaagcaccggaccaactgacaaccgcgacgacctacatcaacctgcctgtttttcaaagtgatcaaacatacagtacggcatccaacgacggaattaccgaacaactgaataaagcgcaacgttctggctaccaacacatgctccatatttaccagcaaattattgtcagtcaagatgctcaaggggcctttcggcaatttttaattaacctgctggctagtagtcccgacgatggggtactgtttcactgcactgcgggaaaagaccgaaccggcattgcatcctatcttctcctttccagtctcggtgtgagtcctgcacaaattcgttcagattacttgctcactaaccaagttacggcggccgaaacccgcgaacacctagccaacgctaaactcgatggctcatcggctcaacaactgcaaaccatccaagcgatgtggtccgcctctgaagattacttggattgtgcagttaacgccattcagcaaaactatggctccacagccgcctacttacagcaggcgctgggcttttctaccgctgatcagcatctgctaaaacaactgtatctcgaataacgatcaaaagagccaagcaaaaaaattgcttggctcttttttgagatttttaaactagacttgccagaaacaatccataaaatcgaaccgcttcaacgtacgtaaagatcttgtttaggcatgtttttcggatctaattattcgcaattttggcaaagccacgttgtaaatcttggttttcagtttgggtaaagttgtgcacagtactatccacatcctgtgatactagcacttccggttgttggttgtggaaaacatacagataggcaatcattttgtctgagccgttttccacatgtgaataagccgcagcggccaccacctggtattcagcatccgtatccgcattcggtgtccatttcagcgtcgcatccgagccatcaatcgtgattttaccctgatactgatcattcttaatatcagctgggaacgtaatcccatcgtcttccacgctatgaccatcataggttcccaaataggattggttcatcgtttgctcccacgaagccatgaaggatgataaatccgaatttttgctagctgaccaaagcgccggttcactgccagatgtgctactctcactcgtgctcgtcgttgctgactgcgaggaactcattgagctaacttgagacgaatcactttcctgatgttggtgataaaaatagtagcccacacctgcgccaatcactaacactgcaatcagaataccgaccaatatcgaggttcgtttagtgttatttggtttatgaggttgcccctttttctgcggctgcgctgtccgactaggcgttgtggctgtgggctgcgctgcacgtgttgatcgttgctcggttggcggtgtcgttgatgtgaccggtgttaaacgcgttccacaattactacaaaataccgcatctgaatcatttttcgtaccacagtttggacaaaacattatctttcccccgttttttcattatttttctttaagtaatacactatttttccgttgcttcgtaaacctgagtggccagcgtcgcaatttgggcgtctgtccagccatccgtcataatggtcaacgcaaactggtgctttcccaacacaatcgccgcatcattatttgcggcaccattaattccgatcttgtgcgctaccttcaccggtaacgtgccaattttatcgtgggcccaatcggtattttgaagccagttcgatgccttttgattttgttgccagacagtcatgatcgctcggttggcttgtagcgcactcatctgcttactatagttactcatccccatatgctggtgcagatactgcgtaaacgccgtcttattttgcaaagctacatggtacagtagttggttgctagcctgattgtcagactgctccaccgtccgttgcaggagatcggccaccgcataagacttcccttgatgattctcgttttgcagggttcccgttccgccgctcaccatcgcattcggcacttggttggcggcatccgcgtacggaaaagtggtggtccaagtgagtttccgtgtcatgatagcctgttgcacgtaagccaccacgggtaatttcgccacactggccgcataaaaagtggtcttcccatgcagcgaggccgatgcgcccgttgttaaatcaacgtaggccaccccaatatttttcgtccctcgatagtgatttaaaacggtctgcaccgcttgcgcccgtctggttcctgccgaagatcgcgttgtcgctgacgacgtagtactgctagccgactgtgccgtctgctgatgcgtcgtccgtgtccgctgctggtgcaattgtaaaaaaccataagcaccgccaccaactagcaggagcacgatcacaataatcccaattcgttttccccgcattgtttcccccatataattcaataacacttatttttttataaagtaccttctatagaataatacgaattggctaaaaaagcgacagacagaccaaaaggacccgctaaatcactttcacacgaagtaatttagcgggtcctttaattagactctagtataagtgcctagcctatggtaattcgtggcctgcttcaaagtacaggtcgtaccattcctgcttggtcaacgtcacatcggaaccagcggcactttccttcaagtgttgtgggttcatcgtccccaaaatcacttgtgtttgtgccggatgccgtaaaatccaagccgttacaatcgcattcttggtaacccctttttcgtcggccatcttggctaacaacgcgtttagctctgggaacttaggattatccacaaatgggccttcaaagaccccgtactggaatggtgaccatgcttgaatcaacatgttcttgcgacgggtatattccatcaaaccaccatcatgactaatgctatctgcatcggccatgttggtatgcaggccaaagtcgaccattccggtatgcatcagcccaaactgtaactgattcatcattaagcgttggttgatcccactttgaacgagttcaacttgttgtggattaaagttcgaaaccccaaagtgtcgaaccttaccactagtttggagttcatcaaaggcagccgcaatttcgtcaacttccagcaacggatctggccgatgaagcaaaaaggcatccaagtaatcaatcttcatccgcttcaagataccgtctaccgcatctaacaagtgctgctttgagaaatcataccgttttcccagaacaatatcatcgtgactgcgatcctgatcaatcacaatgccgcccttagattgaatgtagaaatcgtcccgcgtgaatccggcttctttcatccccgcagcaaaagtttcttcggaaccgcccatgccgtaaatatcggctgaatcgatatagttgatgcctgcctctttggccgttgtcaaaacttcagcggcttgcttggcactcaatccgttcatgcgcataatgcctaaagcgacgtttgaaacggctaaattagtatttcctagttgcactgttttcattaatatcattcctccaagactttattaagaattcgcttccagtatatcgcttgaagtatggtgcaagtcaattactttgattaccaacttactatctggcccaagctatcagttcctaatcctcaagtgacggactgttaactgaaatggtcgcctcaatcacgtagtggcgaatgtgctcgtgggcataggttaatgcttgatcaaagtagcgaaacaggtcctccaccgtcccactaagtgccgtcgcataatgcatgctttgcggcttcagtccggcttgggtggctaaatccacaatatgcacaatatcttgcatgtagtccgcatccccaaacgcgtagaacgaatatttgcaatccacatggaagttttttaattccgtggggacaatgaccggctgaatggcttcatttaagtaacggtccgcgtcaacatcccccggacaccccttggaaaaggtcagttcaaataccgtgtgcacgtcatcatggtaagccagttggcaggccgtcttaaccacattgaccacattttcttggcggccacggtacgtggtactaaacaaatccgtttgagaccagaccggtagcttcacctgattcagttgattgaccgcgcctaaaataatatccacaaactgatccttcatcgggtaaatgctcaacttacatcccgttacatcaacagaaccatctaaattacaagcgatattcataattacctagccttctttctgcgaaattgagtgctttaatacatgggccttaactaataagtgctgaaccaccgtcaccacaccgacggaaaagaccagatttgaaattaagcgtgtgatgaatagcgccagcaacatcgaccagtgcaacttgatatagccgtgaataaagagtgctgatgcaaatgtaatcacggtcgaaaaaatagcggctaacgttaatgaccggacatcgaaccgtcgataccggtagcacgcaaagcctagttcgctcccaataccttgaaagaacccagccactaatgcgacgaccccaaattgaccgccaaaggcactttccacaagcgccccgacaatttcaccatatagcgccgcgccggggagtcggacaaccataaaggccagactgccgcccatgcaccataatccaaacaaaatttcaccaacaaatgggccgagcccgaccaacgacaatagaccgtatacaaaggtatacagccaatctgacagtgtaaaaatacagcctaataacaccgcaattaatgacacactgataatctctcgaatatgccaccgtgcaacaattttcttcatatgccctcctaaataaaaagactcccaacatcagaattgggagccattaagatgcatacatatgtattagccaaataaatatgtcacttctatcaatggtgaaaaaatcccttcgccggtgttaaccgtatcaggttcagtgggtataatctcagcacaatggcaccccaattcttcataatcagattactatcgtcgctcatccaagtcaacagtacattcggtaatatcgaaaaagccccgacgttgatgcacgttaaccgtgctactcagcgtcggggaccttgttgattacgatttagttttgtcatcctttaattcatctgctgttttaatatcattgatgtgaagttcgaattcaacgagcgataatcccgtcatttctcttagtgccgtctgaaccttggcgacaacttcgttaaaaatcttacgagtatccttaccataagcaatagtggcatccattttaattgaaacttgatgttcaccaacatcggtttgaatgccctttgttggatcagtgccatcagtaatccggtcggttaattcactaaacacattaccatcgagggacacaatcccgtctacctgattagccgtaatgccggcaatctttttaatcacttggtcatcaaaagttaggttagtctttaaatctgcacttgttgtcatgtaaattcctcctaatcacttaaacgattcacaattttttggagccaggctcggatactaaactgacgaacatccagccaccagccaatgatcagccctaatacgaccgctaaaacacaaactagcatggcgaaaaatccccactgaagccaagatgcaacaatgattaaagcgccaatcgcaccggtatatgtccatttcaagattgaccacctcctaaatcagcgtactttaattttatcgcgacaagaaattggctgaagatggatcttgagttttccaaccggtatgccaagggtttgctcaacattggtcttaacagctgttttcatagattccaccacttgacttagctcctgttcagccgccaattgggccttaatcttaacccgcgcccgtctcttacgtttgatcagcgtcacggtcactcgcggattaatcgcatcaaactcgtgaatcaaagttttctcaatcgacgcttggaccgccgaccgatcaatagaaagctggttcccgaaatgcgactcgatgatcaactggttggtcactccgcggcgaaaaatagccgctaacaatagtaccagggcgttgagggcaattactaagtaacccactatcatcacgtactccaaccacgtcaatgtttggaaatggtgataatattccggtcgctgccaaaaatactcagcaacaatcgctaattcaagtaggccaacaatcaaataaatcccgcgctttagcttcgtcatacaccatcaaccctttcgcttcattcccgataggattgcggaaacgattaatacaaagacaacggcaccaatgatcgatgggataatcgctaagccggccaaacttggaccccaagatccaagtaagctttcaccaatccacgaccccagcagtccggcaatgatattaccaatccagcctagtggcatatcccggctcgtgatggcacctgctatgacaccgattagtgcaccaataatccatacccaaatcaaatgtagcatcgtactcactcctttcaatgatgtcaggaaacagctaacgttgtatgattattatagattcgataacatttttcaaataaaaagggctcaaaattcctaattttcactgattagtttcaaaataaaacggaaaaatatatctggtataacaaaaggactcatctatgtgagtcccttcggtaaaaatactaattaaattgaatgtgtcacttagtagcccgttacacctagtgcaaaagcaagaatgtacaggagccaaatgtgagtcggatagaaaatgtaaaagaaccatttatcgctccggcctcgtgccccattgtaaagcagaatggggataatcgataagattaacatccattgaatattggtcgtcaatagtcctacaaaattgaatcccgtggcagttaatccgatcaaaagaattgacgccacctgaccaacccgattttctttgaataggtacagtaaaatagctaacgcaatgaatagtgggccaccctcagtaatcataatgcccggaaaaatcattgaggccactgctgctccctgtctcagcatgagatttgggctgaaaaaaacaaggacggtcagcatcgaccatagtaattcgcccacgatgattgaaataccgagccataattgtttcttattatgatcttggtgaccattctgaatcaggtaaatccccaacatcattagtacagaaatgaatagtgtgccaaaaatattattggccaacccatagtgaccgtgatctagcggcaaaaatttttgtaaaatatatgacccaccgcccataatccagtagcctactagcagtcttgtcaaataacgtcgcttgctgcgggtatgtgtgaatccttccaccgcgatgaaaataaacatcggggccacagcacgaccaagcattgtgaaccactccggaattcccaatggtgcaaacatttgatggacatgatccaataccatcaggacaattcccaacattttaatttgaaatcctgtcatgccaatggtcttatgaccgctttcttccgaataaatcattttcttcctccctagttagttactcaactatctaactagtatacatgatgtgttactttttgcaagctcttctctctggtacttgaccgtttcaaccgatagtccaatattattaatcacaacacactaaaagctgtcgtatcgtaactattttatatttagcaggcgataaaaaaagcctggggaacccccaggcaaaagacaatataaccaagtacattctcatggtacggcacaccgtttttttttagcaagcgttcacctaatcaactgcacgttagctggcattagtctatttgcgtcacgaatttaacggccgttccgtaagcaaccacactttgcatatcggtcccgattgaacctgaatcgaacctcatcatgacaactgcatcaccaccaactttacgggcctcttccttgagacgcgcaatcgacttttcacgtgagctatgcagcatatccgtataggctttaatttcaccacccacaatattcttcaagctcgccccaatattgctaaagacgttcttagactgtgtcgttaacccaaacacctcacccagcacttcatagtgttgccctggaatattttcagtcgtggtaattaatatttctttcatcttcattgacctccgatcaatcatttaacttaattttaatcaacataataacgagtcctactaaaatcattaaaatgccgacgatgttggcccctctatttcgactttcgtaatgccggaagaaccagccataccgtacgcgcgtattcaacgcaattacaaatagaccaagcatgaaaaggccgccaccaattgcaataataatatccactattcaatctccgatcttgaacgaattaacagtccaccacctactaccggcggtactcatccattttcttttgaaatattttttcagttataccataagcggtataggatatcgcattcgcaccggcgtcaatcgtggcttcgatctgcgcatcgctttgcccgccggaagcaatgatcgggaaataccggtattcatctggcagacgattccgaatttcagcgatgattgcaggcgtatttttgccacccgcaacgttaaagacccgcgcaccggcatcaattcttgccaacaaatcatcttggagctgcgtcaccgtgtagatgatcggaatatcaactgcagttctcacatccttgatcgtttggactgtcgccggtccatttaaaacaacggccgaagcgcctgattcttcggcaaaaaagccaatcgtggccgaacgcaatcctttcgtcaaaccaccaccaattccagcgagaattggtttattagccaccgtcgaaattgcctgtaaaattttagtattgggcgtccacggatatacagccaagacagcgtcggcatcacaattcgcaatcaccgcgacatccatggtatagacaatgctcttaatgagcttaccgaacagtcgaattccggttgccttttcgataatcttgggcatttcaacaatatcattccgtagatctgtcgtaatatttggtaccacttttttagaatccactttatccacctccgccatttaatacaccttgaatttcaagattaacaaggccgcaccctagtcggcaattataacgaccaatgtgttatgggcaacttgattaatcctcagtgaactgcgtttaaaacttctctttaataacattgaattctccctgcacaattaaactgcgattgaattgagccatatgccattatggtcacattaacacggaaccacataatgcctcaataaccatataccacgataaatacacagctttaaatttaagttcaataatgattaaattacgacctatggtgaccgctaaattcggttactgaactagctagtaagttaaagcagcctgatatttcattccttgtagttatgtgtaatgctattataaatcacgctaaatgccacatatactttacattaaataaaatgtcatatatactttacatagaggactttttaatgaaaaacacaaaaatgaaagctcaacgaaaaaaacagcatctatcacaaaccgaattagcacaaaaagcaaacgtcactcgtcaaacaatcggtttaatcgaagcaggtgaattcaatccttctctgaagctatgtatcgccatttgtcatgttctaaacgttacgttagatgaaatattttgggaggatcaagatcatgaactggaaaactaaactagatgaacgacaggaacaaaaattactcaaaatcgaacactacggtttctggttgctttttgggttaatttttatcgatgttctcctgatgccatttttgacaaaactaagtagcatggccctcacagccgcaatcttcctaatcgtatgtttcttcatgattatcgcttgcgcctggaatggtattttcgatcgacattttaaaatgggatggaaaaccactcttggtacagcgctcgccgccggtattgtggtgacggtcatcattagcatccagaatcacctactgtacaatagtgattggtttcacgccctcatggccgggctctttacgggaattttcactggtctcttgaccggtatcattatgctgatcctaacggctagtaccaaaaagcggcagcgaacattagaacaagaacctaaagacgaggactaagttgcccctccccatcattactcaaaccaaacaagcctcaaccgaagtaatgtgtttctttcggttgaggcttgtattagtatgattcaattaattatgattcggggtcgctagcgaccagaccacccgccaaattatccatattcgggcgatcagccgtcacgatcagctgttcattaacaaacgcatttaatccgagttcatgcatttcccgaccgtagccggaattcttcacgccaccaaatggtaattctggcagcgacaccatgaaattattaacaaagaccattccagtttcaatttgcgcggccacgcgctcaccccgtttgggatccccgctaaatacgatgccccctagtccgagatcagaatcattcgcaagatcaatcgccgcttgttctgattcaactcggtagacctgtgcaacgggaccaaacatctcttcgtggtacgctggattatccggttggatatccgttaagattgtcggttggaaaaactgacccggtaaatcaatcggctcgttcccataataaacggtcgcaccgtgttcaatcgccgcattaacctgttgttgtatcttttctttggcttttttcgagttcaatggtgccaacgtggtttgtggatccattggatcaccaggtttaactgcggcaaatttatcacgcagtcgctctaaaaaggcatcgtacaggttgtccgccacaataaaacgtttggaagacgtacaaacttgaccggcattatacaggcgtgtccgccaagcaatatctgccacgtcttctaggtccgtatcatctaatacgatgaacgcatccgtgccgcccaattccatcgtattctttttcaaattggcaccggcttctcgcgccacgtttcgacccccacgttcagatccggtcagggccactccttggattcggggatccgcaatcacgtcggacacttgatcatagctcaaaaacaaatttgtcaaactagcattcggcgccgaagattgtttcacgatttgctcaaaggctaacgcagaccccggcgtaatggccgcatgcttgagtagcatggggttgccaaccataaaattcggcgcaaaaacacgcataatttggtaatacggaaagttccatggctcaaccatcatcaaaacgcccgtcgcatgctttttaatttgtgcatgcccggtggccgttgtttcgagtgtctggggttgtagcaactctgcactgtgatccgcaaaataatccgcgatcatcgcacacagttcaacttctccctgtgcctcacgcaacagttttcccatatcctgcgtcattgtcttagcgagttcatctcggttttgacgcatcagcgtcgcaatttcatgaagttgtgcttggcgcgtcgctaaatcctcacgtttccactgatgatataagtcattggcggccgccagtgctgcctcaatttcttctgccgttgcgttgggatattcttttacaacttggttcgtatacggattgatagtttgataagccattgatcttttcctcctgttttgtgacaccatctcagaaacagatacatggaacttgctacttcatcattctattgttttttttcgccattcgtcaattaataacctttttgacggatggctgactgcaccttgacgatcacagcataaaatcagcgaccaactcatctaattggccgctgattggcagtactattatcgaacaataatcacatcacatttagcattattcataatgtaactggccgttgatccaataaacactcgttccacccttgtcagcccggttgcgccgatgacaatcgcgtcagtcttttccttttcggggatgtcattggccatctgtgttttatggtcacccattagaacccgatcttcaaactgaacaccggcttgctgcgcaatggtcgtatacttcgtcattgttgccttagcctgtttgataagatcgtcatttaattgtggcggtatcgcgtagttgccagcaactgccatcgaaatcgccggattatcgacgaccgttactagtagcagggatgcgtcaagcgcctgtgctaggtcaattgcgcgatacaatgcgttcttagactgttccgaaccatcaattccaactaaaattttctcatatcttttcatgtggtagccctcctcgattgggtgcgtgtgcggtgtaagatgatctcagtttccaataggacaaccgtcccatgaaccgattgccagccgtggcgtactttcctaaaagtcgttagaaagcgttttactatatattaattattatatacttgataataaatttcaaataaaacgaatgaattacttgtcgcattaccgttcttttttagtgacaaaacgctttaatccaactccacaacatcagtaatccaacgggaaatgttaatacatttcgacacatcacgtaaaaaggagctgttatgcttaaatgccacccaatcgcaatcacaatggacacttcgatcgcattggtgatatcacagaaccactgccgtgtgtccggctcctcaaaccggtaatacttaactaatccgtaccgtaaccctaagaccaatacagccgcaaaactataacccccaaccatcatttcacccgcttcttcaattttcgggtttgattacctgctgtctctcaactgctaagtaaccgtcacagtttagaatgacacagtaccaaccatccccgatactttgaacatatccgtttagctagaacagatatgtctatcaggaaaattgaagtgtttaattgcttgggtctctgcaacaatagccgagctagttgtgatgtttctgataaatcacgatttaatcgcaaaacaaactattgattacatcatcttgtactaacttagcatcgtcagcactgataagggggtaaaaaaataccacgagccgctggttttgatcatcacttaattaactttattttgcctagctattgccccaatgtttcttaacgtgtgcaacatgactcgtgtgttcaagcaccatcttcatatttttggtttaaggttaaaatgcgttgctcaatttcatcgcggacctgccgaaaaacggccatgacttcttcgtctgatcccgtggccgtggcgggatctggtaatggccaatgaatctttttaactcgggtgggcaccactgggcaccgatctctagcatccccgcaaagcgtgacgacaatatcgcagttttgtaaatattctggatcaactaattttgactgattttgagaaatatcaatctgcttttctgccatcaccgctaccgccttcggattcaacccatgagtctcgacgccggcactggcaatttgccattccgaacctaaaatggtcttcgcaaacccctcggccatttgactgcggcacgagtttcccgtacataaaaaataaatttgtggcataaacaactcctccattaatgaatattcatcttcactagtatttttctcttttaacactcatcggtcatgatttctacttaatgaatttcctcatttgccaatctttagctaattgtggattttttctaactttgcttggtgacatccccacaaaacgactaaaaacccgtgtgaaatgtgcctgatctgtaaatcccagtaaatttgcaatttcaagcagggggacatcagttgtcatgaccaatggtagtgccttattaatcctgacgagtaacttatagctgctaattgaaagtcccatttcagctttgaatcgatttgaaaggtacttgcagtttaggttaagctgttcaccaatggtacgaactgaaatattattattcggtgctttcaaaattaattttattgcttgacgaacggggactgagatcgcggttaaattcatccgagacacacgctgtgttaaatcctttaattcaatttcaatcactttgacgatttcatcaggagtctttaaccgctcaagttccctaacgtaccgatcatttagatcaaatgcatgctcgtaatctacgccactccgaatcgccgtccgaatcagtacagacaccagaataataccaaagtttttcacgtttcgtagcttaccttcatcggataaatgacccgtctgccccgaattgataagtttcattaaagtctcatgaatgaccgtatcatttcctgtctcaacggcatctgagagcgcctcttcgtagtaataatgcgtatgggcttgttcgttatcggtactgattccgaatgaatcggacactggcagttgaagaatgactgggttatccaatgccaaaccaatcatttgagtggttacatgacactgcagtaaccgtgctaaaatattcatctgcttaatcagccgctcccgttcgattcgatgaatatttgcaaagtgatagacatctttgaatccccatgactcaaaatagggcccataaattaataccattggccccacaaaatagtttccgtcatcagttgttagacacaaggtatacatatcattaccgtatttaaacacctgaatcttttgtttcactgaacaccgtgcgtttaaggacaagtacccatcgtcactgatcatactatgcttgcaaatcagcctagtagtttgattctttcgcattaggtgtgcaaatggtagctcaattgagtcgagataatcgtactgaagtttcattgatttcaccgcattctaattaaaatgaattcttacaagaaagataacttttatacaaaacatagtcaatcattttcgctataattaaacttgtaaatgacaacgtaccttatgcatgaggtcaactcgtttacaccaacttacacaatgtcagtggtagctgcttgatacacggctattctaaaatactcactttgcaaggttttattttggcactgacataaaaagcagtaacttcgaagataacttcgaaacgttactgctttttttagctaaaaattcaattttaaaccgacacctatcagttatgttgcttcagtttccatcctaatcaacattttctgctactttttagttaaatagccatcctgcatttcgtacagatgatctgctgcttctatcaatcgtgcatcgtgcgtcacgacaaccaccgctttatgatgtttaaccgctagacttttaagtagttcacccacgactttaactcgggaaccatcaagtgccgcggtcggctcatccgcaagaataatggcaggattgggataaagtgcccgtgcaatcgccacccgttgctgctgtccaccggatagttctcccggatatttattaattaactgctcaattcccagcgtttcgagcacctcatccagttttgccttcgataagttaccgttgggcttgaccttatccactaacttaaactgatctgcgaccgtcaaatagggtaacagatggtacgcctgtagcacaaatccgattgaatccaagcgtaacgcatcccgttgcttcttagttcggtcagtatatgtttcaccattcaccgtcacttcgccactcgttggtgttaataagcctccggcgatcgtcagaaacgtgcttttgcccgatcccgacggccccataattaaactgagtgtccccggctccgcctcaaagttaacgtcatgtaagacatgtactttggcagttccagtgccaaagatttgattgacgttttttacagaaaatgaactcatcgattaccctccaatcacactcacaggatccacacttaaaacactcttaatcggaattaagcctccaatcaacgccattaccagtaaaccagcaccgaccgcacttaataccggaatatcaaacgccattggaatggccggtggaatgaccaacgccgtaataatcgtcaaaattgtgccgaaaaccagaccactcacaaccaataaaaccgactgactcacagtcgcgccgacaaggaccctgcttggaattccctgcacccgaagaacggcatagttaggcagtttttgcatagtcaaaatgtatagaaagacggcaataataattaatgaaatcaccattaaaaaggcaatcatcatcacaaacgtcgttgtctgcgcttgatagccaggcagcttttcgatcactttggccgtactgtaagttttagccccctgcttggtcgttttataatgcgtattttgagaaacaatcgcactcgcaaccggtccatttgttaatccgcgtaatgtttgccacgtcgtcaactgcccatacacaaccggtgcaatattcaacttggcgttcttagtgaacccgacaattgtgtaccgcgtctgactgtcattcaacttgattcggcttccgagcttgtatccttctagcttgaacgaatcgtctacaacaatttgatgcgcctgcttaacttgatggccgctttcaaggacgagattttttgcaacaaattgcgtctcgtcaagcccaataaagacagcagataattgcttatgaccagctgccttcgcaacaacggacgtttctccaattaaagcttcttttttggttagttttccaacctgctctgcggttaggaaagattgtcgcatatcggtatttgcactagagttgagcgtgatccggccgacatgccacgaattaatggcgtccgtgttctggcgtgcaaggcctaatgctaaactcgttaaaataaagatcaagtagctgatcaagacgatcatggcgataatcaatcctgaacgcaatttttctttttttatttcttttaaggctaaaaacatctgtttatcctttcattaactatcccaaagcgcctttgagttgggccaacctggcatctatcgtgtcaggatccagaatgacatcgcggactgtttgatgatataaaaccgtcatcgcccatttcttcgggccatcatcgtcccccactaactgagtggcttgcgatccaacaattccttcattatagcgataatgcatttcgacaatccttcgaaatccttgttgatcaacacgactgacaaagtgacgaattgccgcaacatatgcatcttggttactgcgattcggtgtttctggcattgattcatgaatttgctgcatgacatatccaaaaacatattcgtaagcatcttgtaaatcagaaaaatacttataaaatgctcctcgggcgatcccagcatccgtcacaattcgggccacttgtgcttccgccagtgaatggcgactaaactcagttagtagcgcatcacggacgcgagcttgtttctctgtcgtaatatgattgaaagttgctaaaaccattttaatctctcctccggtgacatcgtgtcactatttcaataacgcttattatacagtaaagtgacaccgtgtcaacataagaataaagaaaacacccaccgaagtgagagttagctatgatgagatttctttgcattctttgaaaatacactaaatttttcatcaaaatcgtagactacgaactgaatcactgctatttcaataccccaccataatccctttctaatatttctaattaaaatatgacttttattttctggtaatacatttgaattcataattaagctcctcattattcataataaagtaatgtcttgcttcgactcatttaccactttatttttccacttagtatcagttcaacgttacgtattttttctatgttccattgctaattacctttatcggctagttgcataactaggccttgcagtgtcacaaaagtgatcaattttcgatcaccgacaaaaattcagtaagcactaccaaattcgacatagtactattgacagacgataaaagttgtcgtatattcatgttgtgattaggtgtatcgatacacctaattgactaaaagtactaaaaaatgcgggcccgcatttagacattgcaataaacattaaacaattaggagcttttacgtatgacaaaattcaatcaagcaagtttttcactagcaggtaaagttgccctgattacgggtggtgcccatggactgggcagattttattcggaagcactctcaatgtatggcgctgacatttttattgtgagtcaatcaactgatggttggaaagaaactcaagaaatcattgaaaataacggtcaacatgtagaatttttaaaaaaagacattactgagccagactgtgcagactcgattgttgctcaagtaattaaagcctttgggcatctagatattttgattaataatgccggaatgcagatccgtaacgatgtgttggattttaacgatgcggactggcgtaaagtcattgagttaaatttgaactcactctattatctgtcccatgctgccgctaaggtgatggctcaacaaaaacacggcaaaatcattaatattggttcgatgcaatcgtatcgagcaggtaaatatattttcccttataccgctagtaaacatggtgtaatgggattaacaaaagcctacgcagatgcattggcaccatacaatattcaagtaaacgcattagcgcccgggtacattagtaccgacatgaccaagccattacaagaagatccagttagaggacccgaaattgaaaaccacttgccatctggaaaatggggtaccccaccagaattaatgggtccaatggtatttttggcgagcgaggcatctaactacgttactggagttatgctaccggttgatggtggatacctattgcgataaaagttaggaacggacgtcataactaatattttatccgacggttaacgtcctttttttagcattattttgttaacgctttcaatagttattaaacataaaattaaaaaaagaggttagtattatgccacttctcatcgtcgcagtcggcgtcgctattttaatttttttaattatcaaattaaaattaaacacttttgtctccttgattattacttcgtttataattgcgctagttttgcaaattcccatcgacaaaattccaactagtattgaaactggtattggaggtcagcttggccatttagctgttatttttggattcggatctatgcttggtaaattagtctctgattctggtggtggtttccgaattgctacaactttgattaaccgatttggtagaaaaaaaattcaaattgccgttgttatttcatctttcgttgtaggattagccttattcttcgaagttggcctggttgttttactaccgatcattttcgtaattgctagggaggttgatctcccacttatgtatttaggaattcccatggctgcaaccttgaacgtcacacatgcctttctaccaccacatccggcaccaactgcagtgaccgatatcatgcatgccgagttaggccatgtattgttattaggaataattgttgctatacctacagtcatcgtttgtggcccactattcaactgggtcttgttcaaattatatccacaagtttaccgaaaagatgttgatattaaggtattaggcaaattcagggaatttaaaattgacgaaactcctaaatttgggattagcgtcttaacttcaatgatgccagttattttaattgcactagctaccatttgttcaagtacattgccaaagaataatttaatcaatgaaatcattcaatttattggtgctcccgatgccgccatgttaatttcattaatatttgccatttatacaatggggatcgcacgccatttaaaaatgacagacatcagtgactcattagtcgagtcagttaagcaagtgtcaatgatgctactgataatcggtggtggtggtgcctttaagcaagttctagttgacggtggtatcgcaaattacatctcaacattatttgctcataccagcatgtcccccttgcttgccgcatggctagttgccgcattgcttagaattagtttaggttcagctaccgttgcatcgttgactgctgccgggttggtagctcctttgattgcccaaacaggtgttaatccagctctaatggtgctagctgttggtgcagggtcagtttttgctgatcatgtcaatgatgctgggttctggatgatcaaggaatattttggactttctctgaaagaaacgtttttatcgtggaccactttaacatcggtcttatcgctcaccggattggcatcagttttaacactttcaatttttatctgactatcctgagaagaatctgaaccgcttgattaagatttatcattatttcataaaattttgatatacttgatatattcgaatatcaataaatcaggtgtatatcaaatgaagaagaatgtaacaattgcggatgttgcaaaaaatgctggcgtgtccgtaaccactgtttctagatatttaaacggtaattataaaaaaatgagtccgcaaacgaaggatatcattacaaatacaattaaaactctgaattatgccccaaaagcatccgccagaaagatgcgaactaaatatagcaagatggtgggtgtggtggttgcagacatttctaacgtcttttcatctttactatttaaaggaatttatgatgtcttgcagcctgcaggttacgatgttttactgatgaactctaataattccaatgatgaagagtccaatgaaattcaacgattgttttcacaacaggtagatggtttaattctgcaacctaattcaaaaacgttcaatccatatcagggtattgttgaagccaatcttcccatggtgctcgtagatcgtgaaattaaaactatccctaaagcagttggtgcagtggtatctagtaatttcgattccagctacaccctcggcatgtacttacaaaatatgggttataaaaagatcattaccgttagtagaacattagcagaaatatccgctcaagagccccgaatcgaagcattcaaaaaagcagctcagattaataatctcagctatcaaaatatagaagcaaaagaaatgacttcagatgcattgaaacaaaaaataagtaatgaaattcaatctcatactgaaaaaacagttatcatctctttgatgggtcctttattattcaatttactgagtacgctcagagaactaggactcaaatttcctcaagacattggtttggtgagttttgatgactgggaatggtcacaatacgtcaacgatggtatatttttattaaaacagcagcctgaactactaggtaaaatagccgcgggcaaattattgaatcaaattgatcacgttgctagtacaagcggaaccacttatattcctgtgcacgttgtcaagaaggcttctatataaaaggtcgttgctgtaccctctatatacattcctatattctaaaatcaatttcactcttcgtttccgtacactaatgtttctcgtttgaactttcttacgatatttctgcaattacctttttatagctagtcaagtttaactataaatcatagttggcttgatcaactttcaatgtcacccagttgtgccgatttacatcgatatttttgacgtatcctgtcactctataaatcaagcgaacattatctcaacataccgagataatgttcgcttgattttttagcattctattatcggatattcaccgtatactcatatttttgtgatatcaacctttcattaaaaaaattaccattttatttttccatttggaatcatttcaacgttacgtatttttgcgatgttccattgataattacctttatcatccacccgtactaacaccctaccatcatctagttgcataactagtccttcaatgctaactaccgtttcaccatgctgtaactcctgtaactgaatgtgtacttggtacttgtactcgagcgctctaaaaagggtatccatcatttcttgattggtctgttggggtttcattggttccgcaacactagcttttttgtcctttttgatggtgctcgtatgatcacttaaaaaaaatccctgccacttcaacatgccacgatcttcgtagtcatttttaaagaatcgttgtgctgtctcatcgtcatcattaatcagatcaattgggccatatctatgtttcatcgttctcacctcagttaatcgaacacattaccaccgttatgaccacccacaagtccagcacgttgtaagaaagtgccacctttttttaatttttagctttaattacagccgtgctaccaaaacgatcgcgcagccgatctagtacctcgtcctctgccgcagttttaatctgtcgttcaggtttctgaaataggtctaactgtagaccactgttatcagacaaacgactcaatgacaccgcaatattacgtactacctcgtcattccactgatctctaaacatttttaggcagtatcgagttaactcctgactattacttgttggatcgattcgcattgatcgtgagaagccctgtcgaccatcgtcctcaatacttgagtaaccaaacccaattgatagactgatacaaccagctaactggcgatgatgacgcatacgtgagctagtctgatctacaatttcactaattactaattcaatctcttgtgccaccgtatagtcacgaggtagcacttgcgagttaccccaagatttgtccttaattcgcacggacttatgaacgtcagcacggtcaatcccccatgctaatgcaaataactgctcgcccattaaaccaaactcctcttttaactgatatggatcagcatgagctaagtcttccattgagttaatgccaatttgattgagatgtttggctgttcttgagccgatgttccagaccttgttcagttccgtaataggccagaccgtctgtgggtatgtttcatatgttaggccaccttgtagattaaaatcatgcttagcaattaaatctaaagctatctttgcttgagtggggttttcaccgattccaacagtaacgtacagccctagctgtcgtttaacttcaagctgaatgcgacgtgcaacctccgctggggttttaccaaacagcttccatgaatgttgcatctggattaagctctcatcaatcgagtaagggacgatgtcttctagtgctgcaaactgctgaaagatgtggttaatctgcatattttgatgaatgtacaagttcattcttggtggtactttaagtaaccttggatcatcaggtaggtttctaacccgtgatacgttggtaataccaaagagttttttagccatgggtgatgatgcaagtaccagtcctgatcccgtattagcttccattgacacgactactaggatggatttaagtggattgagtcctctctcaaaagattcaacgctagcgtagaaacttttattatcgatcataaaataaagcccatgcggctccttgctataatccatcactctcacccctgactaaattgataatccaattatacaaacatatgttcgttttttacaagaattgaattattaaaaatagtgctgatagtgccaaaagtgcatatcttttaattggtcttctaaaccttagtacatcaatttttcgacatactaataccattatttctaaaattgttgtcatcgtagcgtccgaaatcacccttttttcagcgtcctgaccccgaaaatcagcagtcatttcaataaaaaaaacacccacctaagtgagtgctcaataagatctgattaatcagtatcttagtatttttcttttgaaagtacattaagttggctgtcaaaatcgtagactacgggctgtccagtagacatttcaagacccatgatgtcttcgtcagagatctgttcgatgtacttgctcaaggcacgtaatgagttaccatgggcagcgatgatgacgttcttgccgtctaataatttaggggcaatttcatcttcccataaaggaataattcaagggccttgaaacgttgatataacagcattcttgcaaaccgaatttgtcaaaaatcgctaatagcgtccgatacaacacacaaaagcttagagcgtctaattactaaactcaactgatcctgcccaattttgaagtacacgataaccctcttcaatacagagattacatttttcttccgacgcacttctttaagatcactattctaatcttttcttcgccgaataccaaacagagctaacgctgtcatcaaagtcatacccaaagatgctagcagtggtgattcagaactatcacttgtttgaggcaactttgttgtacctgacgaggttttatccgaagctgatgccttcaccgaactaccatttttatcagaattgtcagtaacttctgaagtctctggaacttccggagtacctggaacttctggggtacctggaacctcaggtgtttctggaacttttggagtacctggaacttctggagtacctggaacctcaggtgtttctggaacttctggagtacctggatcagtgagcgcatacactaccgtatatgtttgactatcatccgtcgacttaacggtttgctttgcaacctgcgataaatctgaacccggcgcatcattactgatgactttatatccaggtactgttggattctttatttgatcaaactctgtttggtctcctttgatccaatcagttcccgttggcataccattattatccaggttcacaaccgttgtcgttgttgaataatacgtgaccgtcgttccatcgactgggttcgtcacgatcaggaatgttacggctggcgcttcatgacttggagcgaccgtcttgccttgttgatccacgtagttgatcgtttgattgatcgccttggtcgttgtcgccgcataatccggtgcatacacgaccgtgtatgtttgactaccatcggtagctgtaacggtttgggcggcaacgtgacccaaatctgaatttggcgcatcattactgatcactttgtagtgggttacgtatgggttattaacagcttcaaactgcgtttgatctcccgctacccacgcgtcatctgttggtaccccattattatccagttccaagcttggcaagtccttgcttgtcgtgtaatacattacgggatgtgcagcatcgactggatttgtcaccgtcaggaatgttacggctggtgcttcatgacttggcgcaaccgtcttcccttgttgatccacatacttgatcgtttgattgatcgccttcgtcgttgtcgctgcataatccggtgcatacacgaccgtgtatgtttgatcgtctccggtcgactgaacgtttttcgctgtgacctgtgtcaaatcatcttcattcgcatcgttactaatgactttatagttggcaacctctgggttggctaccgccgcaaacgtcgttgcgtccccttcagtccatccagcgtcttttggttgaccagtttctggatccaacgctgtgtccgtcgtggttgttgaataatacgtcactgtcgttccatcaactggattcgtcaccgtcaagaacgttacgggcgttgccgtatgacttgtcgccaccttcgtgccttgttggtccacatagttgatcgtttgatgaatcgtcttggtctgcgttaccgcataatctggcgcatacacgaccgtgtatgtttgatcgtcgccgttcgattgaacgtttttcgctgtgacctgtgtcaaatcatcttcattcgcatcgttactaatgactttatagttggcaacctctgggttggctaccgccgcaaatgtcgtcgcgtccccttcagtccatccatcgtcttttggttgaccagtttttggatccaatgccgtgtccgtcgtggttgtcgaataatacgtggtcgtcgttccatcaactggattcgttaccgtcaagaacgttactggcgttgctgtattacttttggctaccgtctttccttgttggtccacatagttgatcgtttgattgatcgtcttggtctgcgttactgcataatctggcgcatacacgaccgtgtatgtttgatcgtcgccgttcgattgaacgtttttcgctgtgacctgtgtcaaatcatcttcattcgcatcgttactaatgacttttattggcacctctgggttggctaccgccgcaaatgtcgtcgcgtccccttcagtccatccatcgtcttttggttgaccagtttttggatccaatgccgtgtccgtcgtggttgtcgaataatacgtggtcgtcgttccatcaactggattcgttaccgtcaagaacgttactgcgttgctgtattacttttggctaccgtctttccttgttggtccacatagttgatcgtttgattgatcgtcttggtctgcgttactgcataatctggcgcatacacgaccgtgtatgtttgatcgtcgccgttcgattgaacgtttttcgctgtgacctgtgtcaaatcatcttcattcgcatcgttactaatgactttatagttggcaacctctgggggttggctaccgccgcaaacgtcgttgcgtcccctttggtccagtcgtttcctgtcggtaccccatcattacccaactccggactcgttgccgttgttgaataatacgttacggtggaattatcatttaaattcttaaccgtcacaaatgttactggcgttgctgtcttacttggagctaccgtggttccttgttgatccacgtagttgatcgtttgattgatcgtcttggtctgcactaccgcatattgcgtatagatatatacaaccgttccgttatcacccggagtaactaaggtaccattcgcgggtaaactaccctcacccatttttaagaactgataacctggaatatccagctgtgttgtttcatactgcccatttacatttgttcctgatggatattgaacttcaccttgtgcaatttgattccctgccgtatccaaatatttaacattaacagtagccgcttgttggaaatcaaaactactaatcttatactgttgtaaatttttggcaccacccgtagaagcactaacgatcatagccatcgctttatacgtatctgggacagtttttgtccaaatcattggctctccactgtcagtcaaatagaactgtatagttaatactctagtactaccatcatagctaacaataaacttatgaaattttccattcaatgcactgctgtctagaggttgagcagactcctgatctgtttctgcccaccatctttgatagtagcgtccattttttgcctttatttgcttatctgtagtcgtaacaaaagcaccaaactgcttaaaccaataaccatcgggatcctgcgcccagccaaatccatctgaatcaagataaccaacttgagccccatctacagccgctgtaggtgttgccgcatcattatgccaagtatctaacttaaatccaatcgcattttgcaatccgccaattccaagatttccgcccgcattgccgatgtcatccgtattgccattatgaaatgcaaacccaattccgtcagctccgcctcgatcagaagttttatttccaatatttatttcaccggtcagttggaagctagtattcatatctattttatcttttagtgcaaaattcccaacttgatcgttttcatttggggtgagtgtaactatccctgtatttttatcataagttgctgaaccatttaaagtgaaatactcttcaaaattatcctttgtcacatcagttttagaggttgaattcttataagaaacttcaggtatttgcacctgctgattttcacttacagcagtagtgtcattatctttgttttcattattttgtgtgctacttgtcgtattactacttgatgtgttattttcagaactactctgactattattcactgatgtactttcagtcgaagaactatccgagcttgacgtattatcgacctgtgtactagatgcagcgcttgggtttactactgttgctgcagatgcaggttcagtggatgcagtgctagtttccgaagtactggtcgtggctagtgttacttcctttgtatcatttgctacactcggtgccgtacttgcactctgactttcttcattagccgatacagtcggagtatcaacttgtgtggctattaacccaattccaaatactgaaatacctgctactagccattttcgtcctgctttatacatcttaaaatgtacttttctatctccattcattttcttaaaacctcccaatgtttattacttctgtcatgactttgaacaactatgaaaatactgtttttctgcctcttcccgtgcctcaatggcttcttccatcgtcgcaaatgacttcaacagtacgtatcgatttttaaacatcaaacgagcaaaccaagtatcggatttcttatcatatgaaaccccaatatgcccacttttgttgcgggccgtctttttaatcgaaatgtagctaataccatcttgattaactaaagaatcagttctaccagcatttttacgcatttcaatattacttttgaatcgctcgcgcatcacttcacgccggagacagccacaactacgcgtagtcccgtgacgcagtctgatacccgtgacaattactcgattaccacagtcacattgacatagccatcgcgcgttaccacgtttgtcgctactctcggctctaatcactgttaaccgaccgaagcgttggttcaataaattattttttctcatatcagttaccaattgatcattacattttgtaatgatcgctcacaaaaattaacgtagatcacttatttaaaaacgactaccgtcctttatgttatgcaccgctgtatctgtgagtacctttggatttggccacctcctttgctggttgcaatattttcagactcaatttttatcaaacacaatacgaaatacgtgttttggggtacaccctaaaacactgggtattcgtacatacgtaattatgtgataaacgttagcacacctaaaaccgcatttcaatattctaagaaacgtttcattcataattacccgtcatttcgagttttgtaaaaaaataaatgaaattattttaaagggtaactaaaacagagaattgattatcatgctgttcataaaattatgaacatgcaacttgtagcacgtgttttagggcgtaccccaaaacacctaatattgataaatttcccttgattcaaaaaacacccaaaaagatgcgttaactgcatcccttggttgcttttttcattccataatatgtatcattgatataaaaccagactttaaatcatagtgccaaaagtgcatgtcttttaattgggtttccaaatcttagtacatcaatttttcgacgtactaataccattatttctaaaattattgtcatcgtagcgtccgaaatcacccttttttcagcgtcctaacccccaaaatcagcacctatttcaataaaaaaacacccaccgaagtgagtactcaataagatctgattaatcagtatcttagtattttccctttgaaaggacattaagtttttcatcgaagtcgtagacaactggttggctggttggccggttgtcatttcaagacccatgatgtcttcatcagagatctgttcgatatacttgctcaaggcacgtaatgagttaccataggcagcgatgatgatgttcttgccgtctaataatttagaggcaatttcatcttcccataaaggcataatttatccccaaaattatactaagtgttcgaataaacctgtcacattattgtctaatgtatttttgtttaggacttttgggtttatccggaatcgtttgttttatccatccagcttctaatagtggagtaatcatctgtcttcgaaatgaattaatattcttattttcccaatcgacctttgcttcatataattctcgagtagacaacggactacttaacaattttagtatcgttttttgatcctcatttaattctttgataccagctatcgtttgatcagggtcactactatttgctaaattgcttaatccttcactattgaccggcaatttaacgatgaactgatcttcattatcaatgataggttcaccgcctaataatattggtgcaaattcaaaaattttgccaactcctgaccctagttcttcaactaatccaataatatgaaaaattctaacaatattggggttcttaggatatggtcgaatctcaccacgatgtaatttacctggatgtacaggcttattagcattttcaaatatgaccgcattagtggtaattgtcacccgcgaaacaaaaggattggaatactctcgatgaattagcatatttacaactatttcacgaaataaaacttctcttagttcaatccttttatcttttttcaagtagaatgggttacttatatactttgaaataaagttcataatttgcgtatagctatcaattaaattagtggaaattcttaacctatcatcctacctctcaatattgttaatcttcactacgacatctaaaacaaaatatggtagtacagatctgattacttcatcctgtccaaatactaaaatactggcaagtgtatatcccctctgttccgttcaaatagtccttcttgtacattgacaaactttgtaaaacctctaaatcagatttatcaattaaattatgctctccagtcgcgttagtactcgcttttctaaccatatcaattaaatcatggcgaaaattggcgatattcacatacggatatattttattctcagtatattcagactgttttcttgcatacatctgttgaactaaatttgtattattcgtaatatcaatatcggcatccgaattacgatcaaagataattcggccgttcatcctatgtacttgcgaactattaggcacataaacatgcaagatcaacttatcgttaatttcataaggttcaatatcaagatataacggtggaacaattttattgccggactgaattgttgttacaaattctttagtcattttttcaattcgttcgctttgcaacttatttttacatagatatatgtttcaaaagcaatacctctgtaccccaccactacagcttattttgttgattttatatcaaaaacgggcatccgcaactgcggatacccgtttttagattcagaatatctgaatcttagtatttttcttttgaaaggacgttaagtttttcatcgaagtcgtagactacgggctgtccagtagccatttcaagacccatgatatcttcgtcagagatctgttcgatgtacttgctcaaggcacgtaatgagttaccatgggcagcgatgatgacattcttgccgtctaataatttaggggcaatttcatcttcccataaaggcattacacgttcgagagtcactttaaggttttcaccaccaggaatttggcgtgggtctaagtcagcgtaacgacggtcgttagcagctgaaccttcgtcactggcatccagcaatggaggcaatacgtcgtatgaacgacgccagatatgaacttgttcgtcgccccacttcttagcagcttcggccttgttttggccttgcaaagcgccgtagtgacgttcgttcaagcgccatgatttggtttctggaatccacatttgatctgattcttccaaagcatagtgcaaagtcttgatggcacgcttcaaaactgaagtgtaggcgtaatcaaattccaagccagcttccttgattgccttaccggcattcttagcttgcttaactccttcttcgctcaaatcaacgtcaacccaaccagtaaattggttagataagttccattcactttgtccgtgacggatcaatacaagttttgccatgtgattagtgacctctttctttctattaatataatctctttacattttactctgaaacactcaaaatcgaaagtctttttatcaaattacaccgttggttttttcgatcggtggtgccccttatgcttacgaatcgacttcactcctaaaatatccagtaagaacgtgaagatcggtaccccgacaatcaggccccacgtaccaaacagatggtccgccagcaacagcacaacaaacgtgtagaaaactggtagttcggtgcggctcgacatgaattgcgggttaagcacataggtttcgatcgcatggaccacgacgatcatgatgagaatgtacacgacatagcgaataccgccaactgaatacgcaatcatcgataacgggacgcatgatacaatcacaccggccactggcaccaaactcaggagaaaaatcatgatcgagagcgctaaaatctggggcattttcataaatgctaagatcaccgtcgtaatggccgtgttgcagatggcaatgaaaaattgtgcttctaacacaaccccaaaggtattcacgaacttgtgaccaaagtaggagatatcctgaaagaaccaaccgaattcactatccaagaaccgattcgaaaactcattcatttggtccaactcaatcgtgtagaagaaactcaggaccattgacatgaagaaggtgatggccatcgaccaaatactggtgatgtattccaacaccatccccatgccatttttaacctgttccatgatgctcgacttactaatgtagttcgtcacgtacttcatcaattcattcgtatcttgcgactgataaaaatgcatgaccgaatctgtcatcttcacaatttgctcaatgagtttcggcaagtaattcgtaattccgaagtacagtgcacacaacactagcgcataagtcaccaacacgattaggatgcttggtatcttcacataccgtcgaattaaccgtaccatatgggtaaccaaaaaggtaaaaataaacgttaacaaaacggtgctcatcattgagcgcgctaaccataagacaaacacgacgagaatgagtactgtaaaccgtcgtaatttgacatttgtaataaaacgatgccatgcagctgtcatccaatccccccattaattattctgctagcttgattatagcatggtagtgtcacaatattagacagttcttaccaactaaatgtaaatttaggcttctcaatttaggttaactttcgtataatgatcttgtgagatgaatgtaatcgcttacttttcgatggaacaacggccggtaagcacacatcagttagccactgatttgtagttctagccttagcggacttattgggcagttgctccagagcaatgaacgttctggtcgtggtaacacgacattcgagcaaagcaaagaatcttctgatgttagacacgaacacgtggactatgctcacgtacataggatcggcatctaattaaatcgttatctgtcaaaatgacgggtagcgatttttttgctactcatctagccacgtttcgtcaaccactcccgactaaaatcggaagcttgtgagaaccgcacctaacggtgcaacgaccacaaattgcttagatacagcgattgcctgcaagcaggtcttatccgctaattaccaaagcctttatagtccgcaggttgccagacggactgtataattttacattgatgcgagacctttagccaaaatattttgagcggcattatggtcgcgaatatggtgagtttcacattgcggacatacccaatcacgatcggctagcgtaagtttgttagttgtttcagtgcccataataaacccgcaatcatgacatgtctgggtagtgtttctcggattaacggtgataaattttcgaccgtacaggtcggctttataagccaacatgcctaaaaacgttcgccaaccaacatcagaaatactcatagccagagcatgatttcgtaacatattcttacttctaagctcttcagcgacaaccaaaatcgtgattcttgataagtgtggtcgagacgagatgtagaaagtttttgcgacgattagcaattttacgctgaatagtggcaacaacgttacgctgtttctgataattcttggcatcacgtaacggccgatgttcttgtttggcacgtcgtgcccgtcgagagagcttgcgttgtgcttttgccaacttcccgctaacagaacgatagtagcggggattagcaacaatattcccttcggaatcagttagaaaattatcagtatttaagtcaattccaatagcggtagcagtttcattactaactttgtctgcaaaaggctgttcagatgctaattgcattgctacatagtaacgaccggtagcgtccattgagatcgcggttgtaccaatacgaatactgtccatacgattgaatatttttgggggtattcccttgaaacgcaatcgacctaacttcggtaattgagcctgccgagaattaatgatccgaacactaccgttttgcatgttaggtattgctaatttactggcatacatgcaggaagtttggtagctttgttcaattctttttttatgaaatactggtgttccagcatgatgaacttctcgaaataaattccaagcagcacgataatttttgatagcattagctttcattaaactatctaaatcattgtcattcagccaaccatgaacatttgatatgccagtagatggcgtctttaatcgttgttctagtgtttgaattcgtttttgtaccagctcaattggtattttcacttggtgaagtaaaaataattctttattcatcccattcatttcattgtagataaagcgactagcgtcgctattccgtttaatgagtcttttctgttcattagacgggaaaatacgtaattttacgccgtagtgatagggaagtttggccatggttttactcaattagtttcacctcctcaactatgataaaattattatagcatataagcgaacgtaagttccctacaatattataatgaaaacactgcgaaaaatcgtagagctaaatgaggttacaatagaaaaaatggaaatcataccagaccatgttcacacgttgataaacttcgccttatactaatatcgtgaaagcatttaagagtgcccactgcacacatttttcgaaaagcatccagaactaaagtaacaaaaattctggagaggccatctaaagtctctcatagttactacatgaatatcttaggcaacataagcaataagcaaagaatatatccaaaataaaaataaaaataaaaataaaaataaaaataaaaataaaaataaaaacgccttacggcgttaatacatgagcattcatctacctgattaaaatcaggagatttctgccatattgctaattaaaatcagcccataaacggcacccgttttacttaataatcgaaacccactcatccgcttacatggcacttgtttcccgatctttcgttcgattattaagaattgagtcgtattgtttagcactaaaagtcagttaggagtataatgaccaacgttaatttatatgaaaggataagggatttttcacatgctcgaaaaaacttttttcaaaacatttctaagcaaaagcttcacaatccccgttaaagttaactactgggatggttctaccgatacctatggcgatggtgaacctcaagtgacgattactttccacgaggcgattccgatcaaggaaattacccgtaacgcttcaatcgctttaggcgaagcttacatggatggaaaaattgatatcgatggcagtatccaagccctcatcgaatctgcctacgaaagtgcagacagtttcttccgcgattccaaattcattaaattcttacctaagcaaaaccactccgaaaagagtagtaaatccgatgttcaagaccactatgacatcggcaatgatttttacaatctgtggctcgacgatacattgacctactcatgtgcctacttcgaacacggcaaccgtgatgatttgaaacaggcccaactcgataaggtcgatcacattctcaagaagttgaatccgcaacccggaaaacgactgcttgatatcggctgtggctggggaacactaatgctaaccgccgctgagaagtacggtcttaaagtgaccggtgtcactctgagtgaggaacaattccacctcgttcaacaacggatcgaagaaaagggcctgcaagatgttgcggaagtccggcttgaagactaccgtgaactcggcaaagagcaatgggactacatcacctctgtcggcatgttcgaacacgtgggtgaagaaaatctcggcgtatactttaaggacgttaaccgttacctgactgatgatggggtcgccttgatccacggaatcacccggcaacagggtggggcctataatggttggatcaacaagtacatcttccccggtggctacgttcccggtttaaccgaaattatcggccacgtcgttgaaaataacatgcagatctttgacatggaacctcttcgccgccactaccaacggacattggaactttgggatcaaaacttcaatgctgttcgtgaccaagtcgatgatatgatgggcgaacgtttttcacgcatgtgggatctttatctacaagcttgcgcggcatccttccagtctggcaatattgatgtcatccagttcttgatgactaaggggccttccggtcgggttctaccaattactcgcgattatatgtacgaagaaaccaaataactattcgaacaggcattgccacaacagcgatgcttgttttattttatttctaaagatgcaaatcgggacaccttcttataagcaaggtgccccgatttttatttttttaatttactaatatcgtattttctaacctcatccaaattaattgccaaaaaatcactgagaatcatcaacgccggtaacccgacttgctttgtacccacctcatatcgactaatggacgacttagacggagcttgataatagcgcttatccagttctgctgcaagttcccccaccgtcaatcccagagcgtgacgtcgttgcctaattgtcgcacccaacttactttccatctaccgtcacctccatgacattctctattatgcatgaatacgttgccattttacaatggtcatggcgtttttctaacgtatgtattgaaaatatttgatcgatgagctatattaaacacatacgtagtcccagaagtgggatgttaaaggggaggaattcgcatggagcattcaaacgaaaatatggcgccatcccaagtacgcggatggatcgcggcacaccatatccgtcgagcacagatttctgatctgttaggcatcgatgttgcaacggtgagtgccaaaattaacggtcattcagattggcgacaatctgaaattcaagcgctccatgataacctgtatatgccgattgatatctttttcagtcacgatgatcagtcatcattctaatcggtagtgctttacggcattgaaaaagtccaactaagagttgggcatttttctgttgccattataacaccgataaatggtggttgactacgttttaatcttgcaacccctattgaattaatgtaatattggtttgtaccgattcgtatgactttccataagcaaccaggtacgtgaaggctcccctagtccccgctagtggcccttcttttttattttgaccatacacaaaaaggccagtccatcaacggactagcctttatttttttatttgaatgtcgctacaggaagatcgtgaccacaaaaaccgctgctaaaccagcaatcacggacagcgccatcgagcgcgtcatataagtcacgacaatcacgaccagaccggcaatgatgtagttgacgtgcccgaggccactaaatccataactacttgaaacgaaaattccctttgcaaccagcgccgtaaataaactaaccggcacatacttcatccactcattaaaccaatccggaatctcacgggttgagaaaaataacattggaatataccgtggaataaatgctgcgattgctgccaacagaatcaacaacaaatgatccatcgaatccatcttattcactaccgtgcccgcaagcacaggaagattagtccacacagtttccatttgagcctccgctatgagtcattatctttatcctcaaccgttttccgtgttaacgctggccccttaatttttccaaacagccagtgttgcgaaatatgcttgtagtgcttgcggacgtgtgcttcgagcataaatccaacaaacgatgccagcaaggttgagatgatgagtccaatcgtactcttcgttaaaactaggaagaataccgataagaccagtgacaaggcactaatcaaaaacgttaaccgattccgaatctgcatgacgatcatgtataagaacaaggccgtgagcgcaaaatccacgatttccaaatcaatcgttaacgcactaccaatcagactcccaactaagttagccaatgaccatgatagtaatgaatagtgctccaccatcagagcttgacgtggttgccagtttttatccgtggcaaattttaaatagttgatggcatagttttcatcatttagcgaaactgaaaacagccagataaatcgttgtgactcacccttgaggtagcgtgacatactcgatcccagtaacgcataccgtaactcaaggaaaaacaacgtaaccacgatcgaaaggatcggggcgttgatggttaacatagaagcgatcagaaattgcgcgccacccgagaaaaccacgatggagacgagcaatgtcatgatgaaattgaagcctgccgcgtgtaatagaatcccacacgccagcccaatcggaatataactgagacacaatggcattgacgttttcaacaccatcagccagttaggctctttttgtttcaagaatgttcccccaatgaaactatctgcgacttacattaatcgtacatcatccccgcaaaatcaggggccggtacgacttacatgaaatgacatttttatgttacaacgtttcacacaacacgaaaccattttagcatgtttttcagtaattgaataccgtgattttattttaccataccacagtgggtggatggagcggttcctagcgattttatgaccggtatgactttcttactagccattcactaaccggtttaatgccgtcatggaccactgaatcccgtggcccgacatcacaacacccgcagtaaagaaactagccactttacgtgcggcgcggacaaagatgttagctttggcgacgcttgactgggctgctagcgcaacgtcaatatggttgccggctaacgacgccacattgtcacccgtcaactgtgcggttccgaccgtttgtcccgccttcactggggcctgcaacgcatcgttcgcgtccttcattgacgacttcaagacaactgcatgtttcaaatcactcaatttcgcattcttagataaccaaacggtcgtatcgttagcagctcgaagggccaccgttgttgccttaccagcgggaacactaatcgtatcgagtccgtcaatttggtcgcccttcttaatcgtcacctgattgtagttggtgtatacgagttccagcagttgaatcgtttctgagaaacgcgtatccgttccattcgtcccgttagcgtgcaaaacaacggtaataaatcgattattttggtaagttcccgttcccacgaacgaattcccagctgcatctgaagaaccagtcttaaggccgtccatcgtgaccttggttggggcgtttgtatcaccaggcagcatctcattcagattatcaattgtttcagacttggtggcgttggttttaaaggtttcactcttggtcttggtaatttgcaaaatttctggatagtggttaatgatgtactgcgacatcttggccaggtcgttggccgacatcttgttttcggccttcttgctgacattcttgagccgcaatgaaccgaggtcaccgttactcaaaccagtcgcgttataaatttcagcgtccttaatacccatcttcttggcttcggtcttcatcttcttgttgaagctggccacggtgtcaccattggttgtcgacagggcaaatgccgctgcatcggccgacttaatcaaggttgcatggaccaattgtttaaccgtgtaggtctgattttgatccagttcaacgttcgaaaaatcggaatctttcgacatcttggctacggccttactgatcttaacctttgaattccagctcaactgatgctgattaatttcgttgataattacagataccgttaacagtttcgtaattgaggcaatcgccaatttctgtgatccattttgctggtagatcacctgacccgttttcgcatccacgaccattgcggcactagcatcgatggtcgacgctgctttggcattttcgctaaacccaaatagtcccaggttcaaggtcaatacggccaataaaaagctaatcattagttgctttaattttttcatcattttgcttccctctgcatttttgattgattgttctcttatgccactaagctgatgcttgggggccggaccgccccattgtcttgctttggtactgtcgtgggagggtcacaatgaagcacgtttcctgctcatcggacgtcacccgcaccgtcccgtggtgcaattcaacaatactctgcacgattgccagccccagtccggtgccaccagtcgccttagagcgcgattcttccacccgataaaagcgttcgaataagtgggatagcgatttttctggaatctgggcgccatcgttactgatcgtcacctcaacgtcatggttgacctcacgcgctttgatatgaatgtaggacgcctccgcaccgtactttagcccgttagccaccaagttactaaatactcgtcctaacttctcggcatcagcttcaatcatcagattggccggcttcgtgtccgccgtaatcgcaatatgcttatgactgccttccagttcaaagctggccgccaactgttcgagcatctgatcaagattaacattcataatattgaccggtgtaccagtttgccgcaccttcgtgtattcaaacaggtcatcgaccaacgatttcatctgtttggccttctcatacgcggtgtgcgtgtacttgagcaagtcttcttcactgtgatactgcttgtcttcaatcagccccagatagccgatgatcgacgtcaacggcgtgcgcaaatcatgactgacattcgtaatcaactcatccttactttgttcaatctggcgctcatcgttcatcgattgaatcgtgctatcgacgagggcgttcacactggtgacaatgttttgctgatcccccttcaaattaaacgggatccgatgatcaaagtgcccctgagcaatgtaatggagttcggcgatgatgtggtgcaactgatactgatggtagcgccgaatcaggcgccagtagaccaccagaatatcaaccagtaacataaagccgatcatccaccgttgataactccaaatttgggtatggtagggcccgataatgagcgattttttgataataaaaatgccgttttccaagcctggattactgcgaatcgtgtcttcgacgatcacgactaatgacaggttcaacaggcccaataaaatgaccgttataaatccttcaaaaattaatgaacttttttctcgtgctgttaatttcacgtgttatctcctcgtcgaccatagtcgccgtaaatacgtcacgacggccttttacgacattattggctcacaactaggtgggcaacgcgatatctctgatgaccagttttctactacctagtgataccccatctagaataacataggttactcagatctgatgcttagaacttcattaaatttctcgtttttccgcaccgccctcaccgtttctgttggcttatttcaacgaatatggtactatcacgatgagatataggtccagtggccagtatcaaaaaaacaatcagcttgaataacatgttcgatggagcgtcctggcggaaaacaggacgctttttttcgtagtcgcacaaaaagtcaccaaacgtaatgaccacgtttgatgactccgttgttttgttgacaaaataccattttgatacgtctaaccgaaaactcgccaggccagcctatttatcgatcttatagccgacaccccagacggtttcgatcaccttttcgccgccggtcgcttcttcgatcttatcccgcaagtggctaacatgcaccatcacggtcttggccgatacaatgctttcctgttgccaaacccgttcaaaaatatcatccgctgaaaagacccggttcggatgactggccaagagatataagatcccgaattccagcgcggtcaattggatttcatcccccttgatcgtcttcacctcatgggaatccttattgatcgttaacggtccgatttccaatacatctggccgatcattcgtcacatcgttttggctccgccgcaacagggatttcacccgtgccatgacttccagcgggttaaacggcttcgtcacgtaatcgtccgcccccgtgatcagcccctgaatcttgtccatgtcggttgtcttagccgagaggatcaggattggaatctgcgaatccttccgcacttccttcacaacctcaattccatccatttcgggcatcatgacatccaaaataatgagtgcgatatccggatttgtattaagtttggtgatggcttctttaccatcataggcagcgattggttcgtagccttcatttttaacgtagatttctaataattgaacgatttctttatcgtcgtcaacaactaagattttcatagtgagaacctctccttacgtgcgcagttcgcgcgtcatactgtctcaattataatcgcaaaccaaacaaaaaagcccgcaatgtgcacggacttaagaaatccttagttttatcgggcattttcaccttcaccatattcaccggttcctgttccggtcgacgaatcgggtgttgtattataagaactagttgtggcggaattatttgtgccactagttgtatggtagtgttgcgttgaccctgtattaccagtatacgtgctccggcgtgacgctgtggtgccggtacccgtggttgtccgactcgtggtgcccgttgacgtcgatgatgaactccgttgtactgtgctggtactgctacttgaaacgacggcactacttgatgatgaactagcaacaacggatgatgacgagctacttgaagcatcattatccttgatggtaatttccttagttaccgttttgccatcccgtttagcaaccaaatcataagtccccgcggtcttgaacttatacgaaaaatgttcggttgatcgaccactcttggccttgaaggttttaaaggtcttgccagaataatggccttgaattaataggctcgactgtggtgaaaccttgaatttgaccttcacgctgttgccagtcaatgtcggctcttctgggctatacgtaacccctaaagccgctaattttttcggtgtgcttgccgaactagacgacaccactgacgacgatgaaaccgccttgtcttgtttttgatccgcactgctactgtggtttcccttgagcaccagatatcccgcagaccccaaactaccgaccagaaccaacaatagcgcccagttaacaactatccggataaatcccagtggttctgggcgtccttgcgtcacgcttcgacgatagtgtcgaaaaattaaaattaaaaataatagtgccagtaacgctagtaccagcaaataccccacaaccataatgcacctcaaataattatattaatgtttttattttacatcaaagttctagtacctgcagtagttctactaaaataattgaccaaaatccaaaattaaaattaaaaactataccacttgatcattacctttaatattttttgtgctacaatgcctagtatgagcattagtgttagatcacgaaaggaaactataccaatgaaaaaagttagaaaagccatcatcccggcggctggtttaggaacccggttcttacccgctactaaggccttggcaaaagaaatgttaccaattgtcgataaaccaaccattcaatttatcgtcgaagaagccaaaaagtctggcatcgaagacatcgtcgtggttgacggcaaaagcaagcgttcaatcgaagatcacttcgattctaaccccgagctcgaaaagaatttaactgaaaaacacaaggacgaaatgttgaagttggtccaagaaactactgacatcaacctatacttcattcgtcaatcacatccccgcggcctcggcgatgctgtcttgaccgctaaagccttcatcggcgacgaacccttcgttgtgatgcttggtgatgacctgatgaacgataaggtgccattaactcgtcaattaatggatagcttcgaagaaaccggcgcctccaccttagccgttatgaaggtgccccacgaagatacctcaaaatacggtgtgatcaaccccatcgctgaggttcaaccggggctttacaacgttgaaaactttgtcgaaaagcccaagcctgaagatgcgccaagcgatttggccatcatcgggcgttacctattaacccctgaaatcttcgacgtgctcgagcacaccgaacctggcaagggcaacgaaatccaactgaccgacgccatcgacacattgaataccacccaacgtgtcttcgcccacgaattcaagggcaagcgttacgacgttggtaacaagtttggctggattcagaccaacattgaatacgggttgacccatccccaagttaaagatgaactccgtgagtacatcaagactctgggggctaagctagaaaaagaagactccaaatagattgctagatttatcgcgcgcatcaatccttcagtgggttgacgcgcgttttttgcgtcatgaccggtataagtcggcgttcagaacgaacacattttaaaaccgaagcgatcgtggcgccaatcttgtgccataataggcttaatacatcacgcggcactttctactttgggggagttagaatgaaacatttcggtattttcactgccactcttatctgtaccgtcctgctgttggcctcgtgtactagtgcccatcacaaagccggcgccagcagttcaacgacgagtagtatcaaaacgtccagagcgcttcaaaatcctgtcgagcgaatcgtgcccactaacatgcagggcaactggtacgccgtgatggacgacggctcattaattaagctgaccttcacgccatcaacgatgaccgcctctggcgcagatggtggcacggcgatcttccacaagaccggcagcaatcccagtcaagtaccggcatccgtccagaaaaaatgggtccgcggcacgatgaccaccattcggcatattcgttacctaaatatgcatgcctgggaccaaactaccggtcccggatcgttctatggcgtcaccactgaaacctataatggtcagcccaccaccgtccttgtcgaaggtcaaggaacaacggctcagaccgccattctctactatcgaacagctgcccaggcgcgccaaatgcgcggcgtgacctttgatgccgacagtcggttaaattatcagaactaaaacaagctagacaaaaacgttaatttttgtctagcttgtttgtatatccgaaccttaatcgtcaccaataaaaaaatcgatgggcgttcactcgcctgcggctccaatcgggtaattttcgaaatcattcatgaaatcatgccccggcaattacatcgtgaccacttttgcgccccactgatggtcgacaatcgtggctggggtgcccccgatcgtcacatgatcatgtaaaaaaggatggttgaccaacgcattcgcttcgactgccacatcattacccagggtgacatgatcaatcagcttcgctcccggtccaattttgcagtcgttgccaatcaacaccgtccgttcatcatcgaccccaatatggaccccctgatgcagttcgcagttacgtcccacacgtgcattttcactcaccaccaaggaaccatggtgcttaatatgtagaccagggccaaaaacacgagttggcacatcgaaccctagtttaagtcccaaccgatgatggcggtaagcatagtagcgtcggcagatcccatttatcagaccagactggtattcaaagtattcatgcttgcgcagtataatttcaaaccgccacacctcatctcccaacaatcgtggtcgaccagttttccctagggcctcgcggtcagccgccaaaaattggatcaagtcagctttggttttgatcatgtcgtatctcctcctcggaactcggtatcggtcatcactgcgtgtcgtctgctcgaaaattattcgaattaataatcattatcataagtattccttatatattatcctatcttagttccgcgtgaatgtaaacggttttattattttcttcaacaatcgtctgcagtcgcatcgctcataccaagccaaccggattaagccgaccgcttctggagggtgctcaccaccaagtaccggacattgctaattaaccccttggtctccgcaaactcggtctgccggtggtgaccaacgtacacccatcccaaactccccaccagcacaatgccaaatagtcccccgacgttaagccacgcgttggtaagtagctgagtcggtaaataattggcaattaacagcagtgctagtaatagggagccccagtaacggagcgatcggcgcaggtacgttcgggaacttaattgcagtccgtaacgataaacgatgaacggttcccaccacaggttgaccgcgagttgactcgctaaggtccccagtaaaattccgttgatcccgaggtgggcctgcgtcactaaaatcaccgacagaccgatactaaccaccacttcgacaaccgccttaatgcctaacggaaagaataagccatacgcggtgataaagataatcgccgtttcgcgcatttggttacaggcaaagatcagtacaatcaagatgaccgtcgtttttgataagacataggacttgccgacccacagcatgataaatgggttcaacaaccccagcaaacacgccgaagccaccagcgtacacgcaaagttgacgaagtagtgcgtcatgaagaccttctccaccttttcaacattttcgttgccggttgtggccgtcaaattaccaacactggatgtcaccgagctaatcatctgcgtcagcatcagcatgatccccgacacaatcagcgtgtagttggcatacaagccccctgcgtgcacgctgaccagcaggccgatcaataagccatccttggaggtcgtaatgatcgtgctcagtttatagcttactaaccccttcaaattgcgctttaacttctctaagacgaccgccggaattgatgcatgccgatattttttgaggtagggataccggcgtcgcacctgccaagacacggccaagttccctcccagcgtgcacaccagctgaatgattaagaagattaggtagttggaccagagtaacaggctgaccacctgcaatcccgtttgcaccgccaaaatgacgcattgattgatgacgctcacgtagcccatctgatccgcgatcaaaagttgacgcttattttcgttgaggaaaaacaggagatagtttgccagcaccagcagataggcccactgccagttagcaatcaattctcgatcataatgggccagatacagccctgccataaagcctaatcccaccaccgcgctgagcccacacagccaatgatagacccgccgaaacagcccgatcaacgctccaatttgatcatgtttatgatgtgccaatggatcatataacgcgtatacaaaggcactactcacaccaaattctaaacatgacagaaagagcatcaggttcacaaagaaactctgcgttcccagaaaagcggcccctaaaatttggataaagatcgtttgcgtcacaaatttgaggaccaaactgctaaactgggcaatcacggaaattcctgaattaagcatcgtctgtttaaagcggttcttcatcggaatcaatcccttctggcgagccggacagcgagttgcttcagcggggcgtaactatgcgttttaagtgctaagattgataaccgatccttcacccgcagccagcgactgatcatcgctcgtccacttagtcggttgaattgatcgtggacgaaatgggcaatttgggtattttcagccccctgcatggtgagcgagacctgtaaattctttaaattgcggtagtaaaggctccacgcctcctggacgagatccgggtaccacaggcgaataaaggtcagaatttcatccgaaaagcgtaataaatccagtcgcccatcggtcagtttcatccccgtaatgctccccgttcgttgtaaatagtagtagtacggccgaccaatatgcaccagccggtggcaatggtgcaccgcctgaaacaagatccccacatcatcatggtagccgcgccccggaaacgtgacgttggctaatacggtacgccgaaaaaccttgtcgcaaattgatgaatcaaaccgccgttccagcagtaagtgtctcattgcggtgggacgcgcactaaccagctgacggcccgtgaattcatcccccagcacccgctggtcctccgtcacgagatagcggccacacgccccaatgtcggcggccgttgcggtcattgcgcctataatttcagtgtagatgcgtggatccacgtaatcatcgctatccatgaacgtcacaagctctccgtgagccagttcaaaacccagcttgtgacagtaggctaatccgtgattttcctgattaataagcgtgacttccggtcgatccgcaaattccgcacagatggcgggggagtcgtcggttgccccatcattaataatgattaattcaattcggcgataatgttgctccagtagactgtttatacactttcgtaggtatggtgctacattgtacactggtaacacaatcgaaagtaattcctgcttagccatcgtgggcctcctccctagctagttacttaacctggcgatagcgtaaattgcggaccatttggggcatccacgatttaagtaatggtgtaaagcggtagagctgctggaatggtgtcagcgagaggtgctgccgatgtcgattcatcaccgcgtacacattgtgcaattgctgcgcatcacggcgttggatcgtcgcgggactctcacgatagtccagtaatggttctgtcaggttcatcccccgatacccctgtgcgtataacttgcaccatagatcaaaatcttcacaccgtaaggtctgggccatcaccgtatatccgccaaccttcaacaatgccgcgcgccggatcatcaccgtcggatgaacaaaattttgtccccgaaagatctggttggtggtgggataacgcgggcatgcgcgtgtggcatagtgctgtcccggctggctaaacaggcggaccgcacttccaacgagggcgacctgcggctcttgttcaagggcgcgcagctgacgggcaaaacgttcgggtgctgaataatcatcgtcatccattcgggcaatgaacggggcctgtgacactgacaaacaacgattcaaggccaccgccagcccgccagcaaccgtattatgaattggcttaatgcgtggatcggtcagtgctaagcgttgtaatatttcccacgtcgcatcagttgagcgatcatcgcacacaatcagttcccacgatggttcggtttgttgctgtagcgacgcgatcgccgcttcgagcgttgccgccccgttatgcgtccccatcaaaactgaaattttcatcagtgctcccctccttttttaagttgctcggtgaggtaaatttgggcgcaccagatgccgaagaacacccagaagacgcgcgagttattgagcgaaatggacatggaaaacatcagacagatcaaaatggctttggttagcgcccgcacccgcatgctggttgagcgccacccccgccagagctgatagcccacgtagcagatgaagataaaagtgaagcccagtccccattccactagtaattgcaataccgtattatgcgcgatgacgccgtctcctagaagctgctgggccacgaccgcatactcgtgaaacccaattcccagaccactcgtaatcgtcgtgatttgtaatgcattcgtccaagcctccgtccggtccgagccgttggccgttagcggattatccccagaaaagacggtgctcacccgggaaaacgaaggattgatttgttccaaggcctgaatgagccctgtcagttgggtggccaaaagcacggccacattgaccatgatcaggctgcctaacaccaccagcgtcagtgtcaaccagtgccgctgcatcattaatcgtgccagccagatcaccaacattgcgacgccgtacagacacaaaactaatagtgctgacttggaaccagagagaatcgcggcaaccgtaagacagctcacaactagccctttcaatacgggccggtgttgataaaataatccgaccagtggcaagctcatcaactgcaacattgaaaagtagttgggatcgttcatcaaccccttcaaccgaaacgccgtaaagagccacggcacccactggctcgtgttcgtcaccacgacgaccatgcccacgacaccaaccaccacgttcgcccacagaaatgttttcaacagcaccgtcagcatccccgtgcgcgtgccgattaggtagccggcaacgaagtacaccatgatcagccccagcttcagaatgcttccaaagaccgagggattcatgatttccaaccacgtcggtaacaccagcgtaatgagcgtgcgactgatgaaaatgacggccagaaagctgagcccgactagcggcaagcgggactctgcatcccagaacagtaccaaaagtaaggcgaccaacccaaggtcagcaaacgaaaagtttaacccaccaatgatgacactttgaatcatgaagattcccgtcaaaacggtgaggattagccgcggacgagatagttccgcctgtcgcataataggaattgtttgtgccatgggtcacctctcaattctaccggttaccggcaataccgacctgttgatacagttgctgcagttctcgttgcacccgttcgagcgaaaagttagccagtagttgctgaacagcctggggatcaaacggggcgggttggttaagtaataaatgaatttgggtcacgagttgatcgtcggtttgatacagaaagccgttcacaccacttttaatcaggtcttgatgcccccgaatatcggttgccacgacggggaggttaaacgctagcgcctccataatattgaccggtagcccttcctgccgtgatgacgagaccgcaatgtcggccattgcgagaaacggggtgatgtcggtctggtaccccgcaaacgtcacccgattgctgactcccaattggtgggcgaggagttcgtcgtcttgtcgctggggaccatccccgagtaacagcaacttcaccgactcacgcagttggggtaaaacagcgatcaaacgcgactgattcttacgggcgctcagttctgcagcgtacacgagaactgtgtcacgttcgtgatatccgtagcactcacgccaagtttcgcggtcaaaatcctccgccaactgattaacccctgggcgaaacccgatcccgtgcgtaaaaccgacgtgcccgcggaccggtaaccgttgtgaattacggtaatcctcgtcattgatcgtaatgaggaggtccgtccaccgtgcggccaaacgttccattgagtaatacagcatccggttcttacggctcgccgcctgatgaaaatggaagccatgcgcggtataaacaacctttactgccagatcacggctggcggctcgcacaataaacgaggcaatcggcgtatgcgtatgcaccacatcgtacccttgttccttaatcaactgacgaatctgccggtaactgcgcgtgtgctgtaacgacagcgcgcttcgcgtaaagtcaatcgggtaaaattgacagccgagatgatcgagttggggatttaatggttggttttcggcactggccacgtcgacttgatgcccctcttgaacaagctgttcgatatggggcaccagaaaggcgttaatcgtgctggtgaccgtggtcacatataaaattttcatgtccgcccctcctctggttgtaagcagccttgtaatgcccgaatgacgcgatcttgctgatcatccgtcatggctgagccggatggtaaacacagaccgtgggcaaaaatctcagcacacacatctcgctccggttggtgttggtagtacggtacacccgcaaagagtggctgctggtgcaggggcttccagacggcccgggactcgatttgctcgcgggccaattcctgcatcacccaccacggatcctgttcaatcgtcaaggcggtcaaccagcgcgttccccgtgcatgcggtaactccggttgaaactgaacaccggcatagtcgccaagcgcggcctgataccggtcaaacaactgccggcgcttagccacgtacccgtcaagttcggccagttgggcccgcccgatccccgcggcgatgtttgacagccgatagttgtaaccctgatcgatgtggaagtagtacggtcgggcttccttagcttgggttgcgagatggagcgcccgatcgtggtaggcttgcacgtcggttaccatgcaccccccaccaccggtcgtaatcatcttattaccattgaacgagtgaattccgatcgctcccagcgtccccgacttacgaccagcgatctcggcccccagcgattccgccgcatcttcaacgatcggcacttcgtactcgtcggcgatcgccttgagggcgggcatatcggccgactgcccaaagaggtgcaccacgataatcgccttgggtaatcggccacgggtagcggccgctgccagcgcgcgcttcaaagcctgcggagacatattccatgacgtaggttccgagtcaataaacgtcagctcggccccaatgtagcgaaccggattagcgctggcgataaacgtaaagctctgacaaaaaacgagatcccccgcccgaacaccgagggccagcaaggcgaggtggagtgccgccgtgcccgaattagtcgtcaaggcgtagtggacatcatcataatcggcgagggcctgttcaaaggccgtgacgttggtgcccatcgtcgtaatccagttggtttcaaaggcttcgttaatgtagtcttgttcgcgccccgacatgtgcggtggcgacagtaaaatttgttccgtcatgatgggcctccttctaggcgtgccagtcgatcaatccttccacggccgccacgtcaaaaaccggacagcccacctcttcgagaacgttatcccgttccgcaaacgaatcatcgatgaagatcggattagcgtactgtgcgacaattgcacccttactcgtttggcgggtcacatggtggatttgatcgaacagctgggggtcaacgtggtaacgggcgagggtcatggctaaatcatgttggtggcgggtcagtaatacgatcggaatctggcgatttttcacttggtagagtaagtacatgaccagcggattaatctgccccttcaacgtgatcgtgtcatcgaagtcgatcaccagcgtgccgtattcaacgctgagttgatacttgttcgataacgcgcggtccacttcgatatggtacgcgttttgttgtatctgaatcgggtagttcaaccggtcgtaaatgctgagcagtggcaagttcaccccttgaccacggtggagacacatggtccccgcaacccgcgtcgccacttccatcatccggtattcaccacgggtattttgcttcacttggaagaaccagacgccccgtagattaagcttgcggttgacgatcgtcgcaatcgccctgacggctgccggaatcgcgagggccaccgagttcacactgatgccgcccttgacccgccgccgttcgcgaaagccggtaaagcatagcttaccaaaccggtcggtgaagcagtcgacggtgtattcatgtcctgggaggtattcggtaatcagatagtcctccccatcggccaacttatggtccagttcctcgcgggaatgcactaccgacgccccctccgaaccggcaccaataaccggcttaacaaaaactggaaaggcatcgacctgttcgggggtcggataataggttggcaaaatcccatcatccgcgaagaactcactagtcaaccgtttggaacgggcaatttcattggttacccgatcactaccaatcacggtggcgttgagtttgtcctcgtatgtcgcaaagaaaagggccatttgatccgaagcgggaaaaatcaactcaatttgatgagtttcaatcagatcattgaactgctgtaataatcgggtatcatccgtttcatcaagattcccgataaactcacggtagacaaagcgtccatggcggtgcgttggtgacgcccccaccagatggataaacttcacgtacttcagggcattattaatttctaggccgatctcggtatcagcaggatacacgagcacgttaatcattttcgtcattgatgattccccctttaaactccggcatcgttgcatggtcgtccgcactcacatcggttggtttgagcaccgccagaatcgttttgacaacaattttgacgtccccgatcagcgtgatgtggtgcacatagtctacgtcgtaatcaaacttagtctcccagtcaatcgcattccggccgttgacctgcgccagtcccgtaataccgggacgcactagatgtcgttgccggtgcttcgtcgaataacggggcaagtatgccggtagcaacgggcgaggcccaattaggctcatctcccccacgaggacgttccagagctggggaacctcatccagacttgtcttgcgtagtaaccgcccaaacctggtcaatcgttgcgcatcacttagcaactccccgcgggcatctcgaccatccgtcatcgttcgaaacttaatcagttgaaaggggcggtcgtttaggccgatccgcgtctggcgaaagaaaatgggtgtgccgaggcgcagccggactagcagggccactaacagccaaaggggtgacccgatcaggagaatcagtccggccaccgttgcgtcaatcatgcgtttaccaccgttgcgatacataacttacaccaccctttcaactgacgtttcaccattgtacttgcaagcgaaggccacaatcttttggcgaacctccgttgctggaatttggagtagttgttgtgcaaaggacacgatatgggtttcctcgacctgcatcacctgtcccaaaaagatcttgtcatgaatttgatggttcgccgtttcaccgctaatcaataattcttcatatagcttttcaccggggcgaatgccaacttcttgaatttcaatttggtcttccggcaagcccgatagcatcaccatcttcttggctaaatcgtaaattttgactggtttacccatgtccaggatgaaaagctcaccgccctgacatagtgctccggcttgaataacaagctgactagcttccggaatggtcatgaagtagcgggtcatccggaaatcagtgatcgtgatcgggccgcccttagcaatttgctgcttaaacagggggaccacgctcccacgactaccaagtacgttgccgaatcgtacaaccacaaaattcgtctgactatgatggtttaaattagtgacaatcagttcggctaaccgcttcgttgcccccatcacgttcggtgggttgaccgccttatccgacgaaatcatgacgaaggtctgcaccccacattgatcggcggcatgcgcaatgttagaggtcccgaacacgttatttttaatggccgcatgcgggttatcttccattaatggcacgtgtttatgcgccgcggcgtggtacacaatcgagggccgatagcgctgcatgatctgcgtaatcacctgcttatcctgaatatccgcaataatcggcacgatcggaatggtcgtcatttgttccaactcgtgcttgatcaaataaatcgaattttcaccatggcccagtaataataattgctgcggatcaaagcgcacgagttggcgcacaatttcggacccaatcgatcccccggcaccggaaatcaggatggtttgccctttaatttgctgttccatctgtgcaatgtcgagttggagctcgtcacgttccaataagtcggaaatggtaatctctcgtaggttaggcgtctgatgaggactttggagtgcttcactggggctcggcatccggagtagctcaatcccgagctggctggtcagttcaatcagggcggtatactgcgccgcactcagcgtggtcgccacgatcacccgcttaacggctagttccgccagcaaaggtttgagctcatcgagcgtccccaccaccttgacatcctgaatcgccatcttttgggagtgtgtgtcgggttcaatgagacccacaaccgtgtgcttttctttttgaccttccaattgtgtcagtaactgatccgcccgttgaccggtaccaataattaatgtcctattgcaattaattgtgcgcccgggccggaaaaagagttgccgactgtgcaaaatgcgccatactaaccggctgcccataatcagcatcgtggcaaagataaatgcgaggatcacataccgtaggctgtattgggcttggaaagcgaccagcaccaccagcttggtaatcaatgtgcccacacagcaaatcaataatttcataaatccgtggaacccactatagcgcaccacctgcttatacacgtcaaggtacccggcgagcataaagtaggcccctaacccgagaagtgtccccgctaaatacatccggttaggtacggcctgggattcggtcacaaaggaaagtgccagtagattggcaactacgataaacccaaaatcacagaaacggagcaaaatgcctttcgtcgttcgtgtcatcttgattcctcccttccaagtcgttaacgctcgaaggcgacgcacccaatcgtggttgcctgtacggccgctagttgtgcttgtgccgcctgcaggtgttttttcttcgtcactcgcagacataccgccagcaaagtcacatctgtaatcgtcgccagaatttgagcgtcggtactcgttagcaacggcgcagaatcgaagatcactagatcgtagttctgcgcccaatcggtaacgatgcggcgaaaccggggatgagccaaccgatcgctcatcgaggaagtcgccttgcccgttgtcacaatatcgaggctgctatacttagtcggctgtggtcgtaagctactcgtcgtattcagcatagctgctaagcttcccttttcccggacgtcgaagagttcttgcagggcgggcgcggcaaaattcgtgtccacaattagcgttcgccggcccattttagcgtaggcaatggcaaggttcgcggccaagagcgatttgccttctccgtagcgcggcgacgtaatttggagtgtttgtaggtggggatgattttgtgtcaaagatgtccgaacaacgcgaatttgatcggctagcgatgcggcctgatcaaacaacggggcggacgacagtggcttgtgagtcatggcggggcctcctttatcggtgacggcaattatttatctagcttaattactcctagtaaggggagatctgacatgctttgcagttcctgcttggtgacgtgtgaattagcgaattcgcgccaaatggccattagtattgcaacaaggaccccacacaagacgctaagtgtgatcacaatccaacgattcaagcggtgcacgtgggctaccgtgtgacccgtggtgagccgttcaatgttctctgaactttccagcttactggtttccgtctgcaggatttgtgcggtgcgactagcaacatatttcacttctgaagcgctatgaccggtcgccgtaatcgtgaaaattcgtgaatcttcatcggccgcaatatcaatgctatcctttaagtcggtcttggttcctgaatagtcaaaccggtctacaacatccttgtaaatcggcgtaatcaccagcggcgtcttcacaaagctttggtaagttttgatgtttttggttgccacatcattagttttttgttgaccggttgcgatcatcgcaacatcactactgtaatagggcttcactaacacaaacgcaacgaagttcatgaggaccacggtcacaacaaaggccactaaggcaatcgttttatgcgcagcgataatggtaaatagcgaacgacttttaatcataagcgctcctttcgtggaactagcgggcgtagataagaaaaatattattatggttatcatatacttctttacaatatcttatcaaaaaacaatgttttctgtaaatgttttttataataaatattagtttttgtttaatcaaatgtaattcttgtatcatctgctcccagattctagctaataaaaaaagttctgttatccaaaattagacaacagaactgttttttaatttttaattaacgaccataactaccccttaatgaccgtttgccactgcttccaaacatgttgcgcatccacggcgcgactaagttcataagcctgattgctcatcttttgaagccgggccggattcttcaatagtttgacagccgtttggatcatcttagtcggcgtatttggtgcgatcaaatacccattcttaccattagtaatcagatcacttggtccgtacggataatcatacgccaatgtgggcaccccgtgacctagggcttcaaccagtgacaagggttgcccatcaattcgtgcgcagtcgagatacagttgggcattctcatagaccgagctcgtatctggcagataccccgcaaacgtgacgagcccttctaacccagcattttttacttgttcttcgaacttcgccacatcagcaccttcaccatagccataaagcgttagagtggcggttggaatctgatcatgaatcccctgaaagacctgaatgacctgatcaatttgcttgtcaaagcctaagcgccccacatgaatgatccgattgggctggcgttgggccattggcactgattcaccagtcgccgcaatcccaccagaaacctgatagatcttaatttgccgcttgaatcgtttcttcaaatccgccttttgctgtgcggtcatcacgatcaacccgtcaagccggccgatattgtcccgattcagtgcctgctggtacacgccactcagcacgcccgctaccggatcattgccttcggcaacgtgattaatcggtaaccagagcatttttttagccggcgtcatcatgtccatcaccggattattcgccattgccggtcgatccgcaatgaaggtattatcctcggccgtgctgttattcagctggtcaaggaaaaacgtaaacaggtcatcgatcgtatcaaagtagtaatcgtgcccctgataattaatcaaccggttgagagaattaattggcgtattttcggttgatttaacgtagtagcgttccatgtacttcgtttggtcggggcgatacaaggcttggtaatgcatctggccgtcttgaccgaagaactcatccgccgtcttgaaaccgcggatatcatactgctcgcggagcgtcaaattaccgctcccatcaaagtagtcgatggtacgcactcgggctaccgtgccgggggcaaagtgaacctccccgacagtccgccccccatcactaaatgtgcggaaattattgcccgtagtgaactgataatcggtgctgaggtgtagcgcgtcaaactttaacggctcccccgtataatcagtggttcccgcaaaaaaatcaaacatgttttgtacttgatcatcggccagcccaaacttcttaatcgtgctgtgtaaaaccggatcaaagtcgcgggtcacaattttggcgggtgtctcgaactgctgaaacaattttacccgcgcaaattcggcgtgttcgacactggaattttgactgagaatatattggtttacaaaataatacattgttagcgtgcctcccgtgtttgataccactgatcggcatctgcgatcaagttttgccattttttcatgatattagtctccgaatagcgttcactatcggcataggcctgttcgctaaattgggccagttgagtttgatcgctcaacaacgtcgtgatcgcggttgcgagaccatcaatatcaccattttgggtcaaatacccatcctgcccgtcaacgaccacatcggccggaccatagtgaatgtcattggcaataatcggcaggccgtgcgactgtgcttcaaccaaggccaacggcaagccctctgcccgactggggagcacagacagctgggcatggtcgtagacactcgcaacatcattggtgtatccccgaaacttgatcgattcagtcagatgggcatcttccacctgttgcttgagttgtttaccagtgtcaccattttcgtagccccagaaatcaagagtggcctgtggcagttgctcgtgaacctgttgccatgcccgaatcaaatgatcctgctgcttttctggtgacagccgtgccaccatgataacgtgatacggctgccgctgagtaaagtcaacatgcggtgcgttaagctgggtggccggaacgatcggccctggaatctggaatagcttggccttgccggtcccgaagcggtcgtgcatgtcgcgatcttgctgggatgtcaaactaatcaccgcgtcccaacaatcaaacttgttcagcccgtactcatagttgtagttcaacggtgagtggatcatatcggtcacatcattcacgtggctattgtgcaactgaaaggcccggtaaacgtgctggttcatatgcaataccgaccagcccaactcgtacgaccggtccgtgatcaacactggacgatcattatcattgatatcgggatctgtgaccaactcatcaaagaagaagcgggtcagttcatcgaagttcgcgaactggtacgaccggccccgatagttaaatagatgatagctttcaactgcctgcccccgcttgtcgagtaaccgcgacttttggatggcgatactgccatccagccgcaggtaattttcggtggcaatctggccatcccaatcataagcgtgctctaccgaaataaagccccggtcatcataccagtccacttttagcaatttgccaaaatgatcaaaatactgaacgttctggacccgcttgtcacttccacgcttaacatacataatccggttattgtgtcggtaatagttatagctgtccccatcgggaacccgcttccagctcggatctagccgtaaattttgaatacgaatttttttagacttcacttcccgcgttccctgaaagtagtcgtataggttaattaattgtcggtccgcgataccggccgcattggtgactttatgcaggtcggtcgcaaactggcgcgtcacaatctttgccggcacttgaaactgattgaacaggtttaaccgcttaatttgggcgtgttcaatccccgactttttttcttgaatattatcatttaaaaaataaaacatctatgcacccctgattgacgtcatcgtttttgcagttgttcacgttcattctatcaaattttgcgggaactgggggatgataacgggttacgttttggttaatattggatgtcgtgttgggggatgaggatggattgtttcagtaagagcaacataaaagcgcactcggatagagtgcgcttgttaatccatgacatggcaaactggtcagaatttattcaatttcattcaccacaagtacctacagtgcagtagtctactttttcacacgtgcccacattttttcctgcactttcggccaagcaatttggtcaaacttcgtgacgttcagccattcaccgggaaaatagcttaaatcaggccgctcattccaggttacctgcagtaatgtgattgtccatttttgatgcgtaaacgtgtgcgtcaccggtcggccctgtactggtttcaaggaaactttgaatccatattttgtcattaagtactgacacaacaattctagtatttccgagtccgtcggctcatcatccccagaatccgtggccgccaacacatccgcttgtttaaccagtggaaacgtccaaaagttagccagcaacccattactcggtcgtttttccatcaagtactgatcagcatctggcatcactaacccaaagtacgccactggcttgggccgcggtttcttcgtcttaaccggatattgatcctcaacaccatccaaatatgcctgattaaactggcgcacgggagagtgttccgagtccggattcttggcgctcatatagctcgcaccgagatccataattgcctgattaaagtcgcccggacgatctggtgaaataattcgcgcaattacctgttcaaaaatctggcgtgtctgtggtttggcaatatcagcgtcaatttttaacagacgtgcaaatacgcgaaacgcgttgccatcgactgccggcacgggttgaccaaacgcgatactcgcaatcgcgccggccgtatacggtccaattcctgccagttcgcgcaatccatctgccgtttgcggccattgtccgtgataatcgtcgacaatctgtcgggccgccttctgcaaattgcgcgctcgtgaataatacccaaggccttcccacaccttcattaatcgtgcttctggtgctattgcgagctcttgtaccgtcggaaaccacgtcataaaccgttcgtagtacggaatcaccgtattcacctgagtctgttgcaacataatttctgaaatccaaacgtgatacggatcatgattccgccgccacggtaaattacgaccgtgaatatcgtaccaatcaagtagtgtttgccgaaacgcatcaatcgtatcttgcgaccattcaatcatcagtaattttctccgttcgttaaatttactgctatttatggtctcatagtgtctggtcgtgcgcaacttgtttgaaaagtaatgtacgatttctttaagagaaatttacaaaactgtcatagaccgattagccaaatgaatacataaacttcaaaatactctatcgttttcttgaatttgtactaatacttacgtatagttaatttaatgtattttagaattcattcatagaaggcggataaagaacatgaatagtgaccaaactatcaacaatatggcaccaagtagacaagctatcttaaatgaaaatattcaacataaactagacggatgggatagaactcgtcataacagactgcatgcttctgaacgcttgaaaggctatgcagacatctggtccgtcctcacatttattgttaacatagttgccattatttttatcattttttcttttgaactaaattcaagtcgtactcttttggtcacatcttcattattttcttgctacgttatcattttgcaatatttcttaagtacccgtgattataatgcgcgtagcttaaaattacattatcagcaattagaaattgaagacttaagacgacagctaaaacagcttcaatttttgccaagtcaaagcatctcagtcaatgaagaaaaatttaaggatatcatcgcttgctaccaaactagtcttaggggtaacgaaaaccacgtcactttggatgatcgaagatataatgcagaaaaacatcatacgtgttcgcacatttttgattttactttagatcaattatttatttatctaaattgtatagttctttttgccatgattgcattaatgtgcaaactatatttttaagaatgaataatcaactacgaaatagaatactccgaacatctcttgaatacacaagaattctgggtaaactacaaccttacaaaatccaattcatggcaatttataactacttttctaaaccgtctagagtaaaattgactcgacacaatgtatcctactacgcttcacctattacaggggagcataagaaagattgtgaatatatcagagatttattatataagaatgattatatgactccccgtatggctgtactaattaggccaaaaatatatgcatactacacatttcaaacatttatgtacatttttaaaacaatactctctcaatcgtccgagcaaaaattagatttttctacaaagcatattaaggtattttatgcaggttttcttgaattaaaaagaaataatctaaaagagaatgccacctacataaaaagttataatgattttcaagaatatcgtacaaagtttcagggatcgcgcgtattaaaaattgatattcaaaatttttttgttggtatcactgctgagcgccttcaacatgcattattacgactttgtaaaaaagaaggtgtgaatgcaactcaagaaatcaataacatcattaattttatgcactatagtggctatactagtctgcctcagtcacgagccttactcgcatcatctatactttcacaaatatatttaatacgatttacagactccttagagactattgcagttaaatataatatacatattgtcagatacgttgacgatatgtatatccagcttcctcaaaaaatgcacaatcgagatgttaacaatttaataaacataattagttctgaactatggaaagatggcttaaatttaaattcgaaaaaagtaaaaatatttagtgtcgaaggatacaaaagaaataccaattgggcaatcacaaacaactccacttacaatactaaatttaaagttagtatatatatccaagataaaatcaacagcttacttgacaacaatggtgaaaacctactagaattctggaattctgtacacaatttatggaatgctaaaggtaacgatatggagaaatacctaaaaatagcagataactaccttagcataaaaaaagatgatacaaataagataatgaacaatcttattttcggaaatcaatggaaaaacagattagatctttccgctaaaaaggctttaatttcatttcccgaaattatgacattcgatcctgttaaatatgttacgtttttgaccttaattgaatcaaatataaagttgctagataaaaattacaaaagtacccctgttggtgactacattaaaattatgcacaatcagctagatgcagtgtcctacactataagacaaggtttaattgattcaaactattttgttcaggttaaaaacagctcagtaattgacaatggcaatctgcaggaattgaatagcaactacacagaatttatttatcgctatatacttgctccaaataaaaaaacactaggtgtaaatagcagcggtaaaatgcacgcccaaaaaggcgattaagaattgtcggttttcctgcatttttaataacatggatcacatcataattatgaggaggacttcgatgtgagtaagcacccaataatagaccggcaaaattaattgagccatcacctcgaattttgagatgatgactcaattttgattttaagcttcatcttgcttaatcgatgaagagttataattccatggtaaataagcctccagtttattctcaatttattgttttgagagctgtgacacgttttttaacaaaaattcaatatattctctgggattgattctgtttgctttggcactttcaacgatgctcatccagatggcatttgcttcagcgccttgcgggctggttgagaacagccagttcttgcggccgatgacgtaacttttcatattacgttccgatgcattattggtgaaatcgacttcgccataaagcagaactcgatttaatgcagttcgttgaccctgtgcataggcaatggcttttcctaaacgtgttttaggaaggacatctgccatattgcaccactgccaaaattcatcaagtaatggctttagatacttttggcgtgcctgatatcgtgcaacactatcccattttcgccacttttgttcttcatgcatcatttgaccaattagagttaatccctttgatgcattgaaatgtttcttgtcgatattggcatcgtcataaaatttacgtcgtacatgggcccaacagccaacatgttcaactgagtccgcaatggcgttataaccgtagtagccgtcacactgaagaactcctgtaaatccggaatatagttgctgcgccacttttcctgcccgactatctgcatagtgatagcatacaatttgatgttgggcacgaccgatggttcgtgcaagccaaatatatgatttactggtggctaatttaccaggctcttgtaaaacttgatagggcgtttcatcaccttgaaggaatttctgggataccaaattttgtcggagtagatcataaaccggcttcacaatctgggcacaagcgatcatccaattacccatagtcttatcgctcaaatccagtccttggtttttccaatatcctttttggcgatacaacggtgtgccgaggacatatttgtgataagcaatttcagacactaaagaagccgatgccatgctgtgaggtattaacgcccttggcgcatttccttggtagagatggctaatcgcatcttgttggtcacattgatgacatttgtaagttgcctcatatatgttggcaacatatagtcgtcctggaatcacacgaacttcttgtcgtacataatgtttaccaactcgttggaggtcatgcccatgtggacacagttttatcattggctcatggacttcatcttccgtcggaagatcagtactgataatctcagatcgttttcgttttggtttacgtgtcttgccattttcaccggttgttacttccggttcttcgctttgttggccagtctgctctggttcggtaaaaacaccattgtcctcaaataacgattgttgattaggatcatcaagtttttcggaatgacgcccatataacttattggtcaggtaagcaatgttctcgttgagctgcttgatttctttcaaaaatttagtttgttgtctcaacagctcctgattttgttgaagtgcttcgtgcaataatttttcagtcgacgtcattacataccaccaccgttcattgttgtgttggcatgattttaccactggtcaccgtcggtgcctagtgttttctgggcggagtgctctgttttatcgaagattctaatgaccaccctgaaagtagtctctcaagttgctttgaatggagctttttgacttcattcatattacgcggccattgaagtcttccattctcaatccgcttataaagtaacagaaatccatcgccatcccaaagtagtgctttaaaccgatctttccgtgtgccacaaaacataaatagcgatttactgtatggatcaagactatactgctggctgacaacgttagccaatccgtcaattccacgtcgcaaatcggtcctgccacataccaaataaataccgtgaagttgtttcatatcaatgatcattcctaaacaccgcctttaataatgcatccagaatgtagttattgattcggttgtagacgagaacagtcttattttcacctaacttcatttgaaaagctttactggcagtagcggcctgataattttttggttgatccaatttcacttggacaatttcttggtcattattcaaaaaaatcacctcatcatatttgataaagtgattctatcgcactgaagtgcgtaattatagccggtttgttattgggtgcttacgtttttacctatgcttgacagatatttaacgctgcactagtatcgcgatcatggacaacctcacagttgggcatgtccactgccgaatattgagcgtatggtaaccatcagcatacccacaattagcgcaaatttggctagtcttatccggattcaccatcactaattgtttgccataccatgtcgccttgacaaaattattccaaataacgttatttttttcgaaaaattaattgtttctcatagctattagcaacaaatttaagatagatagtgagaaaaagaattacatatataacgccataaaacaaaaatactaggaccgaattgatggggacgaatagttgactaattaaagttaaaaaagttgaaactaaaaatggaattgctaccgataaagtccttttccaatataaaataatatctatgcccattttgaactggtaataccagttcattaggcagccatttgcacaaatcatcccgataacataaccactagatgcgcctattaatccaaaatatttagtacctactacagtaaacacaatgttcactacagagaaaataagaagaactattgatctaaaagcatgcatattcattgctctttgaatctcaattccaatattctgagaaagaggaccaattgatggtaagaccatcaatattatcaaccagtaagccagtatattcttatctcctgcccacaaatgaataaaatactgtccaattacaataaagccaccaaaaacaaaaagaaggattaccatttgtaccctacctattctaatcatcaattctgttaatacttttttttcttttttttgactaactaattcattaacttttggaataaaaacatctgatagagaaattgacaacataaaaaataaatttttaatttgaattgcaattgcaaatattgcaaccttctcagcaccctcaaaaattcccaagacaaaatttggtccactattattaataagatcaacaatttgattcaaaaaaataaaaaaagaaaacgccaaaacttctttgaacatcatgacttttccatttctaaaattaaacttcatatttaactttcttatacaaaaattggcatttatgaataagaacaaagttgtcacaatagtttgggtaatcccaattgctaaaacacctgaacctaacatgatcattggaactgcgatcaaaggaaccaaaattgtttgcatcagttgtcgaccttgttgataaataaacctttgattaacaataatatttgaatcaaataccgaggaaggaaaagttaatgcaacatttaatatcataattcccatcaatttttccattaaactaatctgactctgttttaaattaaaaatattatcaacattgaaagccaaaatactaccaataactattgctattaaactaattaaacagaataatattaaatacataccatttaacttctttaaattttcacattcattattacttttatattttatataaaaatgaacgtaagaacttgaaaaccccattgacaataaacttaaactagtaattactgaattagtcatctgaaaaagcccataatcactttgcccaatatatttcaataaaaaaggagtatacataaatgttacaagattctttacaattatattaatatatgacagaacagcacctgattttttttgcgaaaacattttaactaatctccgtcctaagttatcctcttaataaaagagatgaattcctgtataattcatacacttaattctccaataattttattatatttacattacttatgaaatttataattagtatcttaatttatattagtgataaaaaacctagaaaaacttttcccaaaaaagacaaaatatttatttgaaagcttaaaaaagctatttgccatgcaagtccaaaaagtccagtaatcataaggagaaaatagattattattcgagatcttttttttatttggctgaattttacgttaactataataagtggtataaagatctccacaaacattccatatctgtcaattaaaggggtaggtaagaaatagcttaaaattgataatattgttatcatagttaaaaaaactggaaattgtttttcgaaagtatttttttgccttttcgcaatagttatcagtatcagtataaataacattacatacagtaaaaaaaggttatttatctggtaataaaaacttgtatgtgcgtattcagcaaacccgccaccgcttgaccctaatccataagcactgattttatcgctggtcatgctaattatattagaatgtagccctacgaatactaataatacgcccaaaacaccacttaaaaagcgatgtaatagatttttgccaaataaaattcctgtaagaattctacagataataattggcactacggctacatgcattgaaagagctaaaaggtataataatacagttattataccttttttatgaagatataaatctctaaaaattgcaacagcaactatagcattagccataggattacgtacattggtcagtacccacccgaatgatattataaatactccaaagtaagtagccatttctttttttaatacactatttttttgacaattatttttttttaagtatgttgttactatatacatataacatgtataaaaaacagaaacaacaaaacccgaaaacaaactattattatgcaattttgcaaaaaaggccaacataagcttctgtagaataaaaaaatttttttcactgatagcttctctaaataaatcattatagctaatatttacgaagttagggaaccaactaaaatacttcccaagatcagcattaatgttcgttaattcaatacttattcccagataaaaaaaaacaatcgctgttacaattattagcttccatctattaataattttatttttcaaacaagcatgaatagtatatattagccctaacatcggattaataagtaacattaaaaaagtcattaatttatctcctacattttctaacttgcaattaaaatttatttatagcatttcacataaaatctgaacggcactaacgcgccacaagaacgtttcaatcgactagaaatattattaagctgcctaattatcatgcataatcccatcaaaaggcacaccaaacagtcatcgatggttaacttttacactgttacttttgataatagtgagtttactttgttaaacaatgtttctagaaaaaatgtctattttgatcacccatactttccttgggaagatgtgcccaaggataacacctatggtcttctgcgtgggttcttctcccgcaaaaccattcaaagacacatcatcaattgatattcagagttcagtatacacttaatcaccatttgaaaacatgctcgaaatatgtatgtatccagcggatatcatccctaagctctctgattagctataccaatttattagaacagatcaaaatattgtacttagtctaacaattcggcaaattaactctgaaccatgccccatagtgggtcatatcacataaataaagtaaatgtatttttgatttgattgtaaatataatcattgctattagcatttcaaaactagtcatttatggtttaaccgaataaaaagtataatataatagtcacttttttgttgggcctgttagcattagtttccattagagaattttagtagctttttctatacttatgactgatccactaatcttacaaaaagttcgcgccacacttgtacaatattttcaattttgaaatcttttgcccgttctaaggaaagagcctggtatttggaccaaagttcatggtcatttaacattcgtactatctcacatgcaaacttctctatgtcgtaattatcaattagaattccataacgcccattctctaaaatttcaattgctccagcagttttaaaagagatcacgggcacccccaaactcagcgcctctagaattaccaacgaaaaaccctctgtccttgaagtagaaataaacacagaagaagattggtaatgttcaatcaaagcatgtcccatctttgccccgttccagttaacttgctgactgattccataacttttaactaacctttgaaattttttttccgacttttcatctccagctcccgctatattcagcctaattgaatccggcaatttttgcattattttcaccaacagatctaatcctttttgatcttgctcgaaagtaattcgaccaacaaatgcaacattaaaccccttaaactctggaaccttagttgtcatattaaaacttaatggattatgtatcagtgttatattgtgattatatttattaaaagccaggacagcatcttgggtcaaacaaactatctggttggcagactttattccacgtataaagctgctactaaaattttttgctaattgcgtaattgctttatagctttgatgaacccacaaaataacccgaacgtccccacagatttcttttataagcggtacagcagcaaattgttgggccgaggttaaaaccaatacatcaaccttctttatacgaattaactcagttattccttgtataaaacttttttgatacctattaacattaaattctcctttaagaagtaactctaatgcctttccagttctaaacagaatacgttttttttggcctaactgttttttttgcttaattaatcgcccagactcttttatcttccaagcaggttcctccattgagagcgagtaataatacgttgaaaactgaccaccattcaaattttcgccaatcgtagttacaactctctccacaccgcctaaccccaaaccattggttacaaaacaaattctcatctactttccactctccttcaatcgcaagtaaacccattaatgaatttatcagttaaactgtccgcaacttgttgactatcgtaaccattttcccttatggtgcttgaataaggaacccgtggctttcttaaaagtgaaaaatcattaattatctgattcgtccattctaatgcagtgcctattagtgaaatctttttaactagtggtgtttgaattacctcatcatgaaaagcgtccgatacataacatggtaatcctgcgcactgtgcttcaagtaccgacataccaaacccctcaaaaatagagggcgcaaccataacatccatagcttgcattaaaccagctatatcattccgtgctccgaggaaaataaccttgtcattaagctgatattgggaaactttctcttttattagtttttcttgtgatccagttcccactaataatagtactgcatctttttttctcgcacatatttcttgaaaaacatctataagaaaagaatgatttttttgtggtccaaatcgtgcaacattcccaaccacaaatttattttcgatattcaacatcttcctgtaatgctcgcgtatggtgtctgaatacccgaaaagcattgtgtcaatagaatccgcaaccacatcgaatttactacgtggaaacatccattcaccagctttttgactacatgccagtcttacacactttttgtgttttacgtacggtttatgtattgtgtcaagaatttttgaaacaaatagattcttttcaatactatcattgtgcgcgtgaataatgggaaccgtgttctccataccataagttgctgtaattcctaagatattgcttaatgaattaagattattataaatataacgatatttaccagttcttactatcttataaattgccttcttatttgctaaataattatctctacgtgtagggattttaaaaatacgcccaccaagcttctttatttctttactgaatgcaatgtccttttcgccgcaccaatcaacaaaatcaaactgaaccctctctgtatctattttccgatataaattcattatatacgattcaactccaccaggattaggcgtcatacctatttgtagaacaaaaattttttcccgcttcattattttaacttccttttaaaatggttcacatatttttttgcgtgtaagataaggggaaacaggcgatacttgagcgcccttaacttaatctcttgtcgtatatactccctccccttatcttgatagtgatgtaatttctctaaaacgcgtattatttttttttcgttcattaaatctaactcagatagcacgcttttattagaccgagattgccacccattcatcctaattaacagcataaaaagcaaattaaactctaagctcttcacatctggaagtagtgattcaaaattatttttaacataactgtccatctcatctattgttattaatatatcgtcaacatccgtattagcaggtcgatgtgtaattgatgtatttacctgcctataataatatagcggttttgaagaaaaataaacatgactggcagcaccgaacaccttatacgtcgtagcaacatcttcaaatcttcttcccttaggaaatgtaatattattattgatatataaatctcttctggcaatgaacttccatgcataactaccaaatgatcctctaaaaagatgagaaagagcctcactgctattaacacttcctagttctgggtttgaataccctgctgtcgtcgtgtatgtaccaagaacctcattataactgaatgcaactacgtccacttcaaactgtttaaatatgtctaccacttcagaaatcaaatcacaattcagccaatcatcggagtcaacgaaatacacatattctccacgagcttgttttaatcctaaattccttgcatttgacaatcctccatttggcccacttattaaattaaatctactatcttgcagacaaaattgatcacaaatctgcttgctattatcagtagaaccatcgttaactaatattatttctaaatttttatatgtctgttctttaatgctagttaaacattgactcaaataccgttccacattgtaaaccggaacaataattgaaactattcctcgcatgaatttatacctcccttataaaaactacatagttaacgacgatcactttctttacgtaatcataattaataaacgaaaaatagtttatctttccttaactaattttttatacatttcattccaaagcacaacttgacgtttgtcagaataatctgtttggtccatcttatccccgaacttttcccggttagtttcgtcaggcatttcactagataaggtggttaatttcttgatccaactatccatcaaatctagacttaagaaatcacaattaattattcctgcttcttttgtaatgttatcactcattaaaactggcagtcctgcgctttgagcttcaatcgtagttaccggtaacccctcaaattgcgatggtaaaataagcacatcaagtgctgagtaaagatcatttacatctgtacgttggcctgtaaatataacattattttctaccccaaatttcttggtaaattcctttaaatgatcatatctagatccttcaccaataataaggagttttattgattttttctttaattttagcttggaaagcaatttgattgagaactcttggtttttttcagcagacaaccgtccaacttgccccattaagaaaacattatccccaattgaaaattcctgccgaatttttttccttttatcactattaaacctaaatttttcgatatcaattgcattgtgaaaaactgtaaaatctcttgttccgaaaattgcatttcctgccttattagaacaagaaaagaaatcagtagcgtctcgaagtatgcctaaactaaacaaatagtttctagcacttttcatccgatctcccccaaaaacatcgttatgagcatgcataattctcaccggaacattcagtctcttcgcaactttaattccctcaccccaaattgaggaggcatgataatggacaatatcgtatgagttttctgttaatattttatttataaattttctaattttaaaaaaatcaaacttctcatactccttcaaagtgtatatcttgccacctaaagcttctatttcatctttgaaattatcatcgtggtattttccagtagtaaaatcgaattgaaattgtgacttatctattctacgatagacattcataaccacctgtgttcttccatcacttctatttatactgtcagtaagttgtagtactcttatcaaagttattctcctcatatgtcatctagtgattactaattaacaaacattgtgtttttataactaatttttgctaataggatatgtcttcaaactcaaaaatgttcggaattacccgaatatttccaacatggtatgttggaatagataagtacttccaatgttaacgcatcgatacgatattacttacgagcgatgggaccagatcaaaagtctctttccgatttatgttaccggccaccaagttatccatgataatcggacaatgtttaatgccatactttggccgaatcgtacaagcgcaccttgccgtgattttcctcaactttttggcccatgggaatcattttgtacacggctgacacgttgagccaaaagtggcatattaacatacatctttagccctttgaatgcttctgccgatatggaatattcgcatattgactcagccgtgtttatggcacaccagcatagaggtccagatcttgatcccaaccaaattggcaagttcgttggtagcaataccacaaaaatttacgccttagttgacgctcttggcaaaccagtcacattcatgttaacgaggcatgacggaccagtagcacatgagttaccaaaagaagttgccctttcaggcatgaatgtcgttgttgacaaggcatacggcggtcataccattcgctatgataagaccacatacgtgtctcgaacatttatctacatcgcagcgatattgttaataacacagtaatttgaaaacaaagcataatttttgtagctttaaaatatatttagattttttattccaccacgccgtccatacattccttcgtttatccacatatataccaaaacatcagacatatttttaaccatctttccacttgaaatagccttaacccataaaaaagtaatcctcaaaattacatcatatattgtacccgccaacactctgcaaaacatttcttactaaccatcacagttggatggttaacgggaatcattgatccactctcctttgaaatctgctaaaagcattatatatgtacttaattgtaagtaaaaacgatctaaaattttttccagtatattttttgtataaagagtacgtccaaagcattgctttccatttattgctagacaatgagtcacttcttaacatataggatgcaagatatccctcataaagaaaacctttgtaaccttctttaccaagttcaagccacagatcatagtcttcatgaggtatatttttaaatggatgttcaagtaatatgttcctttttataaagaccgttaataaaccaacaggatttccacaattaactaatcttgaaaaatcgtattcacctttttttcgccttcgaacagatactttagaatattgttcattcattacaaaataatttgaaaatagccaatatatgtcagtattttttttaatgatggtatgttgaactgctagtttagacacatcccaaatatcgtcatcatctatgaaagcaacgtaacttcccaccgaatctttaactcctatatttctagcttcagaaactcctatattcatttccaaagaaattattctatttttaactgaacatctatttagaattttttttacaatatctatggtttggtctgcagaagcatcatcgacaataattatctcaaaatcagtgaatgtttgatctataacagattctaatgttttactaattgttacagcagcattatgggttgtcatcacaactgaaaagaaaggcatcatagcaaaaatctccttgtatatctttaagagctcaatgaattccagtattttaataggccgctatgcaaatcatatttacctttatatccaatagcatttaatctatcaatatttgcacaagatctcacaatatctccaactctagaatttgcataaccaatattcagcctaacttttgaaataccttcaagacagctaaccacctcattaatacttgtttcattagaagttgcaatattataaacagtatgtaacgcagtagctgaattcataataatgatcagtgcttgaataacgtcttctacataaataaaatcacgcgtttgcttaccatcaccatatacactgaataactcattattttttaaagaatcagctataatcgataaaaccccagaatatggtgattctggattctgtttcggtccatatacattaaaaaatcgagtgacaaccgttggtatcccgtaaagtttcccataattaatcacaaatcgttcagtcgcgtacttatcaatcgcatatggggaaagcggctcaataggtgatgtttctttcttgggcaattctggattattaccataaacagcagcagaagaagcaaaatgtaattttttaatttttagatgtttagtccgaattgtttctaaaatgttaagattggcatcctggttaatctcatgagtttccatcggtcgttcgattgtatccgctacactcgcaacagctgccaacagaaaaatataatcaaaattccactccaccaataaatcactcataaactgatagtcggtaattgagtgttcaaaaaaatggagattagccgattttggtaaattctcaatcttccccatcgataaatcatccaccaccacaatttcattatctacaattaatgcatccgccaaattggaaccgataaaaccggctccaccggtaatcaagattttactatttttaagttcagtcactttaccttgccccttctcccgtaatcactgttttcatagtagcaataaatacatttatatccattacaaaaccaaaattgtcaatgtaataacaatctagcttggccttctcacccggatcaatatcataaccaccatgtacctgcgcatagccactcagtcctggcttaattcgtaaccgttgttcaaaccctggatactcatgtgaaaactgctccgtaaaatttggtcgttccggccgtggcccaatcaaactcatgtctccccgaataacacctaacaactgcggtaattcatcaattcgagtattacgcatgaacttaccgaccttagtaactcgcgcatcatttttattcgcccactgagcaccattcttttcagcatcatttcgcattgagcgtagtttggtgacaataatgtgctgtcccatcaatcccactctctcttgtcgatagaaaacaggacctggactctccaccttaattgcaatcgcagcaattaacacaattggtgacgtaagcaccatcaaaattagtgctgtaaaaaaatcaaatgtgtttttaactggaatataccatgaatgaacctgttccccaattttcgtctgatacgtttcggttagttgatctccgctaaattgcttctcttctttgatgactttcaaacccactcctcctttcgctccgcctagtaattaaaataagtgaaatctctttttcttctttaattcaatctgccgtatctgattcattggcacaaattctccgttgataattgcttttgcattatcttcatattgctgtgccaactcagtgccgaactcagtggtcaacttttcaaacgcctcacgcatttcatacttgcgtcccggcaaatggtgcgcatctgaagcaaacaggtagccctgccctgtctcaattaattgacggctgaatttctcgaccttttctccaaatgtaccgacatagctactggcagtaatttgtgataagcatcccttttcaagtaattcatacaagatatccggatgtttcatgatccgcgtattgcgttccggatgcacgattactggaatgatgccgcgctgctgtaactgaaagatcatttcagtcgtgtatgtcggtacatcatcatcgggaaactctagcatcaaatactggttatcttcatccgcaaataaaatatcatcctgatcaaatgcatctagcagatcaccattaattcgaacttcctgtcccggaaaaaccgtcaaaccgatttgatgctcatcgagttgctgttgaaacgcctctgtttgggcaagaacatccaccttatgattggtatacacgccattcatatgatggggcgttagcagagcatatttcacgccattttcaaccgcttctttagccagttgcaatgaaatcgccatattcgccgagccatcatcaactcccggtagtaaatgacagtgtaaatcaatcatttggcctccatcacccttctagttgccattctatacatacgagcaaaaactacccgttatttgtagccgtacccgtaaccatatccataaccgtacccgtagccactacgagctgaaacatcattcaaaacgtagcctaacaccttagcattcaccatcttcaacaactctaccgatcgttgaacagccgccttctgtgcaattccctgtcgtacaattaaaaccacgccatcgacttcggccgataatacctgtgtatcagtgactgacaacagtggcggtacgtctaacaccacaatatcgaactcattttggctgttcgctaaaaagtctttcattcgtttggagttcaataattccgctgggtttggtgggactgggccactggttaggatggttaggttctcaataccactattccctaataattcgtggtaatcagcaccctgagctaagtaggtggttaagcccttcgtatttaccaaaccaaaggtcatgtgtagggttggccgccgtaaatcggcatcgacaaacagtacgcgttttccttgttgtgcccaaatcaccgccatattggccgataccgttgactttccctcactcacatccgccgatgtaaagagcaccgttttgagatcccgatcaactgacgaaaaatctatatttgtccgaatcgtacgaaattgttcagaaattggatccttgggattagacgcagtaatcaacttagcgccattgctcatggtgtcagttgataattttttatgatgcttaaaaattcccattttcgctttctcctatcgtacccgtcggtggctgttaccccgacgtggtgtgctatctgtctctcgttttcttgttgctttggcagtttgcttaatttgtgcaacctggcctagattggttaaccctaacgtttctactaaataactgtcgcccttaattgatgtatccatgagttctacggcaaatgcatacgcaacactgattagtaagccaatcgcagcgcctgcagcaacaaataattttacattaggtgacgtcttagcatagtttggtgtcgccttagaaacaatcgtcacgttgttaacatccataatttttttgatcttacttttaaagacggtggccacttcattcgctaccgcggccgacttctcaggattattcgtttgaactgctaaagcaaacacctgtgagttctcttgattactaatcgtgattgaattttttaattcactaacagacattttgtagctctggcctgtatgcttcacgactgctggttgggccgccttgattacatgctttgttccgtcatagttcgtccggtatttagctttctgagctttcttgacgaccaccgtattgttcttcagatccttgctagcctgtttaagcaccacttggttagtaatcaaatccttgtaggtgctaatcatttgtacgtcggcttgctgctccgtataggccgcggccgcctgactattatcactcttacggttgaccaagatctgggtagtcgatgtgtactgcggtgtgatcaggaattcggccacgccaaaggcgacgaccgcgagccccaccatactcaaaactatcaacaacaaatgtttacgcaaaatcgcaaacatctgtcgaatgtccaacatgctgtccatatttctcccccatgctatgaattaacttaataatggaatctttacatatatttaatacaatctacttcattatttaatatttcattaaaacgttcaaccctatatgacaagtttaacctaattgaaacatacgattgataggtacaaccatttgaaacgcttacaggatgtggagctacggttcttttatataacacacaaaattccgggaagattatttctgcccggaatttatgatccattaatcacctaaattaacgcgttttaaccctaaattatcacggatattattcgatgccgcttgccgctcactcgtcgataccatctggaatgactgaccactgatcatcttccccgttccctggacgttatctgatttcaccgtcttggcagcatttcgatagttcagtgctaatttggtcatctgactgaacgtcatatcagtcttagattcattcgaaatcgaatcaaggaaggacttgttgagcaccgtcttgtacgaaattgacttccgtagcagggccgtaatcactaatcgttgccgttcttgacgcccataatcacccttcggatcatcgtaacgcatccgagaaaagttcaacgcggtctggccgttcatatgctcagacttgcccgctgtaaagctcgatccgttgtacgtgaaggtcaatggtgacgtaacgtccacaccaccaacttggttgatcgcctttttcaagccacccatgttcaccaagacatagtagtcaatcggcacgttgaattctttttgcacgacgttaatggattcctttaccccgccaaaagcataggccgcattgattttggctggtgaatacttcggatagtccggcaaattaacatacatatcccgtggaatactagtcatggtcgtctttttagttttcggattgatcgtcatgatgatcattgtatccgtccgccccttgtagtcgcgcccaagatcgccagtatccgttccgaggagcagaattgacaccggctttttgccactcagcacagccgctgcgttccgttgttttgtggcccccgaactttgatacattccactcgtcattgaactgatatttttccaggcaacggccgcaaaggcccctccagcaatgattagtactccgataatgaccaaaaccacgtttctaaccgtgtgccgcttatgatggtggtgatgatgatgccgatgaggttcttgcggttcagccacttgatgatcttcactcataacttaatcctcccgtgatcgtctgtgacgatccaatttcacacttttttcacaattcaagaccagtattccatctttatgggagtgtgtcaatgttatccgggaagtttaccgctccccatatagcctttctctaatactttggcgaccattgcgtggagtcgttttcgatcaacaaaggaaccatattcatccttatgcagcgtttgacagacgttcgtaatgagttcaatcccaaaatagagcttatcgccgctgccattttgaagatggaaatcctgatcgccataaaaggcatcccgactatcttcgttgcagaacccatactcaagatcaatttgacgatgaataccactttgataattactcatccaacgcgcatccgcaattcggccatcaagagtctccttagaaatatcacttttaattttgaccttagaattaaacgcaatcgtcaatagttgatccgttgggcagaccccatatgaattaatatggtgggccatgatccacgtcgtatcggcacaagttcccccacgagtggagattaatttaaatttcccatgcgtacatgaatacgccgtatgaatctctccgatttgtgcgattgtacgtaacacaacatctgaaatatgatatcgcttactaaattctgcaagtagtttccgtgacgttttcctcaccgcaatcaactcaccatcatcgtttagcagcactacgtaaatccttttactaaaccgaaattgccgaaacgcaagtgtccgttcccatgatagttgtcccgtctcgtccaacatcgctaaaatgtcctgctccgtaaaacgatccaatgtgaccgcctgctgtcctcttacataattcatttcttcatctccctatacgtgtcctttatgcaaaccaattaatataacacagctgttaaccatttcttaaataataacttaccgaaatacccaataaaagtctactgagagtttgatgagaacgttattaccgagtttttatatattaatttctcgattttatcgatgttttacgtaagtttggtatttgggttcatttgtatcgttcgttattctagtgggcatcaaggccttgataactaatcttaaggagttatcacaaatgaacgatgaccagatccaacgcgcatttcactatctcacgaccgacgaccacgaaaaaattatttacggtgttctgaaaaagttgggtgtcaaccgtcacgaggaatactttgacgacctcgttaccgagggtaaaattgccttcgtcaatggttactaccaagccgaagctactctgcttgacgacccctaccaacttaacgggcgtctctttaaacatgttgagcacagaaccatcgactaccttcgacgccagacacggcaacaatcccacaacgaattttcactcgacaatgaagcggtaactgaagatattcgtgctgcaaaattaggccaaagtttcattactcaagacagtactgatcagcttattcagatggaagaattccacgaactctatgagcaatcaccagaaggcgaacggcgttatctgatggagcatctaattaaccacctatcgctgcgcgagatcgcattaaaatatgatatcagccccgcagcggtttccaaggcgaaacgcagctcaatcagccgggcacgacgtttatttcgaccgtaaagtgttaattagaaattaattatcattttgttaagatacgtattgacgtataaaacgctttcaattagaatttaattataataagttttagtttaatgtgcattcaatatataaatggaggcgagtaatatgaaacgaggctatcaaacaacaaccaccacccattacaagatgtataagaaaggcaggatatggctgttcagtgccgttgtaatcggaacaggggcctttagcgtcactaccatagcccatgcggatactcaggatccagccacctcaacgacattagcagcgaccgcaccgacagcgacctctgttgagagtaccgcaacatcaatagtaacaaccgcaccatcgtcagagatcatcaactctagcgtaccctcggttccgaccagtagttccgcttcgtcattatcaagtgcaacatcatcaagtatagcttcggaaagtagtgagataactgcaacgcccgttctgacagaagcagttgaaaccacatctgccacaccacttaatccagctacaccggctagtgaaaccggatcttcgacaagcaccacggcggaagtgacatccgacattccccttgctacgaatagtgcaaccacagcagacgaacccgtccccggtcccacagaagcacccgccattgaaacaaccgctactattttcactgacgaacatttagatgatatgggcatcgatgtgcaaactgctcatgaggataatgcactcgggattgcttcacttttccatattttctcgaattcgaccgtgcttagtgcagatacgaatggaaatatcgccaccgatcacttaatcgatggcaccacagattttgggactcgcggctatgacggtgatctcttctatattggtcatttatctggcaccgtcttacctaattcattccgcgccaacgatagtctcatttatgtcggtaactcggttagttctggctggatcgacgggcacgccgtaatcaatcgcgttaaattaacgaacgttcctgccgaccgtcttttcaaagacagcgccgatacggtttacattgatttcgatgcatacttcaaactgcttcgtgaaaaagcagccacttactacgctcaacctaatagcgctggcgtgacttacgacttctctaatatgaatcagcgaactatcgacgtttcggacgcgttcacttacgccattgaaaaccatgaagcccatgtttacgctagtatcccactcagcgtactacaagcaccccagagcctatatgtgactggcgtttcatccggcggcccaacattaattattaatgtgatcgatgatttagccaacgtgttcgacggcatgctggtcaacctagagacaaagacggagatcgaggtcgatggtgaccttcttccatctaaagagcggactgaattcgatcaatccgttatcctttggaacttcggtgacgatcatctgaactataatttcatcatggctggacgctttgtcggttcgattcttgcgccgaatgcagaggtcatcggcaacgtgaacatcgatggtaacatcgtggccgaccatgtcaacattgccagtggtgaatcacaccgttttgatctacagacgcctagcgtaactgatccggttgatcccgaagaaccgaccgacccgatcgatcccgaagagcccgtggatcctgaggaacctactgatccgatcgatcctgaagaacccgtcgaccctgaagatccgaccgacccgattgatcctgaggagcccactgatccaatcgatccagaagaccctgttgatccggaagaaccgactgaatctgaaacatcaactactccagtacaggacctcgaccgtgagactgctgtcagtatcgaccgcgacacacagacgaccgcggtaaccgcctcttctaacaccaccacttccaatcccgccattacgatgatatcaactaaacaccattcgactaagtcaaccaacagcgcactaccacagaccggtaacaccgcccaacaatccaccactatttgggggctactcgcccttgccttcaccggactatttgggttttccgttaaggggcgcaataaagacgactaattgacaataactgagacgatccttcactgggatcgtcttttagttggtcacagtatctcgcggattctattcgaaattcatcgctcctattgcgtaaacaggtgttcgccgttttatggttctaacccattgaatccgcggcccaacgtggtacacttatggggttaactcacgttaacgattgggactatatggagggtttaaattggaaacgcaaaacaaaggtgcctcacgccgactctggctgtggctgatcccgctcatcttggtgatcatctacgtcggcggcgtgctgcactaccaacatcgctacttaccacggacggaagttttcggcatcaagattgcgggtaagacccccactcaagccgcaacaatcctcaacaagaatattcaaaccaccaagtacaccttcaaagagggtgacaaaacggtcctgacaacgaccggtgccaaactgggcattagtcggaatttcaccgccatgttgaattcggtgaaggataatcagagtgcttggagctggccggttcacattttcacgcaaccgactgccagcctcactaaaaccgcgacgttaatcaatcaaaccacgctcaagcagtttgcgacccagacggccactaaactgaaccagacgcggacagcccctcgggatgctaagctggccttcaaagacggtcaactggtcaccacgaaggaacgctacggtaatcaaatttcagccactaagctcgcaagccaaactgaaaaacaggtgctcgcgaaccaaaatacggttaacttgaagaagacttacgacaaacctcaagtgaccgttgggatgaaatcatttaagaacttgaaagccaaactcacgaagatcagtcacgtttccggtgtgctcaaaattcagcaacacaacgtgaaggtctccaagagcgaggtgcaaagttggatcgatattactggtacttcaatgaccatctccgagagtaaaatcgatcactacctcgataagctggatcacaagtacgcgacctactacaagacgcgtcacttcaagtcaacggcgcgtgggacggtcgatgtaccggccggcatctacggttggtccattagccacaagaaagaaatccccgtgctcgtgaaggccgtgaagagtggcaccaccttcgacaaaaagatcattgttaaaggaaacgggtaccacgctgacggcaccgacattggcaatacctatgtcgaagttgataagcaaaaccagatggaatactactataaagatggcaagctcgcgatgagttccgcggtcgttaccggcaacccgaataagggaaaagaaacgccatccggagtcttctacatttggagtaagcaacgtaacgcgacccttcgtggggcgaactacgcgacgaaggttagctactggatgccggttgatgataccggtgtggggctccatgattcaccatggcaacctcaatacggtggcagctggtacctgacccacggtagccacggatgtgtgaacaatccaccagcctttgcagcccagctttacaacgccgtatccgttggcacccccgtcattattttctaaaatcggcttttttcgtggatactatccgatatataataaaatctcgcctctcctattgaagagacgagattttttaattaatgttgtaaaattgcgacaatcaggagcaccaacgccgccgcaaattgaacgaagtcgaacagaaaatgcgtgataatattttgccagatattccggctaaagtagtaaattagggcgaagaagccgccaatcaccatgtacggtaccatctgggtgacatccccattgaagttattccagtgtaccagtccaaaggcgatcgatgacacaaagaacatcaggaacgtcaaaatccgatggccacgccactggtaaaacagcacgtgccggaaaactagttcctcggtaaacggcgccatcaacacggttagactcccgaagagcccaataccagccgtcgtcactgcttggaagctcaacacatcggcagccccgcccgcggcgctggatcccgtaacggccttcattccgattcgaacgagggcgagcacagcgtagacagcaatcatcaagacgacatctagagcaatattacggacgatatgttcgcgataccggcgccaattgctccccagcacatcgcggaacatcaagacgacgaccaaaaaggcaacgaaggccaaaccgacggcaatgctgaccttcaccagctgcgtttgtcccggttgaactaagacctggcccaggccgagttccgcgagaatcaaggccactgcaaccagcgacttgatcggactcacggtaactgtggccgttgcatgtgaggaaaagtcggcgtgagccatcggccgttgccgttgaaaactaccactaccaaagagcccacgttcacgatctagtttgacggaaccgcggccgatcgtaatcgcaccgataatggcaaagaccacaaagtaaatgatggccgtggtcacactcgtgcccgcattgttactcagcgtgccaaacgcaatttgatcaaaggcatcgataatggcgtgaaaaatcacggtaatccagaggttattcgtcaccagatagacagctgcgaggaagaagcccagtccgatcgccattaaaatttgcgcgccggtattggtccagttaccactacttaagccgttgacggcgtgcacgaggccaaacccgagaccactgaggcaggccgtagtcatggcccccagacggaaatggctgtacagatagctgacaagtaggcctcggaagacgtactcttccaccagacccacggccagtcccataactaacgcaattaaaatattagccggcgtcaacacgtattgggcacccagcgtggcatccccaatcagcacgacaatcaccggtaacaaaaacagccaattcttcgcggtcgaggacgcgttgcgtccccacccgattttggcatggaaatacagccgattgaccagccaccaaatcagtaacgcgacgagttcggtgccgataccggcccaaccctttccgttggtggaatgaatgctaactaagttattgaggcccagattaaatcccacgttgacgatttcctgggcaatggtcgagataatgagcactaagaataatgacaaaatataaaaaactgaccagtgctttctcactaaaaatccctccttgaacaatttgattccatgataccagttatcggggtgtgggactagggtgacgaactcagagcgacgcaatttaagtgaaatccaatatcacggcacgccggttgcccgcttgaccataatgaactgattttagtgtgcgcgatacaagatttttatgagataaattaacgttgtttttatgatgtgcgttcgctggtggcccttaaaaataaggtagacagttccgcttgttgaggacccgataccttattttgattgcacacttttgttgtatcgtgcgagccagatttttgtcactcgcctgccttcaaggtagttcgaccagcggcggtgcctggctcatctttaacttttaaaccgcactccgccacgaaccacaaaaaatagaccatcaagtacccaatcaggtactcaatgatctattttctcattggcaggcatctagccggccatgatagttaacggcacctaaacaggtgcacttcgtcgtcttatttatagttaggggcagccttagtaatttgcacatcatgtggatgcgattcgattaatccggcgcttgtaatttgaacgaattgggcgttgttgatcaatgcgtcaatgtcagcggcaccaacgtagcccatgcctgaacgtaatccaccaactaattggaagataatgtccgtaacatcacccttgtattcaacccttgcttcgataccttctggcactaacttgttggcttcgttaacgccaccttggaagtaacggtcggatgagccatgggattgtgacattgcggcaactgaacccataccacggtatgacttgaactgcttgccattgtcttcgaagattttaccaggtgcttcagtcgtacctgagaacatgcttcccagcataacggcgttgccaccggcagccaaagccttcacgatatcaccagaatacttgatcccaccatcggcgatgatggttttgccgtattcgcgtgctactgaagcagcatcgtaaacggcggtaatttgaggaacccccacaccggcaacgacacgggtggtacaaattgaaccagggccaatgccgactttaacaacgtccacaccggcgtcatagagggcacgagcgccttcagcagtagcaacgttcccagcaatcaaagttgcttctgggaagtgttcgcggatttcagcaatcttgcggagaacaccggctgaatgaccatgggctgtatcgatgacgatggcatcaacaccagcatcaagcaaggcttcagcacgatcaaatgtatcacttgtaacaccaaccgcagcggcgaccaataagtgattgttatcatcaacagcagccttttcgaagttccccgtcaaattaacccctttaacggttgccacttcgccagcctgtgcttggattgacatgttcttgtggataacacccatcccaccttgtaaagccatggcaattcccattgcactttcagtgaccgtgtccattccggcactcaaaaaaggaacgtggagcttaatattctttgctagttgaacgctcaaatcgacttcgttcggtaatacgtgactttccgctggaattaatagtacatcgtcgaacgttaaaccttttttagcaaattttgtttcccattttgacattacttttgcacccctattcttttaattgttactacgttaccagccttatggctaatggtcaaatacttctttcgttttatcatcattttttcattttcggaaaacaaaaacacgcactttttgaaagtacgaacattatctgttctttatttcaataaaatacgtgtttaaagcggattatttccgccgggttggttgttgccgtggttgaccaccgagggccccaccgacaatgtgatacttgcgacgcaggtaaatatcgaccccaaaaccaattacggcgagcacgatataaacgagccctggcaactgggcgttgatccccttggctggcatgaagcccacgaagaagtagatcgcaatccaggccactagcccaacagcaacaaccccaatcttataccacattgagtgttgcttcgccttttcgcttccgggttgaatcgacttcgtcacccaagcaaacagcagaccaccgaagacggccactaagatgatagctaagattccgctggttccagaggtggcggcttgggccttcagtgccttcgattggaaggttcccatgaacccaaacaatagggcaaagatactgaagaacatcagtccattgtcggttgccaataaaccaaagctactttgtgacgctggtaccggtgccttcttcgggccgttgatcagttcatcggccttttcagctggcgtcccaaataattgacgcgcggtttggcccttcttttgaccttctaacagcgtatcgatagtcgtcttcaaggcttcgggcttcttatcctgcttgatgccctgttcgtccaactgcttgtttaattggtacataaattcttcgctacgcttagttaagcctaactcactaaattggcggtgcacattagcatgctgttcatgcacgtgctcccgttgcttgctaccagcggcggcgttacgaggctggttttgattctcttcactcactgaaattcccctctcttggtgcttggatgattttttggtgcgggttttgctgaaacgtgttcgtgaagcactggcgcctaacggataagcccccattaactctgaccgcaaacccacgatcacagttaatggtgtcttatcccacggcaccaacctgtgcttgctcacactctaaacattaaacctaaactctacaatatccccatcttgcatgacgtagtccttaccttccagtcttaaccggccggcttccttgactgcgttttgcgtttcgtacttatctaagtcttcgtatcccataatttccgcgcgaatgaagcctcgttcaaagtccgtatggataattccggcagcttgtggcgccttcgttcccttcttatacgtccaagcccgcgtttccttaccaccggccgtaaagaaggtttctagtcctaacagcgcatacgatgcccgaatcaaacggttcaacccgggttcttctacgccttccatctcaaggaattcagccttatctgcgtcatccatttcagcgatttcttcttcactggcggccgcaaccccaatgacttcggcgccctcatccttgacatagtcgcggatggattggatgtacttgttagattcgggatcgcctatttcgtcttcgctgacgttagcgacatataagaccggcttcgacgttaacaggaacaagcccttcacgattggtaattcgtcttccgcaaaatcaatcgtccggacactcttaccggcttccaaaacgggacgaatcttttccaaaacggctaattccgccttggcttccttgtcgctccccttggctgcgcgttggacctttgccaagcgcttgtcgacggcttccaaatcagccaagccgagttccaagttgattgtttcgatatcgtcgattgggtccactttaccagtcacatgggtaatgttgtcgtcgtcaaaggcccgcacaacgtgcacaatcgcatccacctgacggatgttttcaaggaacttgttaccaagtccttcacccttgctggcacccttgacgatcccggcaatatcggtaaattcaaacgtcgttgggaccacttttttggcgggaatgagttcttgaattcgctccaatcgtttgtcagggacttccaccatccccacgttgggatcaatcgtcgcaaacgggtagttggccatttctgcccccgcttttgtaattgcattaaataaggttgatttaccaacgtttggcaaaccgacaattcctgctgttaacgccatttgttaattcactctttcctttgaattttaattaatcttcttcgcttgtggttgcttttcgaagcacttttttcatgcgcttttcgaagtttcggcggctcaacatgacaatgtgaccgcatccgagacacttgattttgatgtcagcgcccatgcgaatgatttcccattcgtttgtgccacatggatgctgctttttcatcataacaacgtcacccttatcgtacatgtgaattcctccttcgttgtgaatcctcgtcttattgttgctctaactctagtgaccagctttgccttggtggcattgccggcattcaaccagtctagtttaaatcaacatccaacatttccaaaatccgactgagatcatcatcggatagatacgaaatctcgatcttaccggccccgttcttcttattcgactgggccagtgccaccttggtgccaaacttcgattgtagttggtcttccgcggccttcacaaagactgacttttgtggggtcttcttatcttttcggttcttcaactcaccgttcatctggttaacgatttgttcaagttgccgcacggttaagttttgccgcaccgtccgccgggccagggaaactaaccgatccttatccttcaagccgagcaacgtccgagcctgccccatcgacagcttatcgtcttgcagcatatccttgatcatcttgggtaagcctagtaaccggagatagttggcgatgtatggccgactcttccctaaccgcttagccacttcagcctgcgtcaaggagagcttttccattaacgtatcgtacgcttgggcttcttccaacggagtgaggtcttcacgttgcaagttttcgaggacggcaacttccatcatttcttcgtcgttagtttcccgtacgatcgccggaatagtcagcttcttagcgagcttggaagcccgaaagcgccgttcaccagcaatgatttcgtagcgtttaagcttcttatccggttgccgcaaaatgatgggctgaaagacgcccgacttttcaatcgaagcggctaattccttcaacgccttggtgtcaaaaatccgccgtggctgatagggattcggccgaatctcactaatactaatttcttggacgctttcttcgctggcggaaacgtcattatcttcaaagagcgcttcgattccgcgaccgagtccttttttactatttaccatgcgctgctaacacttcctttgcaagttggcgatagacttcggcaccctttgactttggatcgtaatcaataatcgggagcccatgacttggggcctctgacaaccggacgttccggggaatgatcgtgtcgtagacctgatcgccaaagaacttcttcacttcggcattcacttgttggcccagattagtccgggcatcaaacatcgtcatcagcaccccttcgatcttcagtgcggggttaaagtgcttttgcacgagcttaatggtgttcaataattggctcaagccttccaaagcgtagtattcactttgaaccggaatcaaaatcgaatcactggccgtaaaggcgttaatcgtcaaaagccctaacgaaggtgggcaatcaatcagcacgtagtcgtaggtatccttgaccgagtcaatggcatctttcaggcgggtctcacgcgccatcatcgaggttaattcgatttcagcaccggacagttggatcgtcgttggaacaatatccaagccgtcatgcaccgtcttcatgatcacgtccttgattggcgtttcatcaatcaacacatgatagacatctcgttcaatcgtggctttcgaaatccccgtaccgctcgtagcattcccttggggatcaatatcaatcagcaacacgtgctggccctgttctgcaaggcaggcacctaagttcacgctggttgtggtcttgccgacgccccccttttgattggctaatgcaatcacatatcccatcttatttaccgcctttctcttgcttattcttcggaatttcaatcacgatctcatagtgatcgtcctgttcttcctcacgcgtggtaatgaccatgccgctgtcttggatcatcttaatcgattgcttgatcgtattgaccgcgatccgcgaatcactgaccttctgactgacacgttgtttctttttcttggttttctttttaggtgcttccaccgcgggtgtttcgtccgcaacaggaatctttccgagcatccgaccgacgagttcttcggtctgcttaacgttaagtttatcgttaacaatttgcatcaaaacgtcgcgttgctgatcttcatcgagatctagcatggcccggccgtgccgttctgtgatacggcgatccaaaattgcattttgaaccggtgcgatgagtttcagtaaccggagcttattcgccacgaaggactgactcttccccatccccttggccaacgccgtctgggtgatgtggttgagttccatcaggtcacggtaggcctgcgcctcttcgacggagctaagctgttcgcgctgcaagttttcgatcaacgccagtgaggcggtttccttgtcattcatcttttcgacaatggccgggaccttttcccactgtaattcgttcaccgcccgaaaccgccgctcgccagcaatgatttcgtacttgtcgtcctcatactcacgtaagatgatcggttgtaataagccgtgcgcttcaatcgtctcggcaagttccttaatcgccgtcggatcaaacacctttcggggttggaaccgattgggagtaatctttgtaacatccacttcgacaacctgattggtcgccggttgatttttctttcctttattaaatagtgaaaatgccatactcatcctccccttcgattagtcgatcggctttttattcggaacaccaggccgtcgaggatacttcactggtgttgccacctgtttgttcatcacgatcatcgtgcgtggttcgtgattgaatggcaacgtcaagttttcggtctgggtgacctgcccgcccaataccgtaatcgcatggttggcatcactcagttcatcctgtgcttgacttgccttcatcgcgatgaaactgccgccaaccttcacaagtggcaggcacagttcactcaacaccgacaagcgcgccacggcccgcgccgtaacgatatcaaagctttcgcgatacgggctcttcttcgcaccaaacgtttcggcccggtcgtgaatcagagttacgtcttgtagtccgagcttagcgacaagcccttctaggaaattaatccgcttattaagcgaatccacaatggtgaccttcaacttagggaaagcaattttgagcggcagcgatggaaaaccagcgccagcaccgacatcacaaagcgttagtgcctcattttgaagctgcgcgacgacgagggcgggcgtgatcgaatcatagaagtgcttgagatagacttcattttcttcggtaatactcgttaggttgagttgctggttaccgatcacgagctcgtgatagtaagtttgaaattgctgcatttgttgctgtgacagatcgataccatgatctgctaaagcttgctgaaactgttgtggattcatacattttctccttagacttgtgaaacaaatttatgtttcacgtacggttctactttaccctaaatcagggttgtaagcaagtattggatacagaaccaaccttgattatgactcacatttagtcaatattttcggttggggttaattcaccatctaaccattaactataccagtctgaatcataattgttcagtcttctaaaccggatctttctttcatataatccgtttggcacaaatcccatttttccggtgtttaatttcaaaacaaatcaggccattccagttacggaatggcctgactcatgcagaaaagcttacttacgttttattaaatttagtctttaatcgcgctgacttcttccaagaaccacttgttgaagtagtcagtatcgatatcgacacatactttggcgttggtcttgccatcgtggtaggcaccacgaatgtcaccaactgtttcacccattgctgggccttccgtctgaacatccacccacatttcctcggtcgtaattgcttccggatgtaagagatagaagattgtgttcacgtcatgcattggatgaccgttttcgtcaccatcattgtaatgggtaatcaagtcgtgcaacatttcgccggcacggcccatggtggctaacttgtccaacgtatctggtgtcaacagcgccttcaaggtaatgtctaacccaaccattacgattggcacccctgaatcatacatgatcttagccgcatggggatcagtgaagacattgaattctgccgcactggtcatattccccttgctaagtgtgccccccatggccacgatctctttaatatgatctttgacttctgggtattgtgagaataatagggcaatgttggtgtatgagccggttggaaccaatgtaatgggttcgtcagccgccataatttcatcatgtaaggcttcgacggcactcttggcgattggttcgccgtaatcatcaccaaaatcgtagccgggcattcctgattcaccatgaatccgggccgcatcttcaaatggcttgatcaatggctgcttggcacccgccgccactggaatatcttgtttaaagaagttaacaatttttaaggcattggccgtcgttttatcgacggtcacattgccggcaacagcagtcactaacttgaggtcaagtgctggatcgttaatcgccatcgttaaggccgctgcgtcatcaatccctggatcggtatccataataatttttgttgtcattgcaattcctccatttagaaagcgcttttaattctgttgataataagaacctggtctcccaggctctcagtagttattagttatttttagagtcaaatcaaagtaccgatcttttgcttgccgcactagttttctaagggataattacggctcacacgagttgattgttgcttcgatttgataccaatcaagttcgggtcaggatattatctcgaactcgatcggctagagctaatcacctaccgggctaaatcaccacaaccgcccagaagatgacatttggaaaattgaactaatttgattgtgtcgcattagagattccgatcaaacacttttaccgcggttcgattggaagttaggcgtatcccgcagtgtcgagacacgcacgctatctttttaccaaacgaacaaaccaacaaatccggctgaaagtagtgatactaagatacctgaaagcaacagataaccaacgtttttagcaattaattcgttcttttctttattaactaagcccttgaacgccccaataatcataccaagcgttccgaagttagcgaatgaagtcaagaatactgtcaggatggcacgtaagtgaggatcgtagccgttgatgacaccaccagcaactttccccataacaacgaattcgttagtaactaacttaagacccatgtcttgtgaaagtgtccatgcttggtcgactggtaatcccatcaaccatgcaaatgggaacatgataacccctaagatactttcaagtgaaagtggcttccagaaagcacccaagattttatcaatcaatgcagctaaggcaacgaaggcgataacgttggcaacgatgatcaagatcaacttaccagcacccaagattgaatcgcctaagaatgagaagaatggttcacgcttgccatcggcatcttggccttctgaaccaaccttagcaattgtatcttcttcttctggtaccttaactgggttcaacatacttgtcacaatgattgagttgatgatgttgattggaacggcggtcaatacgaattggccaggaaccatttgggtataagcacccaagattgatgccgtcacacaactcatggacatcattgcgagcgtcaagttacgttgcgcattcatttgacgaagttgaattcctgagatggcaagcacttcagtgttaccaaggaacatcatttcaacggcaaagaatgattcgaactttggttggccggtgatgaatgataatccacgaccgatccatttgatgacccatggcaagaatccgatataagttaagatatcgaacattggaacaatcatcaaaataggaagcaaggcacttgtaataaagttcaaggatttcgcggtcccaccaaagtctggggtaacccagttaggtaaggcaaacacgattccttggtaggcaacctgcactaaccaattaaatccatcggcggccgccttaacagcgtcccgaccgactgagaaacttgtgaaaaaccatgccaagaataagttgatcacaaccattatggcaattgacttccagttgatttccttctttttctttgagaacaggaaaccaatggcgagaaatactaccagcccaagaatatttatcgcaacatacatggacaataacccctttgctatttttttgcgttaccgaaaactaaataaataattgcgccatcctggtatcgctttctaaatataacccataaaacacccctttggcaaatgatagcggtttcgatttttttaattgtttcgataaacaaacttattttcccgtttttaataaacataattggttaaaacgttttactagttgctatatttgattcttataatctcatttagattaaaattagattaaaaaaacttttagaaagcgtttgctttctaaaagtttgctgcccctgccaaggacccttattataccatttctagtagggactggcggcctcattttcatcccgaaactgggctatcagttgattctaatttttctgttcaccccatttactttttatctcattcttacttttactgtcgaccaatccaaaaagaactcacaaaaaaagatcgagggccttctctaacctcgatcttctttgattaacaacaggaaggtgacgtgcaactgcctaattgtttacttacatttaaatctattggtctcgcctcaatggttctatccatcgcctgaaatcggtggaccccagcgcctaacgatggttttatatgggatcttttgagcaacctacccgatctagtgttctaaatatggcggtaggtctcagctttatcgttggatacttggtaccttggtactcaattctgtggttcttaattcttatacgtggtacttggtgttacggttcttggttcacttacatggttctgtttactaactgtggtactcttcttggtgatctttgttccatctagtaggctagtcactacctgcttaactaaaggggtaacatcaatctttggttctatgagtacggtgaaaatcttacaaacaaactttaaatctcgtggtgctctaaaacttaaaacttgtggtaatttgttacgtaatacaaggagtttctgtgtgagaaggttttgaagcagctacacgtaaaacttacctttcctgtaattgtatattaccatgatcccgatcccagatcaatgaaagcgcttcaatttagcgattaattttcgtatgcaaattcaatatctaactttattattttaagtgattcccttaaaaccgcaaagagacaccgatttgacccatgtgcgggtgcagatcagtgtctctttgcgtggtaccatgttgaattattttgttgaggttatttttatttcgtcaagctggtcttagcaggtgcctagccttcgcgtgagtacgttgctaagtctgccaagatttgatccaagaattcagccttggtcttggtattttgatccgtttcaccgtacagacgaaccgttaccttgttgtcagcgacttcattgtcaccaactaccaatgtgtacggcaccttcttcgtttgggcttcacgaatcttgtagcccatcttttcgttccggtggtctaccgaagcacggatgccagctgcagccaattcgttacgtaacttgtcagcgtaatcgccatgaacgtcatccttaacgggaatgatcttcacttgttctggtgacaaccatgttgggaaggcgcccttgtacatttctgtcaggtaagccgtgaaacgttccatcgttgacacaaggccccggtgaatcatgattggacgatggtcttgaccatcttcgccaacgtagtggaggtcaaattgcttaggcaacatgaagtccaattggatcgttgacaacgtttcgtcgttgcccaaagccgtcttcgtttgtacatccaacttaggaccgtagaaggcagcttcgccttctgcttcgtagtattccagtcccatgtcgtccatggcttgcttcaacatactctgggcgttgttccacatttcgtcatcgtcaaagtacttttccgtgttctttggatcacggtagctcaaacggaacgtgtaatcgttaatgtcaaagtcatgataaacttcgatcattagcttcaagatactcttgaattcatccaaaatttggtttggcgcaacgaacgtgtgaccatcgttcaaggtcatttcacgaacccgttgtaaccctgacagggcgccagatttttcgtaacgatgcatcatccctaattcagcaatccgcaatggcaattcacggtatgaccggatgtgatgcttgtaaacttggatgtgacttgggcagttcattggccgtaattcaagttgttcaccatcccccatgtccattggtgggaacatgtcttcacggtagtgttgccagtgacctgaagtcttgtagacgtctaggttcatcaaaactggggtgtaaacgtggttgtagccgttagcaacttccttgtcgatgatataacgttcgattgtccgacgaatagtcgccccttttggcatccagtaaggaaggccggccccgactttaggatccacgaagaacaagtctaggtcgtttccgatcacacggtgatcccgttccttagcttcttgccgacgttgtaagtcagcttcgagttcgtctttcttgaagaagaccgtcccgtaaatccgttgcaacattgggtttgacgacttgccttcccaatatgcaccggctactgacaagagttcatagttcttcaaaacgttggcatatggcaagatcgcgttattggcaacggcaatcacatcgcccaccttgtaaacggccacttggccgtcttgggcggccgccttgatcaatgcatttgagaattgatcgtcgctcgcttgggccaaggcatcgtccaagggcaccgtggctaattcaatcttagcatcgtctttagcaaactttttgattgcagcagctaagccttccaattggtcggctgaaacttgagcatcatccttatcagaatcaacgtaaaagccgtcatcagtggcggcgccgtcacctaaacggatgccggggaattcctgcttcaaggcagccttgagtaatagggctgtggtttgacgcagtgcctgtaatgcttcttgtgagtcacgatcaactttgttagctgaaccgtctggtgataaaactagaacttgtgccatatgtctctctccttttcgatgtcgtgttcgtctttccttcaaccggaataacttgcacataaaataaaaaaagtccctagtatcatgattgatactagggacgtcattaacagtttaacgtggttccacccatcttcgcgaaacgggtgcgattagtcgcagaaagtttcgcctctaatggtctggtaacgggaaccgcccgaacttccttatttcggaagtggatcatcgaaggtagtaccgactaggttgcctcacaactaagatctcagcctatgtcttagtttctctgacgggtttgctagtcgactcgtccttcaatccaaagtgaattatagcacggcgctgtaaaaacgcaagagctttatcgaatcacgagcaacaattccagagccgcgaaaccatttcggatgttgccgattaatcccgtacgctaacaacatcagaccccaaacggcaattacacccttgtccattgccgatagtgctgtcagccaagctaccaattgattgttcatgcgcccgatctccttttgcagtggtaaccgtatagtgccggttttccacaggtatacctctagtatacgaaatgcgatcagtaaatgcactagcttcgcgagttgtttcactaacaacgccgcagcgttatagcgtatcgtcagccgtaatttcccgtactacccggcacgggttaccgacagccagtgaattggcgggaatatcgcgggttaccacactccccgcaccgatgacacagccggccccaatcgtcacaccaccaataatcgtgacgttacccgcaatccaacagttattgccaattgtgatcggcgtcgcgtgctcatagctataatccacaccgtcacgatccttagtcttcatgttgcgctgctgataccgcaggggatgcaaagcaggggatgccaagccgtgaacaacgatacgttaggcccgcacatcacgttatcgccaatcgtaatgggggcttcatccagcaccgtgaaattaaagttcgcgtagaaattatcgccgaccgttgtgtactgcccgtaatcaaactggatcggcccttgcaggtacgtgccgctaccgtgatggggcatcaactgatccacaatggtctgccgcgccgcctcatcggtttctagcaactgattatattgcacgcatagctggtgtgccacgccccggcgggtaaccagctcatcggccatggaattatacatttctccggccagcattttttgttcatcggtttggtccgtcatcgtttaactccccctctgtggtttgactccattatagcggagatcgcagtcggggataaggcgggtttcttaccgaattttgtggttttgtacgcttgttttttggctatattcaaaaaagtagcgagtcatgtttgtgcttgactcactacttacgaattatttgattgagttgggttttgtgagacagaagcctgcgcttaacccaataattgtaatcatccccaaacccgggatcatcacaattatcacgttaatgctcaacttctaaccgtctcacgccacaccctgattgagttgggttctgtgagacagaagcctcgtttcacaccctatttggctgcgatatatccttgggccttcaataattcggcacacaagattgcgccaccagcggccccacgtgaggtgttgtgtgacaagccgacaaacttccagtcgaaaatcttgtccggacgcaagcgaccaatcgaaatccccatgccgttttcatagttcacatcatagcgcacttgtggccggtcgtcttccgtcatgtattggatgaattgcttgggtgcacttggcaattcaagttcttgtggcacaccacgatagctttccaaagcctcaatcaagtcttccttggttgggttttgcttgaagttcacaaaggcggctgccgtgtgaccgtacagcacaggaacccgcaagcattggctcgtaatggccggcgtttcagccgacacaatttgcttcttttcatcgtcgacatgaccccaaatcttgaggggttcgtcttctgacttcgcttcttcaccagcgatatagggaatgacattgccaataatttcaggcgcatcctctaatgtcttgccggcaccagagatcgcttggtaagtcgtcgcaatcacttgggttggttcgaacttcttccaagcagatagtgcaggggtgtagctttggatcgaacagttcggctttaccgcgatgaagccccgcttagtgcccaaccgttcccgctgatatttgatcacatctgaatgatctgggttgatttctggcacgatcattggcacatctggtgtccaacggtgcgcgctgttatttgaaaccacgggcgtctcagttttcgcatattcttcttcaatcgcccgaatttcgtctttcgacatgctgacagcggaaaagacgaagtccacctgtgacgtcacggcttcgatgtctttaacatctaaaaccgttaaatctttgacaccggccggaattggatcttgcatcttccaacgtcctgcaacggattcttcataggtctggccggcgctatgcgcactggcagccacaaccttcacttcaaaccacggatggtttgctaacaacgtcacgtaacgctggccaaccattcccgtagcaccaatcacaccaactcttaacttttcacccatatctctaacctcacttttagtcgttacatccgctttagtatagtaaattttgatgaaaaatcaattaaaaaatcttaataattttcacaaaaattcatgtaaaccgttttctttcgctattcagcgcggtttcggtgaatcaccgaataggccacgaataacgccacaaaccagattactgaaagtgcgagcggaatgcgttgttcaggatctaataatagaaagattaacacggcaccgaagaaaatcaagcttagataatcggtcaccggatatccgggcatcgaaaacgccttaatcccttggggatggacctgccgaaacttgatgtgacaccagatcatgatcaaccacacgaacacaaagttaatcgttgacacccctgaaatcatattgaagatgccggaaggcatgaggtagttcaaaataacaacgacaaacaaaattgcagatgaaaaatgtaaggccgtattaggaaccatatggcggctaagcttggtaaagctttgcatggcgttcccaccacttgccagcgcgtgcagcgtccggctcgtactaaagatcgcactattggtggccgacatcgccgccgttaacacgacaaagtttaaaatggctgcggcactggtaatcccaattccagaaaagacctgcacaaacggactggacgtcgttgtaatgcggttccacggtgccacacacatgatggcaatcattgacccaatgtagaacaacccaatccggatgggcaaactgttgattgcgcgcggtaaatcccgttcggggtccttcgtttcaccggccgtcaatccgaccatttcaatcccgacgaaggcaaagaccaccatttggaacgacatcaagaatccaatcggccccgttgggaaaattcccccatgagaaactaagttgctaaacgaggccgtagtgttccctgaatgataatggaaaatggtcatccccagccccacgacgatcaacgcgatgatcgcagcaaccttgatcattgaaaaccaagattcgaattccccgaacattccgacgttaatcaggttcaccatcaatagtaaaatgatgattactagcgggccaacccactgtggcaaatgtgggaaccagtacttcaggtagattccagtggccgtcaaatccgccattgccagactgagccagcaagaccagtacgtccaaccggccacaaattccatgcgatcccccagatactgcttaacaaaatctaagaatgagtgtttgctaatgtcagacagcagcaattcaccgacggcacgcatcataaagaaacaaaagataccgacaatgaggtacgataaaatgatcgacggaccggctttacgaatcgcactccctgatcctaaaaacagacccgtgccgatggcaccaccgatggcaatcatttggatatgccgactctgcaatgatcgtgataactttcgattttcgtccactgttcttcctcctactatcgttctgccaatgactgatacttgaaatataattgcgattactgttttgattttacttggggcgttaactgaaagttggcggttgctggtttggctgaaacgtgctcagcaacacagacgcctagcatataaagcctaatcaccaccatgcttgaagcccacaaccataatggtgattaggctttatatgacggcgtctacccgtgttgcttcgcactctaaccaaataaaaaagtccccagtacgcacacatgtcgtaccagggacgctaatttctttttaacgcggttccacccaagctttacagcccgcttcgcgaactgcctcttgtggtcgatattgggaccacccatcttactgccattttcccggttgctagctctcagcctcgccagcatctctgtcttccgtctctcgagattaatgccattatacaaatcctcacataaatgtcaatacaacacctagccgtaactcaaagttatctatcattttgaaaccggtctaatgtcactactaccaacccttacagcgattatccaaacattttaaaaaaaattcgaattgtcgttcgttttttgctgttttcggagaaagtgttacactatcctcatctatcaaaaaggacgtgatccgcttgacccaacctaaagtatggcttattacaggaacctcgaccggcttcggtcgtcaactcgttgaagctctccgcgcaaccgatgctaaaatcgttgccactgctcgaaatattgagaaaatcgccgactggaccggtgagaaaaacatgctcaccctccaattagacgtcaccaatcaggcacaaattgatgccgccattcaagccaccaaagcggaatttggccgcatcgacgtcctcgtcaacaacgccggctggggctactttggctccgtcgaagaaggcgaaattgacgtggcccgccaactaatggaaactaatttctggggcctagctaatatgacccgggccgtacttccaaccatgcgggcacaaaaatctggacaaatctttaacttgtcctccattgctggcttagttagcggggccggtcttggctactacaacgccactaagcatgcggtagaaggtctcaccaaggcactctaccaggaagtcaccccactaggaattcacgtcaccaacgtggaacccggtccatttcggacggattgggcgggtcgttcccaccgctcggcaccgatgaacattgccgactatgaggctaccgcccataaaaccaccaagaacgtcgaaggcttctcgggaactcaggacggctcacccgcccttgtcgctcaagcgatcatcaaaatcagcaatagtcctaagccgccactgcactttctggcgggcaccaacgcatataaccgagctcacgaagaactcgaacaggaagccatcgaatttgatacctgggccgatgactccacccacctgtactacggcgatgaacactactggcaataatgcgactaatcgctaatcgtcacggcagtcccaatcaccagtaccgtgtcgcccacttgtgaagctgtttcagagacgctcacgccgacaatggcgttggcgcctttttctttggcgtccgtcatcagccgcgccatcgccacgtcgaaataatgcttcttcatgtcagaatacagcaccagttcaccacccatcaccgattttagtgattgtttgatctcggccttaatgcccttatcaaagctccgcgaataggtaatattcccgctagcaataccgtgataggctgtaatttgtttaccggcaattgccgcatttgtcgttacaatcatgtgagtgccctccagcaatcgtatcgtgtcagctaacacaatcatgttagcttttgtttctagtttacccatccccagcataaaagcccagcaaaaatttgccgggcttttttctattcttcattatacggtgcgccgctgcttgacgatccaaacgtagccccactcactggcttgaatccaaaagtaacaaaacactacgccaccaagctcaccgatcaacgaactttgcgcctgtgaaagttccaccagccccgtcaccaacacgaggagcagtaagcaagcgttcatcaaccgcccaccgcggtgctgcgtgacccgttctactaggtaaaccaagtatacaaacaggctcatcgcaaacagatgaggcgcgggaaaattaatggtctgtggcaccgtttgcgtactcataatgcccgtgccggcgacgccaagctggatcagccaacacatcatctgcccgataccggccgtcaggactagccacagtgccagtccacgctcgtggtggatcatcagcacgcccactagcaggagaaatccgagctccaccaccggccagcgactaagcattaaaattaagcggccaaacgcactccgatgggtaaaatagtgatctgtgagccgtgttacggtttcattaaagcgctgtgccaattgggcatgcgtcgaaattaaattgccgaggacgataaacatcatccccgatatcatcacgtatagtgatcgtgatttttgcgtattcattttgaccatttcctcgaagtcgtcacttaattctcggcaacaatttattttgtcgtttaaccgtgtccgaaatattttcgtgcaagacatactgattaatcaggttgatgatctgccggttctgtgggagttgatgatgattcgtcgccacccccgtcaccacaatttccgtgtaactcgccacctgattttggaagacgtacttcccgctatcgacgctcataaacggcacggtcccatcaccactataattttgcgtccccgcaattgaatacacctttagcgtggtcggcagctgcttgcgctcgcggatcaaatccttgagcatctgtgttttcttcgcggtccgtcgttccaaattgtagggcgacgcaatcgttaacagccgttcagccgtcacgtgcgcgggtaaataacgctccagaaacagtgtcaacacaatgcccccgttcgaatggcccaccgcgctaaagtggttgaagtggtacagcttcatcaatgcccgaaacgcaatgctgaaccagcgtgcctgctgcttgatgttggcatacccgtcccggttattactaaacgccacgacgataaacgggtgacgatcgcccttacgaattcggcccgtataggtgagatggtcattcttgccaaccttaaccttcaggacactatggggctgccgcccccggtttaatcggcgaatgagggggtcaaaccgattttggcccgccgaacttcccggcaccaaaaatactggagcaatggtcgacggcacctcatgacgcaacgttttaacctgccgtttttgccacacggcaccaaacgttgccaaacaaatgacgaccgccaccgatccggtccatttagcccatcgtttcatcatgctcatttttatcctccaattgttgcacggccaactttacaaacggccagtaaatcgccaccgcgaccaccacggttagacacccgacaaagagggccaccaagttgccgttggttgcgagaaaaccccgcaaaaagcccggtgtcgtggcgggaaccggataaacgctcggtggcaaccaccgcaccgacgtcaagccgatcggtattaagcaggcgaccacactactggtcacaaacggaacgaccataattggattcaacatgatgggcaacgtgagggtgagcggagcaccgacgttaaatagcgccggccaccacgacgctcgtgctggtgattgtgcctgatgccgcgtaagtagccacacggctaaaacggtcgctaagagcatgccaggtccgcccgtgttcgcatacgtcgtcgcaatcgcatggagattaatcggccacggaacccgagttaagtgatgcgttgttagtgcgtagctcaaattctggtgaaccgctacgcttcccccattatagttgccggccccgattgtgccggtcattccgattagatttaagaaacaatttaccatcacgcacaccacgatccagagcggcgcatggcgacccaaaataggccatagagcaccgtacaaatcaccccgcgaccaatctggcaccagcaacacccagagaattgtgccgccaaagaccagccccacttctcccagcagtaatgcggtggcgtaacggccccaccggttaaacagccaactggtgatcaatccgagaataatggcacccccaaaactgggcagtacctgcccctccaagttgagaaatcgtggtagttgcaagacatcgacgtcgagcatgaccggttcggtaaaccggagaagcactaacgccacaattgcactactacaggccggcacccgaaactgtgggcggacgaggcgggcagtaaagagcccggtaaatcccagcagtaccgctaaattcagcaaaaagctcagctgcgcaataaacggtgccagtagtttgaggaacggaatcgtcgttgaaagactgaaaatttggttcaaaaaaccatgtttggcaaagatggtcaggttcaccgtggcgagtcccgcggccccgtatagtaatgtctgcagctggcgtaacgccgcgtatagttgttgaaccgttcggtgggccagccaccaacgattcaccgtcatcacccaatgcacaaggtcacctagtttctaagttattgacgccaacacgttaaaggcgtcagcaattttcttgattcccattccggggatttgatagttactgagcaaaatgaccgcattttgcccattagcactaatacgtaaagtcccttcgaatccataaccagccccatttacggatcgtaaccggtcattaatatagaagccggccccgtacgtgcttggtgatcctgatcggtacaactgatgaacggctgatagggggataagttggccccgtaaaatcgcccgcgtcacccggtatagatctccggtactcatatataactgccccgttccgagttcatcgtgctcccacgccagttggcgaccggcaggatgatcgtacgtgttcagtgccgtctgcacccccgtactgttataccccgtggcagctaattgctgggacgccacattataggcaaaaacggtgtgcttcaaatgaaggcgcgcgatcacccgttgctgaaccagcgtctgatattgctggccgctcgtttgttccaaaattcccgccagtaaattaaaattcaccggttgatagttccacttgccatgcatcgcgggattaaaccgtactcggtgcagatcactggcgataattcgccgatcactcatcaccgtcgtcggtccgaccgcccccgtcattgatagtcctgacgtcatatccaacatttggcgaatcgtaatatggtgcgctccgggagccgtgggataaaaccgactgaggcggtcgtttagagacaccttcccggcggtcacctgctgcatcagtaacgctgccgtgatcatcttttgaatcgaatcgatttcatacatcgtctgccgtcggttcggcacttgggcgccgttgtcggccatcccccgcgcgaccgtcatcacctcacgaccgtgccgaaaaatactgcacgttcctgaaaaatgggtctcagaaaggactcgcgtgacttgcttttgctgcggtgtcgcgagctggggtgtcaccgttgtcgtctgatgggccgtctttgtgcggacacggtcagcacgacgaacacccacggcaagcgccgctactaacacaagtagcggcaccaatgtccattttaataatcgtttattcattctcttttccgcctacttgttctgtgctaactgccatgttcgactgaaaaagcggttttgtatccgatagtgtgctgctggttgcttgcgtgataggaagggcttcacttgctgatccatctttagccagccccgccagccgagatgaatcgtatcttccatgaagtacttctgcccaccatcatgggtgagatcgacaatgtgagtaaagccttgcgattgcagctgcgttttaattttacgatccgtttgcgcgtacattttgtcggataagccggtatacttggcccacttatgattcactggcggaatcaccaccatgacttgcacgtgatacttagcaaactggctgagtaatagttccatgtccgaatactctggcgattgcgtgtagttaaaattccgttccgcctgtcggaggttctgaacgttgtgcccacgcaaccgtaaattataaaacgaatctttaacgccgaaccggttattgccagtggcctgtgcccctagccggttggcaaccttcgttaactgggccgtcgaatcatgggcgggtaattgccgttccgcctgctgaatatgccggagccggcgaccggaaactaaccgagaatataaatcatcggcgttcaccaacaggttttccttggtcgtcaggtacgtccgttgccctgaagtaatggctttccccgccgccacgttggtaatggcggctttcatgattcgatcactgctggccgatggcattgtcagtaaccgctgggccgcgtatcgggtagccacgctgtcatgagcgtgcgtcaaccaatgaattgtttccagcggagaatagtaatagtcaaaggcggttggcatctgcccctgtttggtaaaccactgcggcgaaacgatgaataccaccttgcgattcttgagatggcgcatcacaccactcagcgcaaaatagtgcaccagcgactgggtccccggctttcccagcaagaaaggctggtaagaccggtggtacttcgccgcgagaacgcttggatgcagcggatccatccgagagagctcagatgagccaataaacggaacgtagccgtcatcaatggcctgagatttaattttgttacccttaaacacgttggtcgatagggaaacggccgccttttgttcggtctgcttactgacgctcccgaacccctgtggcacgataaacaccactgccacaagggcgacggccacgatgaccggtccaataatttgccaaatggttttatgcgcgttcattgcattgaagccaccttctcaataattttgttgggcgtattccattgattacgatcgaattcggagatcggcacatcgatgccgcattggtcctgcagttctagtaacatttcgacggtcgccattgagtcgactaagcccgagtcaaagatgttttggtccaaatcatcactgacgtcagcaccggtaatatcttgtaaaattgcaataattgtttgttttgtatccatgttaaacgactccctttttatattaaattctaagttgcagttaactgcgtccgtcgatgctacttaaaccacaggacgttcaaaaatcctgagaaaatcaagaaactaaagcagacgatattaaacgtggtaaaaatggctaggccctccgtccagcgattatgtggtaagccctggtggcgtttcttaaagcgcagccagtaatcgttgatgatgatggcactggcatgaaacaggccgtacacgatgtaaaaccacgttaccccgtgccagaaccccatgatcaagaagttcactaggtaagcgcattgcgagattcgcacccgattcttgactaatttatgcttcattaaaaaaaacgtgaaccgcatgaaaatgaagtcgcggaaccaaaacgatagcgtcatatgccaacgattccaaaagtctttaatgttgtgtgccgcaaatgggcggttaaagttcatcggtgtttcgattcccatcaggtaactaatcgcgacggcaaacaaactgtagcccgcaaagtcgaagaacaggtacatgctataggtgtacatataccccagcaacggcagcgataaaccggtatggaagaaggctgcccgttgtaacagggctgcatgcgcgacctccggtaatagcaacttgccaaagatgtacccgagcacgaacttatataaaaatcctaaaaagaggtaaaagaccgccttatttagtaattgaaggtattttgcgcgctctggtgccgtgcgatagtccttttcgaagcggcggtaccgatcaatcgggccagacgaaatcgttgggaagaagagcaaaaagcgcagaaagggaagcggctgaaaggccttaatcgtgccgtcacgaagctccatcaccatctggacggctttgaacgtcaggtaactaataccgagaaatccgagtaaggattggctccctacctgaatcgccggcgtcaccttcacaacgaccaagggcacaattacggccactaccgcaaccacaaagacacttgtctgattattgcgacgacggtaacgggcatagcccccgacaatcaacagttggtagaggacgtacccgattagcgctacgccctgatgccagtgatcaccaccaaacgtcagcacgatgaacaccagtgaaaagagcgtttcgtaggccacgaagcgtttaccgtgatacagtcccacgataattggtaataaacagagcccaatgatgataaagtagctcggcgacgcgtatggttgtaaattaaccattcgggttgacctccttgatcagggccttgatgtcgaccttgccattcatattcagcggtagctgatcacggtacacaaactgctgcggcatcatgtacggcatcagttccgtttgtaaggcccgcttaatggtttcggtcagtgtcgcattggtctgcgccagatcctgtttggtcttcgtcacgacataggcaatcagtgctgccaccttatgctcgtgattatacttcggcacaatcacgccctgatgaacttggggttgcttgttgaggtagtggttaatttcttctaattcgattcgataaccatgcatcttaatttgaaaatccatgcgccccccaaagaataggaggccgtccgcagtttgaaccccgacatccccagtatggtaggctgggtactgatcgccgggatcaaacgcctgcgcagtcttatccggtgcgttcaggtacccctgcgaaaccgtgggaccactgatcatgatctcaccagactgatcagcaccggtgcttgctacccacactcgggtatcatctttcgcatacccaatcggtaaccggtcgtagcggttcaaaatatcatcagtgatctcaatggctgtcacggccaccgtcgtttcggtcggaccgtacgtgttgaagattcgagcctgcggaaaccgttgcttcaaccgtcgtgccgtactagccgtgagttcctccccgcaaaaacagaaatgggtcagttgtgggtagtgcgcctgatcaaaggttttggcgagcaagcaaatatccgcaaacgaaggcgttgagacccaaaaattaatttttaagttacctaacgcgctgaacaggcgcttgaagtcgccggtggtttcccggtctagcgcctgaagctcgcccccgagcaacaaggtaggataaagatccatcaccgaaagatcaaaggaataggccgtttgcgatagcccaaccacgtgttgtggtagcccgaaatcttgcaccatccagtcaacgaagctgcgcagattgtcgtgactgatttgaacccccttcggcttgccggtcgtccccgacgtaaaaataatgtagaaaatctgatccccgttaaccggatgcgtcaacgagtaggacacgacctgttggcaaatcagattgagggcggctggggcaatcacctgtacgcccggtagtgcgatgggtagggcgttaatcgcaatcaccaatggggcatgcgaaatttcttcaatcatggttaaccgctcggctggtgaatgccgatccaccggaatgtaggcgtgccccgatttggcacaagccagcatagctacgatcgtgttaaacgtctgatccccgtacacaatgatcggtgcatgatcagcgagtgccagccgatcgatctgcgcggccagtgcgtctgaacgttgtttgagatcccggtaagtattcgtcatccccagattgtcatagacgatccgagcggcattttgttgcgcaatggtatcaatttcttggactaaattcatgttgatcccccatttactaaaattcgttatagataaatccgctattattcacgccgctatatccgtagaggtagatcagcgcaattaaaactacaaaataaaatcccgtttttaggacaaatggcacgattggatgggtcgtcataagtgaccgcaatttgtgcatcttcctcacctcgttattcatttcaatacccacgacgggactcaaaaagcaccccaccgcggtgataattacagctattcactataattaccgccccgatggggtgccatataagtttgctaagaattaaattaaagattttcagaatggggcggccgctcaaacgtcacgatgaaccgactcccctgcggataattatccaaaaccttgatctgaccatggttaagctccgtcaatcgcgtcacgatcgccaagcccaatccggtcccttcaatcttttgagaacgcgatttatcagatctaaagaatctattaaagatgagttgtttttcttcatctttcaccccgttgccctgatcagccacctcaaatgcgacctgttgtgcggtttgagtgaccttgaccgtaatggtcgactgacgcggggaatatttatgagcattgctcagcaacgagaccataatctgttgaatactatcttggttagccgttaacatgaccggctctgtcgcggccaatactaatgattgcgatatgcctgactgataggccgcacaaacatcgcgggccactgctccgagatcaaacgtttgggtatccaactcagcattgtccattcgcgacagctgcaacaagctctccaacaagtgctgcatccgcagggactcctcgtcgatgaaccggagcgattcgggaattaattccggatggtccgttccccgccgccgaatgaggttaacgtggccgcgaatcaccgctaacggcgtccggagttcatgggacgcgtccgacacaaattgccgatctttcagtgccgtgtcgttgataattttcaacaggtgattaaactcccgcgtcagatcgtggacttcctttggattatccgcgaccggcaacttttcgtggtgcgtcagttcaccggaattgacaagttgactcgttgcgtccgtcagctcctgaagcggtgtgttgagtttttgggccagcttggaaattgatcgcaatccaatcaaaaagatcacgatacagaccgccacaatgataccaataatggtcaaaaatagccggacaacgcgatttaaactcagccatatttcgtacttctgaatccgatgctcatgctttttttcgctaaaatggtcatgatcgacgatgtggtagtacagcccctgtccattacgatactgaatatcttttacaatcggccaactgcggtagttatcggccagaaagtccttcgtatttttagaatagaatcgatccctcacttttccttcggacgaaaccgtgatttgaacgaaggtattgtgcgtgttgaacgcactcgtttcacgccagtaatcccagtcgatcttgtcgttaataattgattttttgagggattgcatcagttcggtcccattatttttcgtgctgaccaccaaaaacgagccgactaccgtaataatcgacacgctcatcagtaatgtgactaggaccagcacaatggcatacgcccgcgtaatctggctggcgctggttttaacccgactttttttattcgccatgatcgtccctcagcgaatatccaattccccgcacggtccggatcgccgaacatttgctggtgtcgatcttttttcgaacgtaccgaatataaacgtccacaatattcggatccccttcaaaattgacaccccaaattaaattcaacagctcatcgcgcgtcaaaacttggttagcatgttgcattaaaactaatagtaaattatattcgcgttgcgtgagggcgatcaggtccccatcgcgtttaaccgaacgcgccttggtatcaagcaccaagtgcccaatgcggtaaacccgttccttttccactggctggcttgtctgccgtcgaatggcgacccgaattcgggccaacaactcttcgatttcaaacggttttgtaatataatcatccgccccattatctaagccggccaccttatccccaacgtagtccttggccgtcatcataatgacggggacatcgtcagtttggcgaattttctttaacacccgcaggccatcaactttgggcaacatccagtctaacaagaccagatcaatattcccttggttggcatggtacgtttcaagggcttcaaccccatccgtcgccgtcaaaatgtcatagtcttcgaatttcaattcgacctgcaaatacgatagtagtcccgcttcatcttcaaccaataaaatcgtcgccatttgttgtgcctcccagtgttttctcgataaaccgcctttcattattcataaaacatcggttgattgcaaccattaacggcgggtggccctatttttttagttaactttaacaaaaaaatagcttcaaggactaatcatccccgaagcatcagtaaccttaatctttgctcattagtgtggttgaaccgcattaacctgctcaggcgtttcatgacgagcaaacttgagcaactccgcggcgtttggcgcgccgtccataatcttcatggcttctaactgcccaataacctcgttcaccgcatcgaccgtctgcaacccgggaaccgaaatctccatcatcgttaaatgggcgtaaagtacccgccaattttcggcggtcatcgtcactgtaattggggtatctttttggatcattgtcgttcactccctcgtggaacttaaaaaagtgcggacaaacattgactaagtttcaaactattacctctgctcatacccggattataacgaacattcctctgatagtgacaaccaaacgatttgaaattggtcgaattaatgtaagcgtttaataattctttgcgcttgatttccaactgaacacagtcggccgattcacttcaagccccctatctaccaccaaaatatgataggcttttcttatagcgctattaaactaagggagttagtaaaattgaagaaatttattgggggattactcgcctttctggctatttttctagtgtcaggaagcatcaaagcatcaaaaacaacaccactatctaatcatcaactcaaaactgcaattacgcatatgacccttcagcaaaaaattgggcaaatgtacgtctcgcgggttcaaaccacctctaaagatacggttgcaacgctgaccaaatatcaactcggcgcaattatcttatttggccctgattttgaaaatcaaaccaaatcgcagttcaaacaacgtatcacgggctatcaaaaagcggttcagataccgctgcttgtcagtacagatcaggaaggcggtgacgtttcacgcttaagttccaatgctaagctaacacatcaacggtccttcccgtcaccacaaaccacttatcaaaaagacggcctccaagccactattaaagaagcaaaacaaacggccaaaattctccacggactaggcattaactggaattttgcaccagttgcagatgtcaccgatgatccaaatagtttcatttatgcgcgtactttaggaacgactttttcaaaaactgcttcctatattaaaaaagtggtccctgcaattcagcaccagcaggttgccacctcattgaagcactttcctggatacggcagtgctgccgacacgcatactggcttcgctagcacgactcgttccctggctgattttgaagccaatgacttcctaacattcaaagcaggaattcaaagtggggccgattcaatactcgtttcacacatcgtcatgaccgctgtcgatcctgatcttcctgcatctctttcgcccaaggtccatcaattgctgcgtaaacaacttaaatttaacggcgtcattgtcaccgacgatctggcgatgggcgcgattaccaaatacgcccagcaacatcacgtctcaccagaccttctcgctgtcgaagccggcaacgatatgattatgagtgaccattacaaaactggcattcctgcaattgcacaagccgtccaaagtgggcaaatctcagagcaccagatcaaccaatcggtttatcgaattctgacaatgaaaaacaaactgcacttactttccaaaaatcaattgccgtaacaaataactaacagattaatccgaagctctacaactgattactttgctgttataaaataattagtaacatgtctacacattcattttaggagggaaaatatgattaaaatttgtccaaactgccaagcatcagtcgcgcctgatgctaaattttgtaccagttgtggttacgacctgcgtgacattgcccccatcgatccaactgctgccacaaccagtacagcagattcggtagccgccgaccaacagggagcgcagccgaccagcgagatgcccaacgaaaccacacagtcagcaaccaatgagacagccaatgatgcgtcacaatcaacagcaactaacaccgcaccccaccgaacaacaattaccatcgatactgctaatttacagcaagcttcccaaaattattggcagtggttagtaggttcttggaaaacaccatttagcttccatacaactagtaagtttgccggattgattacttttgcaattgaagccatcttatttggaattggaattggtcactacgttcaagctgctttcaacgcggttaacggtgtcgccaacagtacggccgccctgttttcatcaaccaaatcagccagctactccgtgagcctcggattctatgtagcagttatcttgaccgtatttatctgcgccattgcgatgtcgggggttacctacctgatttcgcgagctacgggtagtgtcggtcaaaactttgacttcttagactttttaagcgtgatcgcccattacagtaatctgattcttattttaaatatctgctttgacttggttgccttcatcagcgctagtggttcaggatcatttgttttgctatttattattttaagtttaattccactagtatggtctatcgccaccatcacagccgtcgtcgctgacaccgctaagactggcttagattgtatctacggcgcaatctttactagcattgccaatagtattatttatgcaattgcattttcacttgtgggatcacaagttatgagcatcgtcagagacttctcttcctcattcctcgatctttttagctaaaggagctatgtaaaatgtcagaaaataagttttgccctaaatgtggtcatgctgtcagtcccaacgacgaattttgccccaactgtgggaaccgactttcggtcgcaccacaagcaacgccccaacaagccccaagtcggtcgagtcaagccgctaatgcaactactcagccgagcgcaaccgctccacacgcaccacaaaaaccactcaataaaaaatggctttacgcaatcggtgctatcgttatcgtcctactgggtggctatcttttcggccgtaactactaccaacccaacaaacaggttaaccgcatgattgccgctctaactgataaaaatgccaacgctgctaagtatgtcacttcagatgaccccacactaaaagaaaaagtagactcaaccacagtggccccaatgcaaaaatattttagtgcaaataaggacaaggcggccgaattaaagtcagctcttgaaggcagcgggtcatacgattcaacctactctcttgttcaagacggtcatgcttggctagtctttccgcggtataaaatatccgtcactgcgagctacgttaatttaacaacaaatgaaagcaatgttaagttgtatcaggacaaccaaaaagtagcaacatcatcgagtgatactctatctaagcgggttggtcccctcttcccaggaacctatacctttaaagcttctgggaacgtatctggccgtcacttaactaacaaaaccaccattgatgttggctctgattccagtgatgttgacttatctctaaaatcattaagtttcaccgttaccggtaaccccggcgctgtcgtttacttgaacgataaaaaaattggtaagatcaataaaagtggtgaactcaaagttaacaactattctgaaaatggcaacatggaattatacgcaaccatgaaagtggatggaaaaacagttaaatctgatacgattgacgtcgaagatcaggttagtgatgacggaagcagcacgatcacgcctacattcagtggcatggtgacggaagatcaggcacaaagcctcttacagtccgcctatgatgaaaccgaaagtggtagtgaaggttccagttcggccgacgattttgttggtgaagaagacaacagcagctacaacgaactgctagaatttttcgatagttttagcgaagacgaaagttgggatgttgaagtgtcagatatcaccagtgttgtgccaagcagcaatggtggtgcgaccgcttcttacaaggtcaagtataccttctacaaagacgacaccaaaaagatccaacaattcacctataaaggcgccaaaattgttcaaaaagatggtgacttcctaatcagtaccgttggtaaaacgggcaaatcacctgattgggagaaaacctacgacaattagaacgtataattgttcaatatcattgacttaacaattaaaatgacgtgttatcaggaagatcgacttccttgataacacgtcatttttgcttttttctattatcatggtcattcaacgccgacataaccagcgctaatccaccattatctaagccatcattctcatgcgagttaattttcttcgcccaccgcaataaatttgcccacaaaaacagcaaacataaacgatagtaccaggtatgagacaatagcgattgttaattgcatcaacatatgccatctcccttttgtctatttttgattctaggttcaatatttattatctaactctgattatcgctggtaaatttgaagatttcaagaacttcgtcttaaagatttgctgtgttcgtaatctttttgctaaggaacttaagctattgtttagaatccctattttacttgaaggatttacactaattgaaatgaccgttgttttgttggttttattagcaaaacaaggcatgctaatcccaaaggccgggattaacatgccttattcgtacgcttcttttagcttgtctagttgggttccgcagagcagacttctgcgcttaacccggtctagctaaccattctccagctagtttagttgagctacacaaggccagccctctgcgcttagcaaaataagacacgccaatcccaaaagccgggattaacatgccttattcgtacgcttctctaactttgtctagttgggttccacagagcagacttctgcgcttaacccggtctagctaaccatcccaagttcagggatacttagctagaccacgttaatgctcaaagtctaaccactctgctccacaccctattttttattaaacggtaccgcattatcctttgtaatctttgtaatgccgtggaagtaagggaccaatgcctctggcaccgttaccgaaccgtcttcattttggtagttttccaaaattgctgctaccgttcggccaaccgctaatccagagccatttagcgtgtgcacatattgtaacttgccattttcgtcacgatactgaatgtgcgcccgccgtgcttggaagtcttccgtgttagagcagctcgaaatttcacgatagatattttgttctggcatccagacctcaatatcatgcgtttcagcagctgagaagcccatgtcgcccgttgacaatgtaatcacatggtacgccaaacctaatttttgtaagatattttcagcgttagctgtcatcttttccaattcatcatatgaattttctggcttcgaatacttcaccatttcaaccttgttaaattggtgcatccggatcaatccccgagtgtctcgcccagccgaacctgcttcagaacggaatgatggcgtcaatgccgtcacgtatactggtagcttttcggcaggaatcacttcgtcagcgaagtagttggttaacgggacttccgccgtcggaatcatcgtcaactgatgttcgtcagcttcgatttgatacacatcctgcttgaacttagggaattggcccgttccatacatggctttaccattcacaagatagggtggtaacacctcggtatagccttctttcatgtgttcatcaagcatgaagttgtaaacggcccgttccaactgtgcacctaggccgacatagtaaacaaatcgggcacccgaaactttggcggcccgttcaaagtctaaaattccaagtccttcaccaatttcccagtgggccttgggttcaaaatcaaaactcggaacctttccaaccttacgttgttcgacgttggcatcttcatctttcccaaccggaatgccatcatggggcatgtttggcaagtgagccatcttattttgaaagtcgatatcattagcgtttaactgatcatcaagggccttgatatcctcgccgacctttttcatggccgcaattgcatcatcggctgattccttgttccgcttagcctgcgcaatttgttttgatacttcgtttcgttgggccttcaacgtttcagtttgttgaatcagttctcgacgcttggcatccagtgcaaaaatagcatccaaatcggccgcagcaactccccgcgttgccaggcgttctttataatgatcgggatcggtgcgcatctttttaatatctaacatattccttacctccataaaaatagagccactccatcctcaaatttttgggacgaaatggctctagttccgcggtaccacccaagtttgtcttacgacaccctcgttacattgataacggccaatcaccgtgcggcattacccgcccacatttagctgcatcggagtttcgacgtccgcttcacaccacccagcggctctcttagcgtctacttgaaatgcaatcgtgtttcttaacaaagtaatgatagtacattcgttcctgtttggcaaccagttcatcgagtgcccactaaaaattggcaattccttcaaccacatcttgcgccgtaattttattgatggcggtcgcatcactttggagtgaaccatcagccacaatgcgcacatcgcgcgcctggctaatgaattgcaacaggttccgaacccaacgaccattgccgtcaacccggccagcctgtttcgattcatgaatgtaggccgtcagtttttcttccgcatccggtgtcaacgtctgcttcaactgcccaatttgtaatttagcaattacaaccagctcatccgcactgtaatcagggaactccacgatgtttacaaaccgactcggtaagccgtcgttggcttttaacaggtgtgccatttcttcggtataccccgccatgaccacgatcaggtcggcccgcaagtcatccatgtccttgaccagcgttgtcagagcttcacgtttgtagccgtcactaccaccggaagttggatctaattcataggcttcgtcgataaataaaatgccgcccttggcttccataatgagcttatgcgtcttcggtgacgtttgaccggtatactcaccgatcagatctttccccatcacttccttaatttccggcttggtgatgattccgttcgaatataaaatcttcgctaataaccgcgctacctgtgtcttccccgttccggcagaaccgctgaagattaagtgcaaactgttggcggagacgggctgtcccagctccttacgtttctgattaacgaggttcgttgaaatataggtgttgacctttttcttcacatcggccaacccgatcatttcgtttagctggtcctgtgcggttttgggtttcggcttaggcgtaaacttatttctatacctaaacttcgacgacgtaaacgtaattttcgattcttccttatggaaagtccacaaattttgatcgttgtaattcacaaaatcaacgtttccgctcaagacctgattagcccacgcattaatatggggccattctccactgaatgttatttgactacttggtcttgccttaaccctgaataattggatgttctttttcagaactgctgtttcggcatcgctcaacgtcgctggtgcgacaatctgatcaatgtgcatgctaccagccactgtcaacgccgtctctactttttcaagctgctgcgcggttgcgaaggcgccgagtgcaggggtaaattgcgccacttggaggtcatgatcgtaagagtccagtgagccacgggccgcctgtacctcttgaattttaccagtcacccacgcaccagcatcaattaaaaccagcttagccatatcaacttgacacgccgcaaacttctcgcccgtttgcgcaaaaaaactgcttctggggtaaccaagtgtccctagctgaaatgtgtttccttcacatttttgtgctttaatcacgccataatcaaccgttacttcatcaagaacaatcctctccaatggatgttgcgtcgtaattgacggatacgcatcagcaacttcttcatgttcaaacgtgcagtcgcccagatacatcgacaactctggttcaaaaattttgagcccgttcgattttctcggcaccacaaaatgaacatcgatgatgttgcacaaattatgaattcgtaggccgatcgtccctgacttagcgatatagcgatgcccatttcctttaatggtgaccatcgtcttaagggccaccgaatcaataatatctgatgtaaactcaatcgtatcttcatcgattaattgatcgacaatcgcagagagtgccccctcttttacactgccaaaggtactgccgatccgaaaggttttattcttccgttgcttttgtggccgtttctttggtggctgtggttggttatccctctttaatgaatccgccataaaccacccagcagtaaacgcttcaaatccgctcatccccatatgtaaagcctcccaatattaactactgttctgattataatatagcgggtcggctaaacctatagttcgacggcatttcacccaaaaatcccccggtcaaaagacacttctttcgaccgagggacttcagtaattactattcgtttgtcattattgttcaagtgctaattcacacgcgggttggctagcaaatttgattcttcatggtcactttttgctcgtcgcgttcgcgagctgcctcttcctctgatttggcaacttgaatcgtcaccgcactatctaacagtccagagtcatcccctagttgcaaggtccccgactgatgctttaaattaagccccgtggtgaagaaatattcttccgctttactcgtgtaaagctgtaggccagcgtcattgaccaaaggttgatcaaaatctggatcgagtcggtcactcacaaccagctgaaacttatcaccgattgcgcacgttccgccgaggttcgagtacttgttcgacccatcatccagcgccagaatcaccggtttagtgaagtcaacgtgcttcttgaggtacgttactgcagtgtctttgatattaattttcatcagatcaccccttctttggacctatcataccgaattagaggggaaaatttaaatgatctgctcacctttagtaagccattgtgagcttcacccgcgcttatgacaatcccgcggtgcccaaattaaaaacgccccactttctcaagtcaggcgttcgtaaatcaattcactatgcttcgtagtacttgtaacgaatcgtgtattccttaggttgacccggttccaagacaatatcgccaaaaccatcatggttgatagcatctggcaacatttgggcttctgtcgccagggcgttgtacggcttcgaatcatcctgtgggttggccgtgtagacaactaacccgttacggtcggaatagattgcaacatgacggttgctattggtatcacttaaaaccgcaatcggctgatcatcacttggtgtcacctcgaaggcatcgtcaatctcgatcttaccagtttgggcttcaatgtcggttaacgccttagttactaccatggcgtcagtaaagtcatagccggttcccttaacagccaagaacttgcctgtcgggagcttttcttcgtttaattccagccggcggtcggcgttgatcttcagttcttgactcgtcaagtcggcctgaccatccgtcaggttaaagtaagcatggttcgttgggttaaagagggttgccgccgttgtcttggcgccaaaggtaatcgcaacttcgttatcatcgttgaacgtgaacgtgatggtcacgtcaatatcgccaggaaagttatcgtccgcactgtcgatatgccgagagaacgtcacgctcgcatcatgttcccgcgtttcttgggtggcattccagatcagttcagtaaacccgttaaagcccccatgcaaggtattcccattttcattttgatcaaaatggtagtcctgcccgttgattgttgcttgggcgttagtcaaacgaccggccacccgccccacggatttgcacaggcagtagttagcaggaccagcgtaacgatcaacactatcaaaatgaacgattagtggcttgccattgaccacaaagccctgccaaatggcccccagtgtcagtaactgaatgtagttaccggccgcattcttgatcgtgtaacgatcgatattttgtccttcgtgctgtccaaaaatgtctgttgtaatttccatcatccattatcccctttgaaaacgctttaattggtttatattatacacttttctgataattgatgagtaaaatttttaggattttttagtaaaaactgtgttgggtccaatttatttggtcgcatccacgccataccgccactgaccaaaatagtgcatgatcagattgagcgtcattcccactagcacggcggctaaaatcgttcccagtccgacactgcctagcccgtgaacgagtagtaaacatgtaatcaacgacaaaatcaccatcgttgaatcggtcgccatcttaaccttgggaaaggcaacctgcgtcgcatccgcaatcacacccataatgccctcaccggcgagcggaatcaagttcgtgggcatgtagaaaaagatgccgatcgcaatgcaaacaatcgataagaccgacagtaacagttgcaccccgaaattggtggcgttgggtaagaacgtcacgagccagttacaaaacgtggtaaagtagccaaacacaacgccaactgcgacttgaaatagttgtcgccactgaaaccgtcggcgtaaaattataatttgtaacaacacgagaaagacgtgtaggataatggttgccttgcccatttcaattccccacaccaccgtcatggtatacggaatcgagctaatcggcgatacgcccaagttagacttaaccgatagtgagatcccgatcgtcatgataaaaaggcccaggaagtaaaatcctaggcgctggccaattgtttgatgtttcattcaagttcctccaagttttaaaaaatagttagtaaactaagtattacggcaaaattttagcgcatattctcaagcatctgtgccatcaccttaaaaaagacggccaaatcggcatcatcgacgtgcgcggtcagcttattttcaagttggataatatcagccagcaccccactacgagcttgttctgccttagcggtcggaataattcgtttgcgtcgattatcctcaggcatcgactgccgcacaattaaaccagcctgctccatttttttgagcagcgccgacgcggtcgaaggccgaatactatacttttcttcaacatccttttgaaaaatatcatgtgtttgcgtttcaactaatatgtaaattaacgtacgcgcctgcgcgccattgataccatttcgtgttgccgagatatcgagttcccgccgaatcttattatgcaacttgttgacgtactggccgacgtctttttcttttacacccattgattacgctcctgtaaatacttattttcctaactatattactcgacaacggccaagttgtcaaaaaaagcattccctaaaaatcccaggaacgctttttgatctcctaaattttagtttcagaatcttggcaactttaacgatgctctaaactgcttttttcatcactttcggttcatgcttttgtacccacaacgcgagccgcgtttgcagtaagcgctggtacaggcgtggggagcactttttcaagctatgcagcatgaggagtaaaaatggtaatccgggaatgattggtagcgcaaagcccacaattgcgccaataaatcccgtcaatgataaggtggcccacaacacttttgtcattaataatggcatctccaatccatcccctttctgaaatcttgtagctatcttacggggtcaaacgagagaatgcaatcaatgccaagtgccctttgctgaaacttaatttgcttaatattttagcaagaatttggccgttgtttattcatgaataagggaaaatatgatttatttgcgtgctaaaaaaggctatcagatcgttgatctaatggcctttttattgtgtcttaattggtaactggttgcataaggagagacttcgcatccctaaatcaaatgcacacccttatccacatacatcacatcacccgtcacgccggttgccatgtcactcattaggaacgcggccacgttaccaatttctgtgaccgtgacgtctttcccgtccaccgttcgctcacgtgagatttttagcaggttaccgtgatccttaatgcccgtgaccgcaagcgtcttgattgccccggccgagatggcgttcatccgaattccctgctcgcccagctcactggctaagtaacgcatgctggattccaatgccgccttggcaacgcccatcatgttgtaatgtgggaccgcccgttccgacccgaaataggtcaaggtcacgatcgaaccaccatccgtcatcaagggttgtgccgccttagcgaccgcaattaatgaataggcactaatttcctgggccaaatcgtaaccggcccggctggttgagaccagtccgtgctccagcgtttccttgtccgcaaacgcaatcgcatggaccaatccatcaattttgccgtaacgttcaccaatcgtcgtaaacgtttgggcaatattatcatcgtcggcaacgtcacattcgatcaggtccgcctcgtcagggacaaaccgttgtaaactttgcttgattcgttcattttgataggtgagcactagtttggctccctgggccaatgccgtttgcgcacagccccaggcaatacttcgcttgtttgccacccccatgatgacaattgtcttaccggtcaataattcgctcattgcttcgtcctctcacttaaaattttctaaaccgtgcgtgtcgctgggccaaccgttcggccgccggcaacgcactcaatgttgttattttttcggcaatttgttgccgcaattgctgtagctttgcgacgtcgttaacctcgtcaaccacccggtcaatgatcccgtcttcgtaaaggtcctgcgcggtcaaccgcatttgttccgccgcttctgccactcggtgcgcatccttccacagaatactagcgtagccttccggtgataataccgagtaaatgctatcttcaaacatccacacttcatccccaccagctagtgctaatgcaccgccactaccgccttcacccacgataatgctgaggtaaggcactttgatctgggcaccagttagtaggcactgggcaattgcttctccctgaccatgatgttccgcatggacatctggaaacgcccccggcgtattaatcaaggtcactacgggccggccaaacttatccgcctgttgcatcaggcgttgcgccttccgatagccttccggttccggacacccaaagtggcactgctggttttgcgccagtgtttggcccttttgaattccaatcaccgtgaccggctgcccgttgagctcgccaatgccaccgatcaccgccgcgtcatcgctcgcatttcggtcaccatgacactcaaaaaaatgatccaccacgccattaatcagggcccgagtggttattttctgttcacttctggcggcttgaaccgcttcaaatgctgtccgtgtcattgtgtccctcctgcatgccaggtcaatagtcgtgccaaggtctgctttaattgcggccgtggcacaatggcatcgataaatccgtgttccaacaatgtttcagcccgctgaaaatcagccggtggcgtctgtttaatcgtttgctcaattacgcggcgcccggcaaacccgaccatcgtatgcggttcagctaaaataatgtccccttgcatagcaaagctagccgtcacgccacccatggtcggatcggttaggacgaccaggtaggccagtccagccgcttgcagctcactcaccgcctgcgagaccttcgtcatctgcatcagtgagtgaatgccttcttgcatccgcgccccgccagaagtggtaaacaccacaaccggtagctgacgttgtcgcgcctgttcaaacaaccgcgttagcttttcacccgtggccgatcctaaactgcccatgataaaccggctgtccatgaccgctagcccgcaggcttgccggccaatcgttgcgaacccggtgactacactctcgttttgctgggtcttcttctttgcctgactaatcttttgtcggtactgaagatcgttaaaccgaaccggaatcgtcacctcccgatcaatttcttcaaactgatcggtcaccatcatgattcgttcgcgcgcgcccaatcgaagaccgtacccgcattctggacacgtcttatcgatggcatcgtgggctaaaaatgtcgtttgacaaacaggacaccgtaccatcacgtcatctggaattttatccaaccgttgcgccaattgttccggtgtcggtgcttcaaatcggttattcatcatgctgtctttcacctctttagtcgcgcaacgcccatcaattcactgctttttccgtttggcgttgcattcttcctagaaattcctgctcaacataaaccgtcgtaaactggtcctcgatcacattggcatccgctaacagcgctagtaaaaacgatcgattcgtggtaataccggtcaccgttagttcgttcatcacacggcgcatcttatgcaagaccgcatgtcgatcatccatatggacaatcaccttagcgatcattgagtcgtaaaacggtgaaatcagatcccccgccacgaccccgctatcaatacggaccccatgggtgccagccggtaagttcagccggtcaatccgtccagcaacgggttgaaattggttggccggatcttcagcgttcagccgacattccagcgccgtgccgtgaatttgaacatcgtcttgggcaatcgggagtggctcacccgccgcaaccaaaatttgcgccttaatcagctccaatccggtcacttcttccgtcacggtatgttccacctgtaaccgagtattcatttccataaaataaaattgctgatcctgatccattaaaaattcaaatgtcccagtattggtgtaccctaactgacgacaagcctgtactaatcgttgccccagtgcctgacgatggtcctcatccagtgccgaacaaggactttcttcgatgattttttggtgatgacgttggagcgaacagtcccgttccggcagatacaccacgtggccggcttcatccgcaatcacctgcatctcgacgtgtcgggcattgacgatcaccttttcgatatagatactatcgtcgcccaccgccgtttgggcttcctgctgagcggcgtgaaaggctccgaccagttgatctgcctgatcgacccgtcggattcctttgccaccgccccccgccgaagcctttaagagcaccggataaccaatgcgttgggcctctctggctgccgccgtggcgcttgtcacgaccgctttgctgcccggcacaactggcacaccggcctgttgcatggcctgacgcgcatgagccttatcgcccatagtttcaataactgcggcgcgggggccgataaatttaatctgacaatcctcacacagctgcgcaaatgccgcgttttccgctaaaaagccgtagccagggtgaatcgcatcacatcccaataaaatggctgtattaataatttggggcatattcagataggactgtgccggttgtgggccaccaatgcacaccgcttcatcagcaagttgcacaaactggctttcccggtctgctgtcgaataaacggcaaccgtcgccacacccatttcctgtaaattacgaataatttgaaccgcaatttcaccccggttggctactaatactttgttaaacaattgcatctctccatttggttttgttctgcttagataggtgtctgagttgtgcttgtggtcgactcctgaaagtcggcaagcttggttgatgggacgttcgcatcacgttgggggtcacgctccggttcgttacacgcccttatccctgtgccgcaaagatcaactccgctcggcaccttacctcaccatcacacgttacaattccggttccaaccccgatctgtcgtctaatcttcgtcagttcgaccgtcagctccaaccgatcgcctgggcaacaatccgcgctaaactccgcctgcttaatgccaccaaagaaaatggttttcccctcatactcggggaccgtcagcaacgctgccgttcccgtctgagcgagcatttcaagtaagattggacgcggaatcgccaagcgttgtgtcggttgacggaagtaccattcattgatcgtcaccagtttgagcgccttcgcactttttcctggttcgatcgcgagaaagcgatcgatcatttgaaacggataccgttgtggaatcatctcatcgactgcttgcataccgtcacccctcactaatttcaaataatggttggtcgtactcgaccatcgtctgatcgtccaccaaaaccgctttgatcgtgcccgtgaccggactcttgacttcgttagccattttcattgcctcgatcgaacagatgacatcccccttttgaatgggatcgccaatctgcttggcggggtcgttaaacgtcaccactccgactaacggtgccttcacggccgttgccgtctcatcgacgaccggttgtgcgggaccctctgccgccgtgctaacggttgctggatcatttgtcggtgcacttgctaccggtacggccggagttgcctgctcccgcttgcttagcgatagctgaaattcatcttgaacaagctgaaaatctagcaatgatgactgatcgaacttcgtcattaattgttcaatttctttttcattcatcttctgaatgccacctctttagcgcgatcacggcgttatgaccaccaaatccaaacgagttactgagcgcatactcaaccggtgcctgtttgttctcatcgttcaccagcgtcactgggcaggcttcgtcttggtgctgaaccccaacgttgactggcatctgactccgttgcatggccccaatggtcgcaaccgcctcgatggccccagctgccccgagaagatgacctgtcatccccttcgtgctgctgaccttcacgtggctattttgcccaaagagccgttcaatggcctgagcttccgcactatcattagcagccgtgctcgtcccatgcgcattgatgtagtccacttgatcaggggtaatgtgggcttggttaagggcctgttgcattgctcgtgtggcacccttgccttctggatccggtgcggtcatgtggtaggcatcgctcgtggtcccatatccgacaacctctgccaagattggcgcatgccgttgctgggcgtggtctaacgtttctagtaccaacgttgcggccccttcacccatcacaaacccgttgcgatcccgatcaaacggaatcgaagcctgctgtggatcctcacttttagataaagcagtcagcgaagcgaagcctgcaatcccaatctggttgactgaggcttccgaaccacccgtcacgatcacttgcgccttaccgagttgcaggtactcgaaggcattgccgatcgcattggttgccgaagagcacgccgtcacgattccctgactggtgttttgcgcgttaatcataatcgccacatcccccgctgccatattcacaatggaattaggcacaaagagtggggaaacccgcttcgggcccttttcgtgcatcttgatcacttgctcttcgatcgtcgtgagccccccgatcccggagccataaatgacaccgagttcttcgggatcgacgcccccgtcacttaatcccgcgttttcaaatgcttccgcggcactatacatagcgtattgcgtgaagaggtcattacgttttgcacttttcttatcaattcgttttgttgcatcaaaatctttcacttcgccagcgaccgtaatccccgtcgccgtggcatcaaacttagttattggggcaatcccgacttgtgactttaaaatgccatcaataaattctgcggcactattgccgagcggcgtcaccgctcccatgcctgtgatcactactcgcttcatatggttcctcctgttgtaggggtatcccctacatcgttagtcccccgtcaaccttcagtacttggccggtaatataggggttatcaatcaaaaatttaaccgtgagtgcaatttctcctggttcaccaaatcgaccgagcggaattttttccacaaactgttccacaacccgttcgctgagcttggccgtcatatccgtattaatcattcctggtgcaatcgcgttgcaccgaatatgacgtaatgcgccttcttgcgcggttgttttcgtaagcccgattaaaccggccttactagccgaatagtttgcttggcccaaattaccgtttgttccggcaatactcgacatattcacaatgcacccacgacgctgtttttgcataatcttcatcgcggccttcgtcatgttaaacgcgcccacgaggttggtatcgatcacggcctgaaagtcggccagtttcatccggcttaacagcttgtcacgggtgatgcccgcattgttcaccaacacgtcaattcgcccgtaacgatccataatggtatcaatcatggcttgcgcatctgcttcgaccgccacatcgcccacgacgacatcaatgtcaccgagggttgcttggaacacctcgtctggttcatggtgggcgttaatcacgacttgattagtaggcgttgccagtgcttgcgcaattgccagaccaattccccgtgtcccaccagtgaccaaaatgacttgtttttcattatccatgaacttcccccaatgcatgtcggacctgattcagcgtcgccacactgtcgacgtgggcggtcgtcaaatccggatgattcttatgcgctaatttactcaacgcatcccccggtccaatttcaatcaacgtgtcacagccttgatcgcacaacgccgtcaagcaaagatcaaatcgggtgggttgaaccagttgtttgaccagtgtgtctctcaggctcaactgggcaaacgggcgcgccgtcgtattactataaacagccacgctgggttcctcaaacacgacgtcttgtaaccgccgtgccagtgaccgactggccgccgccatgagtggcgtatgcgaggccaccgtcatattcaacggtactacccgcttgattcccgccgcatgaaatcgctcagtggcctgagcaactcccgtagcgctgccgccgatcacaatctggcgcgccgtgttgtagttcgccggataaaccagctctccttgttcacggacctgatggcaaattgcttccacctgttccgcactcgttttgagaactgcactcatcgttccgggtcgttgcgtaccggcttcattcatgtaagccgtccgatcgacgacaaggggcaaaattgtggctaagtccaggctgtcggccgccaccagtgcgctatactcgcctaaactcagaccggtcatcgcagctggtgccggtaattccggtgcgagcacgcgatgcaaggcgacgctaaacgccacgatgttggcttgtgccaattggggatcttccactactgccggcgtcgttagatcatgatgcaaaatgtcgctggcttgatcaatcacgtctcggtaactcgcttcttgggcgtataagtccgcacccattcccgcaaactgttgcccttggccgctaaataagtatccgattgtcatgtttgatcacccggcttaggccttttgttccagaacgtagttaaccaaatcgccaacggtggcaagcccttcatcgctttcgatttcaacgtcgaatgtatcttcaattttgtcgacaatttcaaacacgtcgaggctatcaaggctgaggtcactcttaaagtttgttgttaattgaatgtctggtgcgtccgtatccagttggtcgatcacaatgtctttgatttgattgaaaacttctgtttgattcataattaaattcctccaaatttgatttaacttgtttttgatttagtttaaaactgattgatgtcatagaactgccgcagtacaggcgtggtgagtggttaatatcgtaaaagcaccgttcccaccgttaggccgccgccaaatcccgttagcgccagcaagtcgccgcgctgaatggtaccatcggtcaccaactgatcaagtaacaatggctcacttgccgcggccgtgttgcccatctctccaatgtttaccggaaatagagcactctcaaccgccatcttattcgccaccgcctggatgatccgttgattcgcctgatgtaatacaaaatgatttatgtcattaactatcagacgagattgtgtcacggcccgttcaatggattgcgggatttgcttaactgcgaatgaatagatctgccgcccattcatctgaaagtatggctggcccgcgctcgtctggccggtgaagggatcatgactcggcagctggcccgcagtcaaatggtcccccagatcgccaaacgtgcggagatcttcgctgatccaagccccttcagctgctggcgcgctgctcagtagcacaccagccgcaccatcgccaaacaataccgcagtactgcgatcctgccagtcaatcaaacgactgaggacttcgcccccgatcaatagcgcatgcttttgtcggtcgccgattagtaactggcgtaccacgctcaagccatacacaaatccggaacaggctgcatttagatcaaaggccgcagcatgctgggcgccgagattgccctgaaccccggcactgacggacggtgtcaacgtatccggtgacatcgtcgccaccacgatataatcgagatcatcggcggtcagattagccttcgctaataacgtttgggcgacttgcgtgcacagctgggtcgttgtttcatcagtactgatatgacgctgatgaatcccagtccgttgcacaatccattcgtccgatgtctccataatctgggcaagttgatcattcgtgaccacccgcttaggcactgcactggccgttgcttcaattgtaaaattttcgaatttcaatgattggttgcctcgtctacaaaattctgtaagttcgtgagcgcccgcttgatcaggggcatgtcgttttcatccatcccgatcaagaagctctttaccagttgtcgatgaaaagcatcgtgagcccggtagagtaaccgccccttacttgtcagtgtcagattaatgacccgccgatcctgttgatttcgaatccgctccacgtacccacgcttcaccagcgtgttgacactggaggtcaacgatcccttgctgagatgaagctcgtgggctactgcgctcgtcgtcttttgttcatgcagcgtaatggcatgaaccaagtgaagttcattgatggtaatatctttgaaccggctcttacgtagttctcgttcttcaattctcaaaattttatcgaaaatttcaactaacgaatcgttaataaataggaaatcctcgtgattaatggtttcggcggtgttctttgtcatggtacttttctcctgtgaacgtttttatctcttattataactttgattcagcgtccgcaacgataaaagttaatccggcagagcaagccacctgatcatccacaatggcttggcaatcaaccgttcccatattatcgcgttgcttcaccattttaacgtgtaatttcagtacatcgcccggtctaaccacccgacgaaatttggcgtccttgatcgcaccgaggtacgcggttttgccttgatatcggtcggccttcaagattaaaatagaggcggcttgtgccagtgcttcaataattaagacaccgggcatcaccgggttccccggaaagtgcccctgaaagaattcttcgttaattgtgacgtttttcgtcaccacaattgattcaccaggttctagttcatcaaccttatccatgaaaagaatcgggtaacgattgggaattaactgcataatttccgttgtatctaatagactcattactaactcctttatgatctagcaattagttcgatattcaaactaattggttaaattttttacttgctgatcggtttcaacaagttaccgatatcctatcctaatttagtttggatttcaaactattttaacaaattttgacttaaaaaagttttccacaagcgtgaatgccttgcgactgttgaattccagcgatgtatgaattttctttgaatttccgtttaattgatctattttatcacttaaagtatgtgccgttttagttggttgaaccaactaattcggatatgcgctcactcagattggagctgaaataatggacgccctttccatcaaaaatccctacgccttcaatattttgaccggtgctaaacccattgagtatcgtacttggcggccgggcaacaccactcaatttttactggtctcgtcgcagaccccctcaacgaccgactttggtctgggcatggccaatggctatgccctcgccatcgttcaaattacggccgtttctccgcaccccgaccaagctagcaactatagctggcacgtgcgcccgatgatgcccattaccccctttccggtcaagggtcgactccatttttacgaagttaacgaggcacaaattcagcgacgcccagacctcatccccgcgatgcaggcgtttctcaacaaccataccgatcccgccggtgccgcgtttaaacagcaaattatcgatcccctcacccagattggtatcacccaaatgccacaaaagtaccaacggttatttaaagccaccggttcctggcgctcggtcatccaagcgtggcgccaacgctaatgggagcggtatattgtggcgataatcagcatctaacacgcgtcggcttattttgatatcaaaaattcttcaattatgtttgtaaaatttccgaatttttggttttcttcaattacgattgaagaaaatagttgaccgtgaactacacgtcacttaagtaacgtgctgctaaaaagcaccgcagacttattatcgattcattgaacagcgaacaaatgaacacaaaaagtgctgttacaaaacgaaatatcgtttcgtagcagcacttttttaaattctttttcggcgatagcttagttaaaacgagcacctaatacagagtagatgtagttgttaagggtagccttgattgcttcaaggtgaccagacttagttgcagcaattacgtctgcatctggtgtgtcgatgatgtacttttcaaggtcagcaaatgtaactttaccagcttcgaagtcagcaccgatccctgaatcaaatgatgagtaacgatccttcaagacgtcttcaaagtagccgtcttccatgatcttagcagcaacccgtaaaccagcagcataaacgtccatgccggccatgtgaccgtagaacaagtcttctgcttcaaagctttgacggcgaaccttagcatcaaagttcaaaccaccagtaggaagaccaccattcttcaagaattcgtacattacgagtgttgcttcgtagatgtcgttagggaattcatcgatatcccagccgatcaacttgtcacccatgttggcgtcaagtgaaccgagtaagccggcttcacgagtaaagcgtacttcgtgttcgtaagtgtgaccagctaagaatgcatggttaccttcaaggttcaacttaaagtcattttccaaaccgtatgtcttcaagaaggcaattgttgtttgggcatcagtatcgtattggtgtgaagttggttcctttggttttggttcgagcaagaattgacccgtgtaaccaatttccttagcgtaatcaacggccaacttgaagaaggctgcgatatggtctaattcacgttttgtatcagtgttcaaaagtgattcgtaaccttcacgaccaccccagaagacgtatgattctgaacctaagcgcttagcaatttcaagtgagtgcttgatttgtgcaccggcataggctaaaacgtcagcaaatggtgtggttgcaccaccagcaacgaaacgcttgttagtgaacaatgatgatgtgttccaaagtaatttcttaccagtttcttgcatcttttgttcgatcttgtcgacaactttgtccaagttttcgttggtttcgcgaagggtgttaccttctggtgccaagtcacgatcgtggaatgcaaagtattcaacgcctaatttgtccatgaattcgaacatgtaatcaactttggcaagagccagttccatcgaaccttcttcgccttctttgtcccaaggacgttgtgcagtaccttcaccaaatgggtcaaccaagcgttggtccattgtgtgccagtaagcaactgagaacttgagccagtccttcatcttcaaagttttgccgttagcagtaatttcttcttctgggttgtagaagttgtagcctttagcagccttaaagtcgagtccttttttgccgccaagataggtagcctttggaaaatcaaataattcagtcatgtccatcctccgtgtgatttgggtttgttttagtggttaaagtttatagttggttgtccgaaacaactaaccgatgacattagtatagcggatccaaatttcatttgcaagcgttttcgcaaaactttttgactaaatttaggccggttgtaggattgtctacaagatctgaatttttttggtaaaaagtgaccaacaaagtgactttttcttctaaattggttgtcattaattagcattcgtttaagaattcatgtctacaccttttctttcttttacattcagtttatcctgaatatggctataagttgttgactgtccttatatcttcaccattccgtcaagaaaatacggtctgaaaaattgcaataagcccccatttggaagccatttccaaatgggactttttttaccacacttaaaaatcgggggttcacataattagttgtgaacccccgatttttgattttattgatcaattaatttctacgactctttttaccaattcccaaaagtcctaacatcgacatcaatgctaagccaattacagtgagcattgtttcttgctgctgatctgtttggggtaacttctgatctgattcttgctgggtcttagaagaagttgctcgtgtgtgatctgagttttgagcgatgcctgttgcttggcccaactcaatcggagttgtatcacgcgacgttcctgttgggtgatcatttttcacattcaccgtgtgattctcagtagttactgtgttttcaccacttggttttaccgttggatcggttgtctcaggagtaaccggcgtcgaaccatccgttcctggtttattattgccatcatctggtaacgttggctgcccgttattgtcactatcgttcagtgtgtagacaaacgttaacgacattacgttgccttgatacgtcccgctagtttcacgttgcgttggcgtgtatcctgaaataatcgctgcagtttccgtaaagctgtcgccttgtgctcccgtaacttctttatccgcacttagttgattaccattttcgtccacgtagtgcaccgttaacttcaccggtgtttcgctttcgtctggagtgacaccatctttcgtgtaaacaaaggtcaagttcattacattgccttgatatgtcccactaatttcgcgttgtgttggcgtgtatccagagactgccacagcactttccgtaaagtcggtaccttgcgtaccagttacttctttgtctgcgctcaattgattgccattctcgtccacatagtgcaccgtcaattttaccggtgtctgactttcatccggtgtgacaccatctttcgtgtaaacaaaggtcaagttcattacattgccttgatatgtcccactaatttcgcgttgtgttggcgtgtatccagagactgccacagcactttccgtaaagtaggtaccttgcgtaccagttacttctttgtctgcgctcaattgattgccattctcatccacatagtgcaccgttagcttcaccggcgtttgactttcatctggggtcacgccatctttcgtatacgtgaatgtcaaatccatcacgttacctttgtacgtgccactaacttcacgttgtgttggcgtgtatcctgaaataatcgctgcagtttctgtaaaactaccgccttgtgtaccggtgacctctttgtccgcactcaattggtccccgttctcgtccacgtaatgtaccgttaatttcaccggtgtcaggctttcatctggcacaacaccatccttcgtgtacgtgaacgtcagatccatcacgttgcctttgtacgtgccactaatttcacgttgtgttggcgtgtatcctgaaataatcgctgcagtttccgtaaagtcggtaccttgtgttccggtaacttctttgtccgcactcaattgattaccgttctcgtccacatagtgcaccgtcaattttaccggtgtttgactttcatctggagtcacgccatctttcgtgtacgtaaacgttaagttcattacattgccttgatacgtgccaccaatttcacgttgtgttggtgtatatccatcgatcacagcagcactttcagtaaagtcagtgccttgcgtgccggcgacttctttgtccgcactcaattgattaccattctcgtccacgtagtggatcgttaatttcaccggtgtttggctttcatctggggtgacgccatctttcgtgtatgtgaacgtcaaattcatcacgttgccttgatacgtcccactgatttcacgttcagtcggggtatatcctggaatgatcgctgcggcttcctcaaaaatatcgccttgaatgccggtggtttctttgtcggcacttagttgattaccattctcatccacatagtgcaccgttaacttcaccgacgtttcgctttcatctggcacaacaccgtcttttgtgtatgtgaacgtcagatccatcacgttacctttgtacgtcccactaatttcacgttgtgttggtgtgtatccagagactgccactgcattttccgtaaagtcggtaccttgcgttccggtaacttttttgtccgcactcaattgattaccgttctcgtccacatagtgcaccgtcaatttcaccggcgtttcgctttcatctggagtcacgccatctttcgtgtaaacaaaggttaggttcatcacatttccttgatatgtcccgctaatttcacgttgtgttggcgtgtatccagagactgccactgcattttccgtaaagccggtaccttgcgttccggtaacttctttatccgcactcagttggtcaccgttctcgtctacatagtgcaccgttaacttcaccggtgtttgactttcatccggagtcacgccatctttcatgtacgtgaacgtcaagtccatcacgttacccttgtacgtgccactaatttcacgttgtattggcgtgtacccagagactgccacagcactttctgtaaagtcggtaccttgcgctcccgtgacttctttgtccgcgctcacttggtcgccattctcatccacatagtgcaccgttaacttcaccggcgtttggctttcatctggcacaacaccatccttcgtgtacgtgaacgtcaaatccatcacgttaccttgatatatcccgctaatttcacgttcggtcggggtataccctgaaatgatcgctgcggtttctgtaaagctgtccccctgctttcccgttgatgtcttgtccgcactcaattgatgccctgcttcatccacatagtgcactgtcaattgagccaacgtctggctttcatctacatcacgaccgttgttcacaagatggatcgtgatattatccgtatcatcaagggttagcgtgtacgcaaccgtcttattttgtccatttgccaatgaatagcccaccggtacaactgcatcgtagctaccagcatctccttcaaagccagtcaacgtcactgaatcaccaacttgaagctgacctgctttatcatcaacgtatgtgaccgtcaacgtcgccggctgattgtaaacaatcgcaactgaatcgtattgtagtgcttcccgttcttgtgcttcagtcaaggtcgaggtgccaccaaacgaaaataaaggaattgaaacaccattcatgaaagttaataccatgaattcaccagcagtggtgcccattgcggcaaccggaatcacagtctctgcggtaacggcaccatctgtgccgtaattcgtaattatgagtgaatcatcggccttattcgccgtccagacactcttttcacccgaagcaagtgatagcgtgatcgagtgtagttgtttaattgggtagccatcaacggtggcgttagcacccgtagtcgactgaccatccccaaccgataaattaatagtctgatcgggcactaacttggtaccagccgtatcacttacactaaccgtaatggccttttgaatcggtgtaacggtcgtcgtccctgccacaacaattgggttcgtaaacaggtaacctgtattggctgccgctaacttagcgagtcccaatgctgaaagtttaaccgagtaagtgccaaccttcgtagacaccaaatcagtatcaatgtcaccagaggatgcctgaatcgtataagatccatcagcgtttaacgtccagcccgccggcgcattgaaatagctgggcaactgtaccgtgtacgtacttggcgcagcagtttccatgaccattgtttgttgactaaatttgacctgattttccgacttagttacgtccactaccttgacataggtcaccgtatacgccgttcccgtcgcaacggtcgttgtactgctaatcgattgcgtgataaacgggtacgtattgtactggttgaccgaactcgttacaagctggtacacatcaccatttttggtaatctgggtaggaaccacgctactcgtggcataaatggttcctggcaagccactcgtctgtgcattccctaaattgacatttcccgttcccacaaattgatacgtatcttgactcttaacgttattaataatggtgtaggcgtacacaaacgcaccatagctatcatttaggacatacgcgtcatcgattcccagcgccgcagcaatttgtttcacacttacataagcgccggatggcacggtataggccccctgcgtgtccgcgtaattatcggtgatatacatcaccgaatcatcgttactgcccacttgtgttcccagatgtcctgttaacgttcctgcattaggatccgtaataatatttaactcaaatgcgtttgaattactaacaacctgaccaaactttaatttaaaaacttggcggccattataatcagtttcctgcgttacacttaaatcactatactcaattccatatgaagtcaaatagctgacaagttgtgctttgacggatgccgtgggatcactggcaacaaccgcgttcccatccgcatccaaatcaccaatcacaaacccagttggaatgaccaaatactcggtcaaatttgcaaatgcttgaccaataccattaccaccaaaatccggagaagcagcattagcggcattgtcactcaatattttcatttgtagcgtcaggtatgaccccacgctagcggtgaacgagctaccacgtggaattcctttgatttcaacataataattggaaggactaaacgagttagcccccgtcaccgctgcatgcaccgtcacggtcccagcctgaatattgttagcatccaatgctagctcaccattggccgcattcaaatccgtaatcgttttgtcactaaatgtcagttcataactgccattggtacttaaatcaatatcactcgtatcaaagtacgttatcggcacattataaacaatgctgttttgtcccgtattattataggcgacggtccaatcactcggtacctgatagttagtcgcgtccgtaatggtgactgtggccttcaccccgctcagcttcgacccgttattgacacttaccgtaccgatcacggcctgattattactgagaatttgataaatccccaccgtcacatcgcccgcggtgacctgataattggcattggccgcatttaatctagccaacccctgcgtggagagcgtcacccgataacggccgacgtcctgactcgtaatttgaacgtccaaatcacccgttgtcacagctaccgtataggtgccatcgccattgtcagtccagtcactcggagctaccaaatggctatcagcatccaaggtcaccacataactcgtggggtccgtgctctgatcaccatcttttttcttactccctccagtgatcactactgagccggcagaaaccgaggccttatcaatgaccaactgccccgccacaatgtcatcgctcgttaagaccacatcgggattcgctgctttaatggctgccaatccggctgctgataaggtaaccgtgtacgacccaacattttgctggatttgactcgtatcaaggtcacccgtcgactgagccaccaaatactgattcgtgacaccagttacgaaccaatcactcggggccaccatgccgttgcccagtgttacgttgtagttaaggggcgtgccagcatccccatcgtaggttttagtcgttgtgccaacggtaacggtcgtctgaacggcatccgccactgctgtaatttgttgtgcttgtccggtttgttggtaggtcgccgccgcactcgccttggccgtggcgatttgggtactggttggattgtttaatgtcgttgtgttgctcgttgccgcggatgtcgtggtggccgtgctatcgcttacggttgttgatgttgccgtgctcgtcgcgctacttgcggcgcttgtgttctcactcgttaccgcacttaaagctgtacttgaagttgcgcttgatagcgcagttgatgtctcgcttgcggcagttgtgctgctcgtcgtcagggttacttgactgccagatagttgcgcactcgtcccactggcactcgaaacagttggcgcggtgctcgttgccgcctgatcatcggcctgtgcggtacttgttcccaacacgcctaatcccagtgtcaatcctgtcattgccgcaaagagccatgttctaccagccttgtacatcttataatgttccgtcaagttcccttgaatccgcttactaaaattattctttcctaccatcataatttcctcccaacatttcaccataactcattcggacgattcccgatctttccctttttatactaaaaccaatgacttaattcatcattgtcgtttgatcctgaaacctgcgattgacttgttccaagatataggcttgcgcatcatcgtcatcccagtcgtcagcctcactggcggcctgttcttgcgcagccatataagctgtcggttgagttgtcatttgttcgtggaaaatctgattttggcggccaaattgccatccgctcagccataattgcatcaaatctgctcggtcaacgctcactgtctccagatcgaacaggtcgtcccaactcataacttgattttgctcgaacaccgcttcactaattgcatcgtccattgtcatgaattcaacgctggttgattcattcagtgctgcttgtaacgtggctcgtaggggttgtaatgcaggatcagtccccaaagcgtggttcatcccctgaacaaatacatctgccatgagattcaaacaggcatccacagacatatacttgacctcagtgatcgcttctacttggtttacttgtgcattcatattaatcaactcccgattccattttttatccagcgactgttattcccattatcaattgacatttattaataatctgtttataaaaatgttctaattgtaaaaaggcccgtcctcggccaccttgatgggctccaagcacgggtcgtcttcaaaatgcgaagtgagcagttatcgtgttcttcttaacatcttgaatatagcacagccacacgtatgaccatactttttttaaaaaaatgatcagtaattcccattttttatcactactacttaaaaaaaacgggatttcgtgggttatacgtattttccatatgacacggtttaacaacttaattatctaaaaagccaatcaaatcaaggcatcgacactattttttctgtagttaatctttcgatcaagcctgtggtaaactaaatgtataatcgtggtaaatttagggcttcactgatcatcatcacacgatcgatatgatgctcatttacaccacactcttcgggaggcttcttatgaccaattggattactggctacaacaacgaccttgcccaagccgccgcaattcccattatgaccaaaaactttcagcaggcagctgaatcgatcggctttcaggtcctcaactatactaaatttcccggaactgattcttatcctaagcgacgccaaaacttacttgatactttaatagggcaaattcaaccgggcgacacgattgtcgtgcaatttcccatgtttatcggcggcgtcattcagatggacctgatcgatcagttggtcgctaaaccagacgtcaaagtcctcgccatcattcacgatgtacctacctggatgatagccacatcggatggcgcttacgatcttcacgacaactggctcaatgccctgcgcaaagttgatggtattatcgctgcaaacaccaagggcgccgcaaaattacgagccgatggagtcacagctcccatcgtttcgttaacggtcggtgactacctgtatcacggacctctccaccccaaatgctttcaaaagaaactctactacgtgggcggtcgcaatgtcgagggactcgattaccacgccgccacgccccttaacctttacacggggcacgttagtcccgaagtagctgctaatccaagcgtcaactggcatggacggcatcccagtgatgtgattttgtcttcgctagatggtggcttcggcattgtcgtatcagataatattaaggaagaacaacagcaaaattttagatactacacacagtttaatagtcccactaaattatccttctacctcgcagccggattgccgattgtcaccatgagtcgcacaccacacgcacaatgggtgaaggaccgcggcatcgggttggtggtcgatgacctcaacgaaatcgatcaccgcttgcaacaaataaccgaatcccagtacaatgccatgttgacggcaattcaaccgtggcaaactgcgatttccaacggtttctttgttaaacgggcgctccttgcagcactgggcgctgttaacttgggcatcacccacaaacttgcaattcataattagccaaagtgaaatcaaaaaatccgttctaacaattaagttaggacggatttttttgagtttaaatacgagcattaagtgcctactcgtcaacgtcgagtcggtgcaattgcttgggttccttcatgatccagtgacccaataaggcaatgaccagaaacccgaccgccactaaacagacgccatgccagccataatggctccacgcccaggtactgcagaaggttccgagcgagccacctaaaaagtagctaaacatgaaaatggaattattacgactgctggcttcccgatcgagcgactgaacgatggcctgattggatacttggctaaactgggtccctaaatccagtagcacgattccaacaatcaaaccaactaagacttggccgaccagccagaaaataacaaaggccaacgccgaaaacagccacgacaacccgatcgtcaaccgtggcgaatacttatctaccagctgcccaataattggcgcaaataacactccggtaacacctaacaatcctaaaacaccggcgatactacttccccagtgatattggtgtgccagataaaaggccagtgtcgaccatagtacatttgaaaccccgaataaacaaagcccattcaaggccgcactttgtaagtaacgctggctgataaagaggtgtggcaacgacccaatcacactaccatagctacggtgttgatgcccccgcggatcgcgtggcatgtaccggtgtaggattccaagtagtaccagactaaagatcgccgctaacaggtaaactaattgccaagacatcaaacttcctaaaatcccactaaatgagcgtgacaacagcaccccggtcagtaagccgctgagaaccgttcctaaaacgcggccctgatgaatgccgggcgataagtacgccacgtaaggaataatgatctgtgcggccaccgacgtcaccccgatcagtccggccgccaccgtaaacacgagcacattgggcgaccaaaacgccgctagtaaggataggatcgatagccccatcatgaattgaatgaggtggtagcgatcaaaaatatcgcctaacggtacgatcaagagtaatcccaatgcgtaaccgagttgtgatagcgtagcaatcaccccgacatgtgcctttgaaatcgcaaagtggtgcgcaattaacccttcaataggctggatatagtttaaattagctacaataatcccggtcgcaattgccagcaatagcaccgtctttcgtgaaagtcccactggttgtgagtccataacgtaaaatctcctttattctgatgattgtatgacgcattgtttaatattgtacagcaatttttggctattaaacaaagaaaaagagccctttcctgatgggccttccaagttatcgctaacttgaaagttcccatcattccaggactctctttttgtacggcacttttagtgacctattttccttggtgcttgttggtccgcttcttacgacggagaccaagaacgctgagcattgctaggactgcgcccatcagtgaagcttcaccatctgggttatcactagtttgtggtaacttactttgcgtcgtacctgccgcacccttgttcgtcgctgttgctgctggaatcgatgaacttgaagtggttggcgtggtggtagcagtttgactgttagtcgtcgcacctgatgtcacagctgacatgctaccgtaacctgattgactgtgagaaccaattccggtggtagaaccacttgttggttgaccattatgatcagagtcactgccactgagtgaactactattcgaagttgaatcgcttgtcgaaccgaagttactcaatgaattgctgccttgggctgagctactgtttgaagctgagtcgctgctgaggattgaactgctatccgagatactcattgaatctgaattgctggttaagccactaccagattctgtttgtggttgaccattgttatcagagtcagaattgatgcttgagatgctatcagaatttgagccactatctgatgtcgaatcactcattgattcagatactgaatctgagtaggtcgttgacgtgctatcagatgtacttgccgaactcagtgtactgatcgagccattgtcggattgactggttgacccgaaggtactatctgaaccgttgtcggaagtactcaatgaatctgacgtgctgagcgaaccattttcagaagcattctctgaagtcgaagcactcagtgatccattatccgacgtactcattgagctttcagtactggttgacccattatcagaagtgctcaatgaatccgacgtgctggttgagccattgtcagaagtactatttgattccgaagcattcgttgaacgattatccgacgtgctttgtgaatctgaggtactcatcgacccattatccgacgtactcaatgaatctgaggtacttgccgaaccgttgtccgaggtgctcaatgaatccgaggtacttgttgacccgttgtcagaagcactcaatgaatctgacgtgctggttgagccgttggtcgaagtactgttggaatcagaagtcgtctgggtgccgtttgctgacgtgctggttgattctgaggtgctcgttgagccgttgtctgaggtgctcatcgagttcgacgtgctgatcgaaccattatctgacgtgctcattgaatctgaagtacttgtcgaaccattattcgaagcgctattcgaatctgaggtgctgatcgaagtcgtggtcgaagtggtggttgaggtactatcggatgtcgagacgctcattgaatcagttgtcgaagtgttagccgatactgatgtgctgattgagccggtcgttgagttactgtcagaaattgaagtgctggttgaaccagttgatgaatcactcgtcgaaattgaatcgcttgtcgaaccagtcgtcgagttgctatcggagatcgaagaacttgtcgagccggtcgtcgagtcattggctgaaactgaagcgctgattgagccagtcgtcgagttgctgtcagaaatcgagtcactcgtcgaatgaatatctgactgactaccagaatctgaattgctatcagatccagcatccgaattactatcagtgccactgttcgacgtgctgagtgaatctgacgtgctcgttgaaccgctatccgaagtactcaatgaatccgaggtacttgtcgagccattgtctgaggtgctcaatgaatctgacgtgctcgttgagccgttattcgaagtgctgttcgagtctgaaccactcgttgaatcactcttcacgtcactttgtgaatctgacgtactgtctgaaccactatttgaagtgcttgcagaagttgaagtactgtcggaaccaacgtggctcattgagttactgtcggaagcactatctgacccgctgttcgaatcgctggcggagtctgacgtgctcgttgagccgctggttgagttgctcaatgaatctgacgtgctgtctgaaccgcttgtcgaagtgcttgcagaagttgaagtgctatctgaaccactatttgaagtgcttgcagaatctgacgtgctgtccgaaccgctggttgacgtgctttgtgagtcagaagtacttgctgaaccagatgttgaaacgctgtttgaagcggaataactggttgagttgcttaccgacgtgctaccagaatctgaggtgctatctgaaccactcgttgaagcacttgctgagtctgacgtgctcgttgaaccattgtcagaggtactcaatgaatctgacgtgctcattgagccattagccgaagtgctgtccgaagccgaagcactcgttgagccgttatctgacgtgctcaatgaatctgatgtgcttgtcgaaccgttagtcgaagtactcaatgaatctgacgtgctcgttgaaccgttagccgatgagctatctgattctgaagcgttggtcgaacgattatccgacgtgctttgtgaatctgacgtactcatcgacccattgtcagaggtactcaatgaatctgacgtgctcgttgaaccgttatcggacccactttgtgaatctgacgtgctcgtcgaaccgttgtccgaagcactcaatgaatctgatgtgctcgttgaaccgttggtcgacgtactgttggaatcagaagtggtctgagtcccgttggctgacgtgctggtcgattctgacgtgctcgttgaaccattggtcgaagtgctgtcagaatttgaagtactatcggaaccgattgatgaagtactatcagagattgaactactatctgaaccgttagtcgaagcactcgttgaatctgaaacgctcgctgacgtggttgttgaagtcatcgctgatgtgctatcggataccgaagcactcgtcgaatcagtcgttgaggtgctgtcagatactgaggtgctcgttgaaccagttgtcgagttactatctgataccgatacgctcgttgaaccagttgttgagttactgtctgatattgacatgctcgttgaaccagtcgttgagtcactatcagaaattgaggtgctcgttgaaccagttgtcgagttgctatcagatactgatgcgctcgttgagccagttgtcgagttgctatctgatattgaagcactcgtcgagctgatatctgattgactatccgagttcgagttgctgtttgagccagcagctgagttactttcagtcccgttgttcgactggctgagtgaatcagacatgctcgttgagccactggttgatgcactcaatgagtctgacgtgctggtcgagccgctgtctgaagcactgtttgaatcagaggtactggttgacccgctggttgacgtactgtcagaagtcgaggtgctcgtggaaccgctcttcacatcgctttgtgaatctgaggtgctacctgaaccactatttgacgtgcttgcggaagtcgaagtgctgtcagaagcagcgtcgctcacggaatcactgtcagaagcactatctgaaacggtcattgagtcgctggtagaaccagaggtgctcgttgaaccacttgtcgaagtgctattcgagagtgatgtactgtcggaaccgctcgtcgaagtgcttgcggaatccgaggtactatctgaaccactcgttgagatgcttgcagaatctgacgtgctcgttgaaccgctcgttgagccactttgtgaaccagaagtactcattgagaaggcactcgttgaattacttaatgaatctgaaacactgagcgaggcactttgtgaatctgacgtgctcgttgaaccactggttgaaccgctgttagaagctgacgtgctcgttgaaccagtcgttgaggtactcaatgatgctgacgtgctcgttgagccctgtgtcgagtgactcaatgaatctgaatggctggttgagccttgagttgattcactcaaagacccagaagtactggttgaaccggtagttgaattactcaatgaaccggaagtactgcttgatcccagcgttgagatactcattgattcggatggtcgtaatgatcttccggcggcactgagcgatgttgaaacgctgatcgaaccgctcgtacttgcggaaccattgtcagaagtactatttgaagcactggtgctggttgagccgttgccagaattacttgcggagatcgaagcactgatcgaaccagtcgttgaaccacttgcagaatctgacgtgctcgttgaaccagtcgttgagttactgcttacaccagaaaggctttcagaagcggccgcgcttggtgtgtagtagaagtcgattgtatgagtttctgaatcgtatacccctgttgcggtatttggaccagaaggaactgcactacgattctggaatgtcacaccgtccacactcacatagccatagtcgtaaccggcaatttgtggtgccttcaatgtccagtcggtccctagttgaccagtcatcgtacttgtatctcggatagtgtcgtcagtaccgaggatcaagtaattaacggtgattgtgccacccatcgtgttgcctgacattgagttcgaattcatattgcttgttgaagcaatattcgaaacactcgttgaggtgctttgtgagtctgacgtgctcgttgagccagtcgttgaatcactatttgaaccaagagtgctggttgaaccagttgtcgacgtactatttgaagttgacgtactgtcagaaccgctggttgaggtactcaatgaacctgacgtactatcagagccactcgttgatgtgcttgcagaaccggaagtgctggttgaaccactcgttgagttactcaatgagatcgatgtgctgcttgaatcaaattgtgacaacgtatttgatgtcacattgctcattgaaaggctatctgatgaactgccagaatctgacgtgctgcttgaaccgttgtctgaagcgctggttgaagcagaggtacttgtcgagccattgtcagaagtacttaatgagtctgacgtgcttgctgaaccattttctgacacgttggttgacgttgaagcactcgttgaaccattgtctgatgtgctcaatgatgctgacgtactcgttgaaccatccgtagagatactattggagtctgacgtgtttgtcgaacgagtatcagaaatgctttgtgaatctgacgtgctggttgagccgttcgttgacgtactcaatgagtctgacgtgctggtcaagccattgtctgaagcactcaatgaatctgatgtgctcgtcgagccattatcagaagcactcagtgagtctgacgtgctggttgagccattcgttgacgtactgtttgattcagacgttgtctgggtgccgttcgctgatgtgctatcggattctgacgtgcttgtcgaaccgttatccgaagtactcattgaatcggaagtgctggttgaaccattgtctgatgtgctatcagattgtgagctactatctgaaccattgtcagaagcgctgtttgaatctgaagcacttgccgaggcagtcgttgaagcagttgctgacgtgctatcggatactgaatcgctcgtcgagttagttgtcgaagcactatcagatactgatgtactgattgaaccagtggttgaatcactatctgatgttgaagtactcattgaaccagtcgttgagtcgctggcagaaactgaagtgctcgttgaaccagtcgttgaagcgctgtctgatgttgaagtactgattgaaccagtcgtcgagttactatctgacgttgaagcactcgttgaactgatatctgattgactagcagagtttgagtcgctgagtgacccttcagttgagttactttcagtatcactgtttgacgtgctgagtgaatcagaggtgctcgttgagccactcgtcgaagtactcaatgaagcagaagtacttgtcgagccagtgtcagaagcactatttgagtctgaggtactcatcgaatcagttgtcgaagtactattcgaatccgaagcactcgttgacccactcttaacgctgctttgtgaatctgatgtgctggttgagccactgtctgaaacattatttgaatcagaggtgctctctgaaccactcgttgaatcactagcagagccagaggtgctcgttgagccgttcgttgagttgctcaatgagattgacgtactgtccgaaccactattcgaagtgcttgcggaatctgaggtactatccgaaccgctgtttgaatcactagcggaatccgaggtgctcgttgaaccactcgttgacgtgcttgcggaatccgaagtgctttctgaaccaagggttgaagcactgtcggaaccaacgtaggctgtcgagatactgtcagatgaactaccagaatctgaggtgctcgttgagccattattggaatcactcgttgagtctgacgtactatttgaaccgttatctgaggtgctcaatgaatctgaggtactcattgacccattgtcagatgaactattcgaagttgaagcactgcttgaaccgttatcggattcacttagtgaatctgaagtactggttgaaccattatcagattcgctcaatgaagcagatgtgctggtcgagccattgtcggaatcactgtttgaatccgaggtgttcgttgaacggttgtccgaagtactcattgaatctgaggtgctcgttgacccgttatctgaagcacttaatgaatctgacgtgcttgtcgaaccgttcgttgaagcactttgtgaatcggaagtacttgtcgaaccgttagttgaagcactcaatgaatctgacgtgcttgtcgaaccgttcgttgacgtactgtttgaatcagacgtcgtctgagtcccgttcgctgaggtgctattggattctgacgtgctcgttgagccgttatccgaagtactcattgaatcagatgtgctggttgaaccattgtctgatgtgctatcagattgtgaactactatcagaaccattgtcggaagcgctgttcgaatctgagttgctgattgaagtcgtcgtcgaagtcgtcgttgacgtactatctgatgttgaatcactcgctgaatcagtggttgaattctcatctgatgctgacgtactgatcgaaccagttgttgagttactgtcggaaatcgaagcactcgttgaaccagtggtcgagttgctatccgaaacggaatcgcttgttgaaccagtggttgaatcactatccgatacggagtcgctcgttgagccagttgtcgatgcattatcggaaactgaagcactcgttgaaccagtcgttgagttactgtcggaaaccgaagcactcgttgaacgaatatctgattgactgtcggaacctgaattactttcggaaccggcggttgagtcgctttcagtaccggcattggaatcactatttgaatcagatgtgctaatcgaaccgttggtcgaatcacttacggattctgaggtgctcgttgagccagtcgttgaatcactttgtgattctgaagtgctggttgagccattgtcggaatcactattcgaatctgaaccaaccgttgaagtgctcttcacatcactttgtgaatttgacgtgctcgtttggctattgtccgaagtactcaatgaagctgaagtacttgcctgactgttgtctgaatcgctgtttgattctgacgtgcttgtcgaaccattcgttgaatcactagcagaaccagaggtgctggttgagccgttcgttgagttgctcaatgagattgacgtactgtccgaaccactattcgaagtgcttgcggaatctgacgtgctatctgaaccgctggttgaatcactagcggaatctgacgtgctcgttgaaccgcttgttgaagtgcttgcggaatccgaagtgctttctgaaccaagggttgaagcactgtcggaaccaacgtagtttgtcgagatactgtcagatgaactgccagaatctgaggtgctcgttgagccattatcagaatcactagttgagtctgacgtgctatttgaaccgttatctgaggtgctcaatgaagctgacgtgctcattgacccattgtcagatgaactattcgaagttgaagcactgattgaaccgttatcggattcacttagtgaatctgaagtactggttgaaccattatcagattcgctcaatgaagctgacgtgcttgtcgagccgttgtcggaatcactatttgaatccgaagtgttcgttgaacggttgtccgaggtactcaatgaatctgaggtgctcgttgaaccgttatctgaagcactcaatgaatctgaagtacttgtcgagccgttattcgaagcactttgtgaatcagaggtgctcgttgaaccattatctgaagcactcaatgaatctgacgtgctggttgagccattcgttgacgtactgtttgaatcagacgtcgtctgagtcccgttcgctgaggtgctattggattctgacgtgctcgttgagccgttatccgaagtactcattgaatcagatgtgctgatcgacccattatctgatgtgctatcagattgtgaactactatcagaaccattgtcggaagcgctgttcgaatctgagttgctgattgaagtcgtcgtcgaagtcgtcgttgacgtactatctgatgttgaatcactcgctgaatcagtggttgaattctcatctgatgctgacgtactgatcgaaccagttgttgagttactgtcggaaatcgaagcactcgttgaaccagtggtcgagttgctatccgaaacggaatcgcttgttgaaccagtggttgaatcactatccgatacggagtcgctcgttgagccagttgtcgatgcattatcggaaactgaagcactcgttgaaccagtcgttgagttactgtcggaaaccgaagcactcgttgaacgaatatctgattgactgtcggaacctgaattactttcggaaccggcggttgagtcgctttcagtaccggcattggaatcactatttgaatcagatgtgctaatcgaaccgttggtcgaatcacttacggattctgaggtgctcgttgagccagtcgttgaatcactttgtgattctgaagtgctggttgagccattgtcggaatcactattcgaatctgaaccaaccgttgaagtgctcttcacatcactttgtgaatttgacgtgctcgtttggctattgtccgaagtactcaatgaagctgaagtacttgcctgactgttgtctgaatcgctgtttgattctgacgtgcttgtcgaaccattcgttgaatcactagcagaaccagaggtgctggttgagccgttcgttgagttgctcaatgagattgacgtactgtccgaaccactattcgaagtgcttgcggaatctgacgtgctatctgaaccgctggttgaatcactagcggaatctgacgtgctcgttgaaccgcttgttgaagtgcttgcggaatccgaagtgctttctgaaccaagggttgaagcactgtcggaaccaacgtagtttgtcgagatactgtcagatgaactgccagaatctgaggtgctcgttgagccattatcagaatcactagttgagtctgacgtgctatttgaaccgttatctgaggtgctcaatgaagctgacgtgctcattgacccattgtcagatgaactattcgaagttgaagcactgattgaaccgttatcggattcacttagtgaatctgaagtactggttgaaccattatcagattcgctcaatgaagctgacgtgcttgtcgagccgttgtcggaatcactatttgaatccgaagtgttcgttgaacggttgtccgaggtactcaatgaatctgaggtgctcgttgaaccgttatctgaagcactcaatgaatctgaagtacttgtcgagccgttattcgaagcactttgtgaatcagaggtgctcgttgaaccattatctgaagcactcaatgaatctgacgtgctggttgagccattcgttgacgtactgtttgaatcagacgtcgtctgagtcccgttcgctgaagtgctattggattctgacgtgctcgttgaaccgttgtccgaagtactcattgaatcagatgtgctgatcgacccattatctgacgtgctatcagattgtgaactactatcagaaccattgtctgaagcgctgttcgaatctgagttgctgattgaagtcgtcgtcgaagtcgtggttgacgtactatttgatgttgaatcactcgctgaatcagtggttgaattctcatctgatgctgatgtactgatcgaaccagttgttgagttactgtcggaaattgaagtacttgttgaaccagtggttgagttactatccgaaacggaatcgctcgttgaaccagtggttgaatcactcgtcgaaacggaatcgctcgttgagccagttgtcgaagcattatcagaaactgatgcactcgttgaaccagtcgttgagttactgtcggaaaccgaatcgctcgtcgaacgaatatctgattgactgtcggaattggaattgctttctgaaccggcggttgagtcgctttcagttccggcatttgaatcactgtttgaatcagacgtactgtttgaaccgttcgttgaatcacttacggattctgatgtgctggttgagccgttcgttgaatcactttgtgattctgatgtgctggttgagccattgtcagaatcgctattcgaatctgaaccaaccgttgaagtgctcttcacatcactttgtgaatctgacgtgctcgtttggctgttgtctgagttactcaatgatactgacgtgcttgcttggctgttatctgaatcgctgtttgattctgacgtgcttgtcgaaccagtatctgagcccgcattcgagattgaggtgctggttgagttagtgtccgatccaacaattgaatctgaggtacttgccgaagcagtatctgatgcattagctgaaatcgatgtggtttctgaacccgttgtcgaatcgcttgctgaatcggaagtactatctgaaccgttatctgaaatactcaacgaagttgaagtactatcggatccaagggttgaagcctcatcggaaccagtgtaagccgtcgagatactgtcagatgaactaccagaatctgacgtgctcgttgaaccattatctgaatcactatttgagtctgacgtgctgtttgaaccgttgtctgaggtgctcaatgaatcagaagtactcatcgatccattgtcagatgaactattcgaagttgaagcactgattgaaccgttatcagattcacttagtgaatcggaagtactggttgaaccattgtcagattcgctcaatgaagctgaagtgctggtcgagccattgtcggaatcactatttgaatccgaagtgttcgttgaacggttgtccgaggtactcaatgaatctgaagtactgtctgaaccgttatctgacgtgctcaatgaatctgaagtactgattgagccattatccgaagcgctcaatgagtctgaggtactcgttgacccgttatctgaagcactcaatgaatcagaggtgctggttgaaccattatctgaggtactcaatgaatcagacttcgtctgagtcccgttcgctgaggtgctattggattctgaggtgctcgttgacccgttatccgaggtactcattgaatcagatgtgctgatcgacccattatctgatgtgctatcagattgtgaactactatcagaaccattgtcggaagcgctgttcgaatctgagttgctaattgaagtcgtcgtcgaagttgtcgttgacgtgctatccgaaatcgagtcgctcgttgagtcagtcgtcgaattgttatccgatactgaagtactgatcgaaccagtcgttgagttactgtcggaaatcgaagcactcgttgaaccagttgtcgagtcgctatccgagatcgaatcgctggttgaaccagttgttgaatcattgtccgagacggaagcactcgctgagccagttgtcgaggcattatcggaaactgaagcactcgttgagccagtcgttgagttactgtctgagatagagtcactcgtcgaatggatatctgattgactgtcggaacctgaattactttcggaaccggcggttgagtcgctttcagtacccgcatttgaatcactgtttgaatcagacgtgctgatcgaaccattggtcgaatcacttacagattctgaggtgctgattgaatcagtcgttgaatcactttgcgattctgaggtacttgttgagccattgtcggaatcactattcgagtctgaaccaaccgttgaaatgctcttcacatcgctttgtgaagttgaagtgctcgtttggctattgtccgaaatactcaatgagtctgaagtacttgcttgactgttatccgaatcgctaagcgatactgaagtacttgtcgaaccagtatctgaacccgcattcgagattgaggtgcttgttgagttagtgtctgaaccggcagccgaatctgaggtgctatcagacttaacatctgaaacactaaccgaagtcgatgttgaatcagataaagttcctgaatttgtcaaggaagcatttgttgaatcggtcaacgattgagtctcggaattcgttaatgatgcggttgtcgaatcggtcaatgactgtgtttctgagttcgtcaatgatgccgtcgttgaatcagttagtgattgagtttccgaattcgttaacgaagccgttgtcgaatcggtcaacgattgggtttctgaatttgttaacgatgccgttgttgagtcagttaatgactgcgtttctgagtttgtcaacgaagccgttgtcgaatcagttaacgattgagtctcggaattcgttaatgaagcggttgttgaatcagtcaacgattgggtttctgaatccgttaacgaagccgttgtcgaatcagttaacgattgagtctctgaattcgtcaatgaagctgtcgttgaatcagtcagcgactgagtctctgagtttgtcaacgaagcggttgttgagtcggtcaacgattgtgtctcagaatttgttaacgaggcagttgtcgaatcagttaatgattgggtttctgagttcgtcaatgaagcggtcgttgaatcagttaacgattgtgtttctgagtttgttaacgaggcagttgtcgaatcagttaatgattgggtttcggaattcgtcaatgaagcggtcgttgaatcagtcaacgattgagtctcggaattcgttaatgaagcggttgtcgaatcagttaacgattgagtctcggagttcgtcagtgaagcggtcgtcgaatcggtcaacgattgggtctcggagttcgtcagtgaagcggttgtcgaatcagttaatgattgggtctcggaattcgtgattgaacctaaagtagaaccgtcagtcgctgataaagtttctgaatttgttaatgacgcattcgttgaatctgtcagtgactgtgtttcggagttcgtcaatgaggccgttgttgagtcagttaacgactgagtttccgagttcgttaatgaagccgtcgttgagtcagtcaatgactgagtctctgagtttgttaacgaagctgttgttgaatcagtcaatgattgagtctcagaattcgttaatgacgccgttgttgagtcagttaatgactgtgtttctgagttcgtcaacgaagcagtcgtcgagtcggttaacgattgggtctctgagtttgttaacgaggctgtcgttgagtcagtcaacgattgggtttcggagttcgtcaacgaggctgtcgttgagtcagtcaacgattgggtttcggagttcgtcaacgaggctgttgttgaatctgtcaacgattgggtctctgaatttgttaatgaagctgtcgttgagtcagtcaacgattgggtttcggagttcgtcaacgaagctgtcgtcgaatctgttaatgattgagtctctgaattcgtcaatgaggcagtcgttgaatctgtcaatgactgtgtttccgaattcgtcaacgaagcagttgttgaatctgtcaacgattgtgtttcggagttcgtcaatgaggcagtcgttgaatctgtcaatgactgtgtttccgaattcgttaacgacgcagtcgttgaatctgttaatgattgagtctcagaattcgtcaatgaggcagtcgttgaatctgttagtgattgtgtttccgaattcgttaatgaagcggtcgttgaatctgttagtgactgcgtttctgagtttgttaacgaggccgtcgtcgaatctgttaatgactgtgtttctgaattcgtcaatgaggccgtcgttgagtcagttaatgactgtgtttccgagttcgtcaatgaagccgtcgttgagtcagttaacgattgcgtttctgagttcgtcaacgaagccgttgtcgagtcagttaatgactgtgtttccgagttcgtcaacgaagcagttgtcgagtcggtcaatgactgtgtttccgagtttgtcaatgaagccgtcgttgaatctgttaatgactgtgtttccgagtttgtcaacgaagccgtcgtcgagtctgttagtgactgtgtttccgaattcgtcaacgaggctgttgtcgagtctgttaacgattgagtctccgagttcgttaatgaagccgtcgttgagtcagttaatgattgagtctcagaattcgtcaatgaggcagtcgttgaatccgttaacgactgagtctgtgaatccgtcaacgattgggtctcagaatttgttaatgaggccgttgtcgagtcggtcaatgattgagtttccgagttcgtcaacgaggccgttgttgagtcagttaacgattgagtttccgagttcgtcaacgaggccgtcgtcgaatctgttaatgactgtgtttccgagttcgtcaatgaggccgtcgttgagtcagttaacgattgagtttccgaattcgtcaacgaggccgttgtcgagtcggtcaatgattgagtttccgagttcgtcaatgaagccgttgttgagtcagttaacgactgggtttccgaattcgtcaatgaagccgttgttgagtcagttagtgactgcgtttccgaattcgtcaatgaagccgttgttgagtcagttaatgactgtgtttccgaattcgtcaatgaggccgttgttgagtcagttaatgattgagtctcagaattcgtcaatgaggccgttgttgaatctgttaatgactgagtttcagaattcgttaatgaagcggtcgttgaatcggtcaacgattgagtctctgaattcgtcaacgaagccgttgtcgaatctgttaacgactgagtctgtgaatccgtcaacgattgggtctcagaatttgttaatgaggccgttgtcgagtcggtcaatgattgagtttccgagttcgtcaacgaagccgttgtcgagtctgttaatgactgagtttccgaattcgtcaatgaagccgttgttgagtctgttaatgactgggtttccgaattcgtcaatgaggctgttgtcgagtcagttaacgattgggtttctgagttcgttaatgaagccgtcgttgagtctgttaatgattgagtctctgaattcgtcaatgaagccgttgttgagtctgttaacgactgggtttcggagtttgtcaatgaagccgttgtcgagtctgttaatgactgggtttcggagttcgtcaacgaagccgttgttgagtctgttaatgattgggtttctgaattcgttaacgaagccgtcgttgagtctgttaatgactgagtttctgaattcgtcaacgaagccgttgtcgagtctgttaacgattgagtctgtgaatctgtcaatgaggctgttgttgaatcggttaatgactgcgtctgcgaatccgtcaatgatgttgttgctgaatcagacaatgacgtagatgtcgaatcactgtttaataaactgtcagatttgtgaatcgacgttgaatcgctaccagatgcgatatcagaatcacgagccgattgcaactcagagaagatgtcactctgatgttgactagccgaatttgaagttgattctgtattgttcgagtctgatgttgagtcactgatcgattgtgtctcagagtttgttaatgaggccgtcgtcgagtcagttaatgactgagtttccgaatttgtcaacgaagctgtggttgaatccgttaatgactgcgtctccgaattcgtcaacgaggctgtggttgaatctgttaacgactgcgtctgcgaatctgtcaacgaggccgttgtcgagtcagtcaatgactgcgttgttgacgtagtcgttgaagtcgttgtcgatgtggttgttgaagttgttgtcgaagtcgtcgttgaagttgttgtcgaagtcgttgttgatgtcgtttctgatgtcgacaatgacgccgtgtctgggagaattgttaaagtcgtataatctgtgtgaattgcggaaccaacgacaatgctgacaccaatatcatatgtcccaggtgtattgttatcgatcgtaccaggataggttacctttgaggcagtacctacttgaatcgtaccatccgcaagtccggcttcaatttcatctgccgtcagcaattcaccggctgaattataaacagagccgataaatgattctggtgaaggaagtgcgtctccctgcgtaatagtctgtggcgttcccgtaatgtcagcatcatccgttatagtaagtgtgtattcctcagttcgcacacttgcatccgatgcaggttgatattccaaataaacataatatactgtgccaactttggttgtatccagcgttgtcgtcgtatagtcgacccaatcaccattaccatcaccatccgcatcaacatacacgtaaacctttaaagttccgttggcaatcgcagtagcggcatccacatcatttccattaaatgtcaatgaagtaacaaaatcggttactgcatgttgctgcccttctggaacggtcaagttttgaccttctgcggttgctgtatttccttcaacagtcacggtcgcatggccaattgctggtgtaccacttgttgtatcaaggtactgaatcacaaagttgtagcttgtttctgcagacgtatctagtgtgccgtcatacatttttgttggattaccatcgctatccgcgttccaaacaatgatattaccatcatcgatctcgttttggattgcagtttgatcagtaacaacagtcccatctgattctgtgattgaaccaatgagttgcgcagcggttggcccagctgcaccaatgttaacagttaaattatttccatcaaccgcacttttatcaagagcagcttgatcaataactgtcaaagtcgcgttctgtggttgaatttcggtagtcaccgatcctaaattagtaccactatcgtcatatagttgaccagtaatactgataaccacgtagtattgattttggtccatatcagccgtcacatttgacaagctcattgatgccccgccattggtgtacttaacattggagccggaaactgcagtaccatcggcattataccaatcgtatgatacggtaaccccagttaaatcgccaagtgagctcttaacgtccttcacttgttgagtaacacccgcatctagggtgaatgtggctgtatcaccgacattcactgtcggactgttaacccctgttccaacagtaaattccttggttcccgtcactacattaccgtcgtaatctttaccagtgaccgtaattgtagcttttcctgcacctttggcagtcaacaatcctgtatctcgatcgacggcaagaatactgctgtcatttgttgaccattgaatcgtagcgggatcaatcgtagcgttggaaggtacggggttataatcagcctgctctgttccgttattagctgtagtttgcgttgtcgcaccagaaatatcactagaaacggttagcttaccaccaaccatcaaatagtcggaatcggcagtaatttcaagtcccgttcccttaacgttcttggacgttacagttacggtggctacatctgaccaataatcactaccaagggcccaccccaaaagcgcgttagcaaccgaagaagaaattcccagtgtcagccagctcgttaaagtattattttggaatgcggttgaaactccaatttgataataatacgtagtaccggcaggttgcgtataggtgaaatctgaagtcgaagtacttgaatccactgccgtccaagacgtaccgttagtgctccgatacagcgtataggttgtctctaagcttccagaaaaaccagcagtcagtacacttgttacaacccctagtgctgatttaagtgtattgattgtcccagtagttagagttgaattaagttcaacatcagctgaacccgtggtggtatagatattttgactagccggttgttctgaaaagccggtagttaattgccaaccaaaaacagaagaaccagatcctgttggtgttcctttaccagttaccgtcgagcttgcgctgacaacggagaatgattgtgcctcacctgtaatgctataagtggcactaccaaaggccttggcagcatcaacagcaacatcggtttcagcatcatccttcacaatagtgttggtattatccttgctatacgtcatcaaataggcgtctgacgcaatgatcatcgttgtaaggctgttagcctgtaaatattgtgcaagggtattaaattgatcagtcgttaattcgttgccactatctactgcaacgaccaaacttgatccatttgattctgcagtcccaattccagtcaaacctaattcagctgtcacatccttgattgcatcggttgtggcagtatctgttgtattagttgttgtggtatcggtggttgatgtcgtggcacttgagctacctgattctgaggcactcgttgaggtgtcatctgtattagatgttgcggttgtcgaactatctgagtctgatgtgtttgaagtgctggttgacgcatcatccgtgttcgaggtagccgttgttgagctgtcagattctgacgtgttcgaagtgccactatctgacacgctggttgactgactgccactcgtcgaagttgatgttgaaccgctaattgaaccacttgttgattccgaagctgtcgaagttgagccactcgtcgactcggacgtcgaaactgccgtgttgttgttcgttgaatccgccggaatcgtggcggtattattcgccgccagtatgttgccggtatcagcctccttactcgtgctcgtggttgtactgcttgtatccgcatgacctacgattggcgctgctaatccaccaccaaatacagccgcaaaactggtaatggttgtgtaaatccaggtctttttagctttatacgttttatagtgctgactctgatcagagtacttagctttcttaatgttattttttctagacatatatttactgcccccctgtgcttaatacacgttcaagttcgattgatagtcatcattcaatttttaaaataaaataagcgtaacacgtattaacccgatatatacaaacgtgctaccgatcgttaaaatcggtaaacaccgctaaatgagaaaattatcaaaccccaagtttacttttcgcatgccggccatcaatgcacgcttcacaaagtagcgtgtactgactgccttttgccacggttcaatcgcggccaccatctcctgataatcggcaatcgtcacgtgagacaatgcttcgtcaatctcgttcagatcatgaatcaccagtcctaaatgatgttgcttcacgagctgggcgtgggcgctggaatcaggcaccacgaccggcattccggctgctaagtacattgataattcaattgggtcattatattggctattccggacttcattaggattagtcgcttccgtgatgttaacggtattaactaagccaaagccgtccgctaattctgcaattaggttatcccgcgccaatccgacaatgtgtttaacactcggattattggcgactttttcatcaacttctgtgttataaaacataatcggtgttgagccccggtaatcaagtgccgtaacggcctgatcgctgatgtaatggagctgcttacgaaattgtttttcctgtaatggccccgcatacgggtaatcccacaattgcaaggacaccattggaatatcaatttcatcctttgatagtcgtcgtgcttgtttttcgttcgccacgaccagcaaatcaaatttacgtaactgggtaaaccaaaagtcatttttgatgacattttggtcaccatcatcggcgtacaaccacgtgggaacttcatgaaccagtgcgatgaccttaatctgtttaattcgtttgaggtagtcaataaactctgcctgaaaatccagttgttcccagagtggaaattgaacaaccacgagatcccgcggctgtaccggacgtaaaattgtttcaattaagcttcgtcgtcgatccggttgctctcccaaattatcaaacggaacgtagttgagttcctgaaaccctagctcctgggcggctttggcgacgttagcactaatttgcacggttgtttgctgattttcactttccagccgtccgttaaagcgtgtaatccagttggtcattggccaccacctcccgtctcgacaatctgatcatcaaaccctaactcaaggtagcggattgcttccaatgctgcttgcttggcgaagaatccgctcgtaaccgcttcttgccaaggtcgaacattggcgaccatttggttgtaatcggcttcggtgagcttgttcatgaccttatcaatatcaccgattgagtcgatcacaatccccacgccccggtccttaatccaaccggagtgggcggtgtgcggcatcgtgatgattggtagccccgccgctaagtacaaggacaacttcatcgggttattataatgcccgtagttgttcatccccttgtagtaccccgccatcgggtaatacagcaggccaaacccaccatcgagctggctcggaatatcattgctactcatctggcccagcatcttaatgtagcttggtagttgcccctgctggttgttaggaccgatgaaattaatcggaatttgcgacttgtattcagctaccatcgccggatcaacgctggaagaaacgtagtacaactgcttcttgaaggtttgcttaggctttggtccatgatagacaaagtcactcaagcccatcccaatcttgggagtggtgaccccgcctgcttcggccatgtgacgcgccattttttcgttcgccgcaatgaccaagtcgtatttattcaacagccacaatgaggcgtcccccgaatagtctcggtcggaggcatcgtggatccaagaaataatgtcccaaaccaaggccaccgtcttcgcgtgtcgttcattctttaagtaatcgatgaactccatttcaaactgaacttcgcttgtccacagtgggtattggacgatcaccacatcccctggtaagacaacgttcaaaatggcctccaacttttcacgccggccaccggcgcccatatcattcaactcctgcgcgtataaacgtgggtaatggagtttgcgaaaaccaacttggctaattgattcggcagccatattattcgcaataatgccagattgataactggatgctgcttcattttcatcaacttttgtaacccaatatgtcatttaactatccctccccttttttacccaggttatacgcagctcctcaaataccaataactgtccttttctaaccctgaatatgtaggtgattagacccgccattccaaaaaatttgcaaattttagcctaatcatcgtaattatcgtcaagcttaacaattttatttctcatagtaaagtgcttaacagcacaattctaagcgaataatggggtttattagtttatcccacaatttgtaagctaaagtcacaaaaatcggtatttctcttaacgtcatccccacggttaaacaaaaatcccattccctgaagagacgatgttaattttcttcaattaataagtgtgccgctaattcgtcgacctgtgcgcggatctccggtgaaaaccgctcccgctggccgggaagatacttaacctgtgtaaagtgtgtgtgcgccaaagtttgccgaatatctgtcagcattttcatcacattagcatcatcgacataggcccgtactagtaatgacggctgattcgtcgctgatgggatcgccatcgtcgttcgtgatccgtagctaatctgcaaaactgccgattgctcatccatcccaatcgtctcatccgcctgcacggcgatccagccgctggtgcgatctaaccgcgccgttacctgacgggcatcctcagtcgtcttaatcatcaaatactgaaatttgatccaggtatggttgagattaacaagggccacctcgtacgacaccgccccttcgggaaagacgaacgcctttgatagggtcgttgaactgatcatcttcaatttttcaccattcacgtcgaaaaatgtgatccgtagctgaaccgcgggcgtgcgatccgccgttaacaccgccaagaccgtgtattctttgcccacctctagcaatggtaacgttggtttaatgccttgatccagataattaacccgtgaacgccacttgcacaactgcatgccgggtgaaaacatttcgttggcaaagagcacttcaccgctatctaagtattgaacggttgtgccggtaatctcgacatcgtcaaagttgtcgggccaccgggtaagatataaactacccattttgatgctccttttgtgccacttgatccgtgactacttcgtcttcctcgtcgagttcgaggtccttttggaagttacgaccgaaatcattcgccagcatattttgatactgtttcaaaaaccagctggtaatccccaacgtatcatcattatgacgcccttccagccccttatgcagcacccgagacgtcggataatgttcctttagatgattaaaaatacgctcaaacggtaaatccgtatcttgtaacatgtgggcgatgatgaacgttgttttcgaatagtcggtgtttaaaaagcgatgccaaaagtcatcatccatcgcggtcgcgctcttttcggtcagctcaccggtcaaactaataatcgtatccatcgccaggtcccaattatagggcgtaaacagtcgttgatggatggcaaggtgcccaatgctagctagcggtttcccaatcacaacaccatggggattgagcatcgtcgaataaaataacgacgcatacgttcccattgacagccccgacaagtttaactggtcggacgtaaagcctagttcatccagcttatcctgaatcacatcaacgagttgctgttctagagtgccaccccggtagaacgcgcccccgacaatccggggatcgaatacgaggataaacggcgatccaagtgaccccatcatccaccgaccttcgtaactttcctttgcccgccatcctgagaagtacacatttaatggtggtttcaagtcggcagggttaaagtagtagcctaactcttcgtgatagtgctgatcatccaccagccgttgaccgccaacgctcagaaagttttcttttgctaacgatccgttccgtaagtgaatttcgccgaccaccagccgaccactcccctttacaaacagggccacgttcaagggatagttcagaaacgccacgtcacgctgcacgtagccgttaaccaaatcagcctcgtcgaaatcccaagtttgaaaaccggcttcgttctcgtagtaaacgcggtagaaatactcgacgtccccactggtagccccaatttccgcatgcagaataattttcccagccggttgccagtgcgtattccacaagatcagccgctgataatcagtgccgtagtcaccttcaaagatatatcgagatgtcccttgacgcgtcacctcaccattaaaattagcagacaactgcgttcggctattttcaaaagtaagaccccacggatcagtcagcgtattgtcattgacgtatgccatcaatgattgcccaccgtcgctgagatccacctgctgggcccgtttcatttttagtaggtgccaccgttgttcatcagactgggaacttgcttcgtaaaaaatttgatccgccggtaatagcagtacctgatccattggaaattcatcaatcgtcgtgtcagcaaatagaaaaatggtccctgaattataaacagcttcggtcggaaacgcggacaggtcatccaatgcttgggccaaatccactccgctcaagggcaagtagtggtaagttgccaattcagcattcaagtcgcccgccttttccagtggttgcccaccaatttgaataaaattactctttctggccatgtaaaatccccctccacgattcaatcaattgatcagtgccgttcgcattaattttatcgatacttgccacaagtgcctggttccattctcggctgccttgcaagtaggtggataaactgttgaacaaggcttcgtcattttcaatcagggccccgttttcaccgtcactaaagtaaatcgacggttcccgactaataatcggaatgccggcccccacgacccgtgactgcataaagaggtcactttgcgcacggtcatcgataaagacgcgggtaaatcgcagatcctgatccaaatccggggtgtcggactggtaccggtagctgacattgtccataaaatgaaacgcatcgtcgattttcttaaaccctgccacctgttttcgggcggcttcaaaggccttttgttgtttttcgagtagcttatgttccttcttcgccgtgtagtacgtttgcagcatcgcaaacaacgtcgaactcgtgtccacttctagcacttcgttcacgaaacgcgtcactagtccttccagtattgattgatcattgaccgcttgcaaatccatgattaactgatcgtccactaacccgatgcgccaataaagacgggcctccgccaaggtgttactttcacctagattgagctctgtcacaaaggttggtaacaactcaatattttgctgaacatgggttgtcgtctccaattccattagctgccccgcctgcaacgggctatcggtcacaattgtctggccgtctaggagcgcagcatgcttactaatcgtcgctgccgtcaaccgttggtcagcctgaatattctcaaagattatccgatccggcgcctcaaagtgttgggcaaagtcgagcaaccactcattttcaatattaatgattaagtaatcctgtgttacatcgaactgccggagcgcccggtttaaaaactcggtccgcaacgccgccatcgtggggtagtttggatgatcaaacagattccgtttagccggggcaacgtgaatgccggccgagttttccgtgagtaccgtctccccgtcctggttgtaccattcagtccgaacaacctcaccattagaatctttaaactgggcaccagcaacaaatccccgatccgaataggtatccgtccgcgtgcccgtttcacttatccattgaacctgtttgacaaagccaaaccggttgaaggtcacctgaccccatagttgtggcccttggtataggcggacctgatcgcgcgtatacaccgactccgtctgagacggcagcggcacatcgtccatggtaaacgggaatccttcagtctgttggatatcttggatttgatcaaacacgtgcacaatgtgggcgccatcgtacataccatactcggcgcccaaataacgtagaaacgggactaaccgggggatcaacacctgatagtcaaaaccacccaactcaaaatttttaatcgtattaaaaacggggttccgctctaaactatcggtatctgccggcaaatcggcaatgtagtaaatcatgacgcgcgtcccctccttttaaccttcacgttaaagagcccataactatccttgtaatacagcatatcaatatcttgccggaggttatcaaagatcgatatcagcacgaacagcattgcaaaatagttcgagaggttcgtgtacatccgattgtggagccagtatcccagcaacatcggaaaaatcaccacgatagcaagaaacatgctcccaaagacggcaaaaaagattactcggcgcgtaatgtagcgttccgtggcaattcctggctgaacaccaatcacgtagtcgccactttccttcatatccttggcggtttggtccggtaccacgttaacaaatgaaaatgcaaaccccaagagatagatcacgatcccatacatccagattccctgaatcttggtcacgtcaaacaggttcatcaccgtcgtattatgatacttcaacgcctgcataatgtagatgggaaagtacataaatgtcgtcgcaaacatcagcggcattgtgcccccgattaaaatccggaaagcaaagtagccgtccttagaacggcggtcgataccgattcgttgcacatccatacgatattcggctgaatatagggcagtcgtgaggtacatgaagacgattgtaacagccagcaggatcagtaaccggtcgagatgcatcaaaatcgagccattgaccagttttaagctccccgtgatccccgtcacaattccgggaatgatcatcacaaacggtcccccaaccccaaactgagcgttgattcccgccatccaagccgcaatcattgccccagtaataaagatcaaggcggtcgttaaaaatagttgcagagaactgaacccgtgtacgatgggtttagcattgttaagaatgttaaaggtcagcggaatgacctgtaacatggcaaagacgagggtcagccagatttgcaggagccccttttggtcctgcgacatttggctcatccgatcccgcgccgctaagaaaataatcgacgtcaaaatcgagacaaccatgtaaggtcccatccccaacgaaaacagggttgggctgttaaacaccccaccagtaatcatcgagagcagtttttcggtcgtgacttgtccaccgccaacgcgaaaactcatatcaaacaagggcactggaatgctttgtcccaagctataaaccgcaattaacataaatgttacggctagccggtgtgttaaatcttggtattttttcattacgcttgtcacatcctcactatgggaaagtcatttcgagtgacccatccttattttgatcgagttccgttaaaattaaatttcgaaacattgcgagccaggcctcgttttccatccggaaaaagccgcggcgagaatcgagcgtaaactcggtaatcggcttatgctgggcggcacttcgaccagtcacaatcatttttagttgttgcaaataatccagttggtcaatccagcaggtatcaattgccttgaggatcaccacttttttgtaataggccagttgcatcgggctccggaaacgatccaaggaccgttggagtgcttcacgcgccgcggccatcagaaattgccgaacatttttcttcttgaagttcccattcaggccatccttaatgcgctggaacgaaaatcccgtgtcaatgttgttatacacgaagttcgtaatgtcgttcagttgcatcttgcgatggtcactgatgaagttatcaatgaccttctccagcgccccattaatcagagcattcagatacgcgggatcctgagcaagaacccggtttcgggcaacataaatcttttcccgctggttactcataattgcatcgtagccggtggtttctttacgcgactctaactcactattgccgacttttttttgggcgttatccatggcatgcacggccacccgctgctttaaggcgttattcggatcaagcttgcccttttccacccgcttttggccgtgttcgtagaacttacgcaggcgatctgggccgttttcgaccacgattttatcttccaatgacaccataaactggctttcacccggttccccttggcgcccagcacggcctcgtagttgattatcaattcgcttgctggtcatgcgttccgttccgacaaccagcaggccaccattttctttggcttccttactcagcttgatgtcggttccccggccagccattgaagtggccagtgtgatcgaatcagtttgaccagcctcactcacgatcagtttttcccgcggtgcggtcgacgcattcaacaggttatggggaatgcggttctccagtagtaccagcgaatatagattcgacatcgttaccgatcccgtctcaatcaagactggtcgcttagccgccatccccgcctgcaccgtcgcaagcgagtgatcgatcttagccctgttggttaagtacacctgatcgggttgatcaatccgtcgactaggtttgtttgtcggaatttcaacaactttcagattataggtttgaataaattccttttcgtccgttttggcggttcccgtcatcccagacaaaaccttaaacttgtggaacaggctttggtagctgatcatgcccagtgttttcgtttctgcggtcacgtcaacttcttctttggcctcaattgcctggtgtaacccaccattcagcttgacgccgtccatcttgcgaccgttaacttcatctagtaagacgaccttgccgtcctccaccacgtactcttgcccatttttctttagcatgttggcctgcagtgccaacactaagtgccgatactggtcaaaatactgttccgaaaaaatatcatcaatgtcaaaatattcttcaattttatccagtccctgaggggtaaaccaaaccttctttttatcctcactgaattcgtaatcgtcatcttccatgcttttgacgaaccaatcgctaatttcaaagtagttcgactgcactttaggggctcccgaaataaccagtgatgtctgggcagcgtccagcaacaccgaatcaatttcatcgacgatcacaaaattaaaccgcttgacgtattgcttgctcagctcagttcctaggttatcgaatagatagtgaaagcctaacgttgaatgggttgtataaataatgtcgttagcgtacagctgccgcttttcatcatcttcctcgacatcgaccccaattccaacgctgaggcccagccattcgtaaactgccccgatttccttgccatcccgctcgaccagatagtcattcgtggtaatcaagaaattcccccgattaccagccactgcccgggcatacattggtaaggtggccaccagcgtcttaccctcaccggtcttcatttcggcaatgttaccaaaaaacagtgcaagcccaccgagcacttgcacttcatatggtgacaggccaaggacccgccgatcagcttccatggcgaccgcaaacgttcgcggcagaagttgtgtcagggtcctaccaccggctaattcttcttgaaaaatccgggtctgatcctgcagttcttcatcggtcatttgctggtacttgggcaaaacttgatatattttttttgcaatttttcgatacttttttaacttggacataccaacttcacctttgcctaattttgacagctagtcacaactctattggccaagaaaatacttggcaatcgtgtagatttgtgaaaacaggacccaaagtgaaacgactagaattaccccgaacattgctggttgtgcgtagcgtcccagcggtgttttgggctttttcccgtattcgtgtcgtttctgttcctgatcaaatttttcatctattaattcatttaatcgcttttttgccattttaacctcaactcatttcgcgatttaactactgttaacgtagtaatttacggtagttcgttgccgtagaaaccggtccgttttgactaatcatctgccgtaatttatcatcccatactgtcttgtcgcttaagagagccgtcaaatcagcgatcaaagcgttggtcccatcgtatactaagctcttatacttaccggctttgacgtcttgatccgtcaaaataatcatgtggttctggtaagcgtagcgtaacacgttagcaaccttgccaccggcgttaatatccaaatagatatctgccttttccaactccaagtggacttcgcgaggggcaaaattaggtaggagactgaggttcggatacttatcgccctgctctagtaatttcttactcatttccgtaaaggccgccaccgtgaccttgagatctggtaaggccgtcaaaatctcatcaaggcctcgtaaatcgtcactattcgtgaggacaaaggcttgatgccggtacttcgttttccgtgcaaactcaccgatattggataagtaagtcaacttgaccttcgtatctggataacggtcgctaacaaacttcagttgtgactcgtcgctaaagataatctgcttaaaggatgtttgattctccaattcagccaccatgttgcccggcacatcatcacctaatggttcttgccagaagagcgtcgtcttttcgttgtgtaacgtatgggcgatgaacagtgggtaggataatgaattgatgacaatatccagcgcattgatcttagcctcctgcaaaaagaagacgaaaaaggccgtgatgttcgcaaaatcgtacgttttgtcctgataccgtaattcgatgatgccagaacgatgattttcggtaatcaccggttggccgtccttaaagtagcgggtcgcatactgttcgccgtccttaaagtacgttgttgcgtagcggtctcccgagatgttgtaccaatccttacgcacaactgtgtcgccgtcttccttggaaaaccaagtaacgttatcgaccacgcggtagccttcactacggaaggtaatcaaaccaacggtccgcatgccattctgaattcgagcagagttagcgccacccacaataatgtcgtaaaaggtaggcaccgcgacccggttaaaaaatagtccctgcgtatttgtttctttcaatccggtaaaaaaggtaaacggactcattgcatcctttggtagtctgccgttgtaatgcacaaatagtgacttacggggcagcttcgccgtttttaaagattgcagtaggttttcagtgttttcatcataataatcaaaaatatttactttcattgtttcgccaccctatttcgattccaatagtttctgccattttttcgccacaaccgagcctaaaaagcccttggccactttttgagctactttccgaccagaattttccaatcccttttgataaaattcaatcaatgctttatacaggtgttggtcgagttcatcaattgagctcttttcatacagaatgccactcttacccggttgtacaaattcacggtttccgtattcgacatcgaccccaataatcggtaatgattctgacgtcgcttccagtagcgacagcccaaatccttcagaagtcgaagctgaaatgtaggcgccatacttggcgtacacgcccttcatcttcttgtgccccatcagccggatgtagtcgccagcgtcgagctctttaatcagctgttccaacttttgccgttctgttccttccccatagatatccagggttagttttggcaactgtttcttagcatgcgccaccgcccgcacaataacgtccagatgcttttcaatggcgagtcgactagccgaaactagggcgtatggatcgtaatttcgtttggagaccaccttttcgacgtagcccaccggaatcgtaacgatgcgcgtcttatttggtaattgtttttccaagatttggcgttgccgttcagtggaaacaataatcgcatcaaagtattccgcatgatcgaagacgtactcatagaagttattccatacgacgtgatcaccttccgtcgtgccttcactaaagtgttccgcatggacgactgacataatgcgcgtcttaccagcatatgccggtaaaaaggcctcaatcatttccaacgcgcgatctacaatcacaacgtcgtctttttgaatctgcagcttatcgaaaaagtacatgtagaaatccagcttgccataaataacatggtcttcaataaaggtaaccgtaatttcattgtcttggtagaactgttcgaaggcgaccgttccgtctaaacgatagaatacccggcgtgtaatcttgccatcgttaaactcctgcatgttgctgagtgacgcatcatagtcgtaacattccgttagctttccctgttctaagcggtccacccggtctactaaaccattttttagcaaccagatttggtacaccagatccatgccctgaaccttgaccttcactgattttttgtcttgtgacacaatttcatacttatcaccgattgtcgctaaaaagtcatccacagtgtacgccgactcgacgattggtcgaccacttagatagctgtagatattaatcactttttctcgcggaaaattcatgagatcggtgaacaccgtgatattggtagagatataatcgagaaaaatatagtaatcatcggcgtcgatcttggcaagtaattcctgccgatacatttgtgcgtattcaaccccacttgatgcatacccaatgcccttgttaatgttataaactttcaaaatagttccccctctgtacacttaatgctaatcagcgtgcatttcataatttttttgtgttgctgttatctgataaacctcatcatgacttaaccaactgctgcttcacacccagattgagtgtttgaatggcagccatcagcgcccgcttgataaaaaatccggtcgtgaccgctcgttgccatggtgccaccgcggccaccatggcttgataatctgccgaactcatatcactcaaaagccggtcgatgtcgtttaagtcatccacaaccatccccagatggcgatccttaatgagttgggcatggggtgttcgactggtggtcaccaccggcaacccagccgcccagtaaaacgacagtttggtaggatcgttaaactgcgtgtagtatttaaaggcttcgtcatgactttcccgaatattattggccgtcacgatgccaaacccacctgatagggatgccaaaatcgcatcactcggttgaaatcccagccaccgggtactgccgttagcctgcaccgcatcactggcaacagcgctatacacgttgagcggggtggccgcgtgatagtccaatcccaagatatcgcggcctgaagcatagtaaagttccttccgaaactgcttttttcgccacgggccttgataccagtaatcgcaaataactagtgaaatcatgggaacattcaccccatcacggcgtaactgagcagcttcctgctcgttggccacgataagtaagtcaaagcgacgcaacagtgctaaccaccaatccgtttgtgcatcatacccatcgctatccacagcattcatccagctcggaatatcccgaatcacggccactttttggacgccttgacggtgaaatagttgctcaaaaaaagtctccgtaaagctgtctgtcgtaaataacggaaactgcacagccactaaatccccaggttgtacaggatcgagtaacgcgtgaactaaattctgtcgccgatccgggtacgcatccgtatattgaaaaccgacaaggttgatttcctgaaagccaatttcttgggctgctatacataaactacgagaaattaagtgtacggcatcgttagcttcctgcgcattgctcgcattaatattcgtaatccaattggtcataatctacttcctctactaaaaattggtgattattgtgcgtcgaaattcctgccataccagtcttatacatggacaaaaacgacctatgcacagcaacataacatcctgcgtacgggtcgtcttctaaaaacgaagtgagctgtctatattcttatacgtatagtttaattatatggatcacgtttgtacatataattttaaaagagaacagccaattcccgatttttgttgattgtgctgataaattttgagattaacgatgtcattcactgaaataccaccagtttactttggttttacccaatattttcctcaattatcacacacaaacctcaattggacaaagccttgacctcatttagttaaactattttttgctattttgactttcaccgctgatcctcaccagtgcgagctaatttctcgcaccatttcatccataatataactgtcttttcaattacacataattcggatttgaagtgcagcacgatcatcccatcttgatttgttcaaagatccccgccgttgtccttcattaattgatttttcaatcctaaatcaagtgtttgaatagctgccattaaagcgcgctggataaagaaccctgatgcaacggcggtttgccatggcacaatagcggccaacattcgttgataatccgtttggtctagtttcgccaacacatgatctatctcattcaaatcgtccacaactaatcctaagtgacgtttcgcaatcaatgcggcatggggtgttttactcatcgtaatcaccggtaaaccggctgctaaatataaagaaagcttagtagggttattaaagcgcgtatagtaccgccaaatttcaccacgccgttcaaccaaattgtccgtcgttacaatcccaaatcctccgtctaacgcggccatgatcgcatcactaggctgacgaccatgccagatcaaactggcattctctgtaacaggtggttcagcaacggcactaaacaggttaatgggtgtcgctgcccgatagtcaatatccaaaacatcacgtcccgttacgtagtatagtttcttttgaaacgtcttggtccgtaatggaccgcggtacaggtagtcactaagtaccatcgaaatcatgggaactgtcacaccatcacgacgtaaatgctgcgcttcatgttgattagccacaatcagtaggtcaaagcggcgcaaccaaccaagccacccatcttcttttgcattgtaactatcatcattggaagaattcatccaagttggtacgtccaccacaacggcgaccttttttactttttctaaggccatcatttggatcatgaaatcctccgaaaaccgctgggccgcatacattggaaattggaagaaaattgtatcccccggtcgaaccggagcgaggatggtatcaatcacatttaaccgtcgctctaaattaacataattaacaaaatcgaaggtcacatagtttaattcttgaaatccaagcgccattgctgccttactaaagctcctagtaattagctgaattgcaccatcggggtgccctaactcttcattattaaagcttgtaatccaatttgtcatcatcaggctcctttctgcagtagttcacagactaatttttctaattcatcaaagtggttcgaaatttaatttgataatcccaccttttccgatcttgtacatttacaaaacttaggcttgcttccatcacagctccaacctctttagttcaccaaacagttaagcccataaaacgttcacatactaccgccggatatacgtatttaatggtacagcattcaaaggtgcataatcaagatgttcacaatggatattatttaattcatgtacttatatttagtttctctttagtcgctttattttaatgacgaaaaaacggttagcaacttttgccaaccgtcatttgatacgataaccgattattttaaaccttgatgacaccattaacccattaattaaacttttttgctgttttaattttcactactaatccttaccagtgcgagctaatttctcgcaccatttcatccatgatattgacctctggatgatcgtttttgatccagttatgcacattttgaacttgaagttcagtacgatcatcctcatgatccaacagctgctcaatttgttcaagggcggccgtcattgtatgtgtgacatgaacaccccgcatcaattgctgtcctagagcagtaaatccgacctggtcgtgacgggccaatgtcacaattggtttaccctgaatttgcatttcgtacagtgacgaaacaccatccgtgaaaactaaatctgcagcttgcgttgccccatattgagatttttttgtcagtacgccggtatttggtaactgttgccattgcccaaggaaatgatgataatcttcgagcgtatacccagaaaattcaccagctttgatggttgcttctagtaaaggatgcggattgaacaaaattgatacggactgatgggtacgggcccaatcaatcatttcttgataaattcgtgggaagctgcccatattaaaccagtgattaccaatggaatggtgcgcaatccagaccatttttttcgtacaatttttcatatcgagcggccactgagccggttcatttttaatttcaattgctttcattgatcccactgattgaaatatctcactagaaataaaccccgattccaattgatactgctgttcagccgtcagtggatcagccataaaataacgccaaatataacgatagtaatcgttaaacagtagtccactatcctgtcgttgtgccgatttgatcatattctcagtgataacgtagggaatataaatcaaacgcgaccaatttaattgacgaccgccaaattcaggcggaaaatcttgttcccattccgactgccgaacgataaaatcagcctgccaaattttaagcatctcgaggacgcggacgcaatcagtgcggttcgccgcattaacgtatccaatatgatgctcatcaaaatacgcagcaatcggctcaaatgtttctaacgattcagttcctaaataatacttattggtgagtaccagcttgacctcgaaccgttgatcgtttcgggtggcattcaataatggtaacaccgcgggtagcgtctcacgactatttaaaataaaagccagccgaatcttatggtgggtccgagccccagccattgccgtttcagcttgtgcgaatgctcgattaagtgctggttgaacgccttgaccaatcgtcttttggagatcttcacgcatcattcgagcttgtgcgtcataaaatcgatcaatactgacaaccgttatccggtgttgtaccgaactattcggcaaatactggcctgaaatctggcccatctcattatcgacacgtggaaattcatctaacgtaaaatgggtggtcgcagcatgattaccattttgtaaaactaatccggtttcgtctagctgccagaaatattcattattagtagtgtaccccccaattcgcccattcgagttgaaatacatgcgcgtcgtatacgtgggcccatctacgcggccgaaggcaaaaatatgcgttgtaaaaaaattaaaccaggatttttgactaatcatgatctgtgagtcatccctttctgcaagtcagttgatatttcatcagcactcggttcattttactgatatgctatcacgaaatgagggggttcttaaagagcaacaccaaaatatattctttcattgtcaaaatcgcaacacccattacgccttcaaatagggcatcaagttctgcagtacgatgtcatacccctgtggcaacatgtggaccccgtcaaacgtcagtgccggtttaaggtccccattttgatcggtcagacctgcgttgacgttgataaatggcacttggtgcttcgcagctaattttgccaccagccggttggcctgttgcaaacgaccattggaacgatgctcgtataacgccgcatgttcctcgtgtgcttccccaaaatcagcggtggtatttaccggatagtatgccatcacgtaaattttagtttgggggaggcgtgtttgaatttgcgtcaaaatttgatcataattggccttgaactcggtctctggtacgttgaacccaatatcgttcgaaccgatattgataaagagtttgctgggctgtaagtcaaagatcaaggtctccatgtgagccaatagatcggccgtcgttgttgctcgaacaccccgattatagatatggtaatgcaatcccaaatcttgctgttgctgcagcttctcaatcggaaaaatctccattagtgatgacccgacgaaaacaatttgtcccttttgcgcagtttggttttcttgatcgtatttgtgtcgtaattggttttgaaacgccgtgatttgtggatttagattcgttaattcggttgtttgatttttcatttgtttatatatcctaacaattagcattactaactgttagttagtctacttttatttttgatgattgtcaacgcttatttagacgatctaactatctttctatctaactttttgctaaactttgcttgaggtgatatttttgacaacaacttctaacgcgaccgccatcagcgacttgattcgttcaatcagtctgacccaacggcgccaaattaaccaacgattaactgccaccagtcatattacggatcagcaggcgatgattttaagttttattggtgcccatccggggctaattcaaaagcaaattgtgacgctcacccagcggcgggccgccacggtttctgcccttttaaaaaaacttgaggatgctgagttgattacccgtaccattccagccaacaacacccggaataagcaactctttctcaccgatcagggccagcaagtggtcagcgattttactaccattcgccacgacgttcaagcgccactgacggctaagctcagtgccaaacagcaagaaaaactaattaaatacctaaatctcgcattacaggggatggaggattaacaaaaatcgctcctaagcagccgaattacgactcttaggagcgattttatcaccattcaactagtataatgctttcaattcttgcaccgttcgcgtgacatccgggctttgcataatcatcgaaataccggaaattccagcaactcccgttttgatcacatcccccgcattcattggtgtaatgccacccaccgcaacaattgggtggtggcaagcggtcacgagctcgtgaaggtaatcgaagcccatgacggggtccgcgtcatccttggagttggtgggaaaaacagggccgctaccaacataggccacaggaagctggttggcatgcgccacttcggccaacgtattgcatgaatagccgacaaacatatcatccccgactgccgcaagaacttcgtctacccggcggtctttttggcccacgtgcacgccatccgcgtgaacccgtagtgccatgtcgtagtcgtcatcaatgatgaacggtacttgatactgggtggcaaggtcgcggcactgctgcgccagtgccaaccgctcggccgccgtcagcgtcgacccagccttatcgcgaaactgaaaagccgtcacgccggcttgcagcgaagccgtgacccgtgccagatagtccgtcacatcaccgtgcacgtcctgtgttcccgcaatcagataaacttggagcatttctggtttaaacttcatcggtggccacctttcgataagcccagtggttcaacgggccatgaccatgccccacgatgatgccgtcacggatggtcgcatccacaaattgttttcccgtccgaatggcagcttccaccgtctgccccttcgccagttcggccgtaatgcaggccgacagcgtatcaccggtgccatgcgtccggaccgtatcgacacggggggcactcaaccaaaacgactgcccgtcttccagcaacacaaagtcgctgctttggtcatcactgacaaaatgaccgcccttcaccatcacgtttttcaccccaatttcttggagttttttcgctgcgacgatcatatcttcttcgttatgaatcgtcatatcggccagtttttcggcttccggaaggttcggggtcgcaactgtcgccagcggcagtaattcatcacgcaccacggtgaccgcatcctcactaaggaggggcgcgccgcccttagcaatcatgactgggtccaccgtaagcgggccaaaatcatactgtttcaagtttttaacaaccgtctttacccgggtcacgtccgccagcatccccgttttgcaggctttgatttgtaaatcgttcgccagcgccgcaaactgttcgtcaatgatcttgggatccaacgccacaaaatcatcgactcctaacgtattttgcgcggtgaccgctaccagaaccgtcgtcgcaaaaacatggcgttcctgaatcgtcttcaagtcggcctgcatgccggccccaccgccgctgtccgatcccgcgatcgaaagtgcctgagtaaattgttgttccattattctcattccacctttaacttttgttcaatttctgctcgtgtgactaaatgtaattcatccattaattggacagcaaacgttcccggccgttcctcagcgagttgctcggcaacaatttgaccggccgtcgcaaagacggcgcaggccgtttgtgctgcctcaaagtaatccgcagttacggccgcaaaggcgcccacaatactgctcagcatgtcccccgatccaacatggagttggaagagtggcgttccgttcaagacgtgcacgacccgttgtccatcactgatcacatcggttgggccgcttaaaataacgacacagtgctgcttttgcgcgcacgattgggcaatcaaatccagatcctggttgccttcacccgcatcaatgcccttcgcttgccagtcaatccccgccaacgccgcgatttccccagcattgccccgaataacatcgacttgaaaatcgctgagtagctggtttgcgacgtctagccggtattgcaccgccccgaccgccaccggatcaataatcaagggtttgtgatactgattggcgagttcacccacgcgcttaatctgcgcgatttgccccgtcgtaaaggcgccaagattcagcgcaacggccgaactcatttggaccatggcctcggcttcatcaatttcttcggacataatcggggacgccccaatggcgttaatcccattggccacgtcttggaccgtcacaaagttagaaatgttaaacacgattggattctggttacggacatcatctagtaatttagtttgcatcacaaggtctcctatcatctatgctcaattttcgaaaccaaatcgcctggccctgtacgtatcgcaaaaggagggccgcgctggattaacgttcatctggcacagtccccctactttccactttcctacgcaagtctgaacttacaggttcaaagggatcgcgttgcacaaacgcgtctcagttcttctccgaacacccctagtgtcaaatcgatttaattgtcgtcttcatggtaccgtatccaagcgatcgaggcaagcttcttttttatccgacaaatcaaccatgaaaatcgcataacgacttccaagccaagcacccattcattcgcttaagtacacactagtgacgctatttttggcaaatcgtaattaatcatttgtctgctattttgcctatgctacaataagattaaattgttcatttgggagaggtaacttattatgaaattggggatcaagttaggcgcccttgttggcgtctcggtactactactggcggggtgttcatcatcgaatgatagcaaaaaatcgtcatcaaatcattcaacttacaccgccaaaaccagtaaacgaaacactagtagtcaacaatcgaattcaacgagtagcaccactaccgcttggaattcatctaagaattcacagttagccagcttcatgcagtcatggggacagacaatggggcaaacatatacccagtatacgccaagccacaacgttaatttttacgggatgacctacccccgcgatttatcaagcaccaagctcaacatcgggggcacaaaatacacgggggcatggtcaaccgacggcaagggtaatgcgacctataacgttgttgcagtttattcggacattgaaagcattaatgaccaacctggggggcacctgtacttttttgccttccacaacgaacagccggttgtcttaatctccgagcagaccaatggtgacgtcaccacggaaggcatgcacttctcgcaaacccaaaatgctgacctcacgaaaggattcaaccagattgttgctggcacgtcttcaagtagctcacaacacagtacaagtaccccgtcttcatcaatcaaacaaattgatttccaagaagcttctgatttaatcgaaaaagggggcttcactgatttcagtgctgaaaatgctgcccaattctctgatggtagtcataaacttgctaacggcggttttgagatggacacctaccctggtgcaaaagggaaggatatcttcaccctaacaccaagcagtgacggaaccgtcaagattacagccgtgtacggcacgctagatggcgggagctttactgcattttctgaccaatcttcgtatggtccttcatcagcaaccgtaaaacgctaattacaaagttccaccaagattccttatgataaaaatcgccccaatcctgaaaatcgtgatttcaggattggggcgatttttttatctttgaacagccatagcagaaaaaatggagggctttattgcttttactttacccgtgccattagggcatccatgaaatcattggcatccccaacgtacgcataatctgatttggtaaaaatgggtgcgtccggatcggtatttaccgaaacaatcgtcttcgcattttcgattcccactaggtactgggtggcccccgagataccgaagttaatcaataaatcgggtgcaatagactggccgctttgtccaatttggctttcatgtccaaattctgcgtgatcggttaatggccgagaaacaccgaccattccgcccaaacgggccgctaatttctgcgctttttcgatcagttgcgggttatcggccccccgtcctaaggcaatcaccacactggcatcactaatgttggccgagctactgataattggtgtcggtttttccatcttaatgtgtgcttctggatgaaattcaaagtccacgttcgttacttgcgtagcagtctgcgctggttcagcctgaaatacattgggccggaccgttgccatttgtggccgccgatccgcgcaaatgatttcacacatgatgtcatcaccgtaagttggtttcacttgaaccagtgtttcaccatcaaagtagacgtctaaacagtccgccgtcaaccctgtttggagttttgcctgtaaccgtggggccacagaccgcccaaccaccgttgctggaatcagcatgctgttaggttgaacctgttccacgacctgatagaggccatccgcaatctcggtgtccgtcgctgccgcaaaccggtcgtcggctaacaccaaaatttcatcgggaccgtactgtttgaccgtcgcaacggtttggtccgcgtcgctggtcggcaatagggccaccacacgctgaccgttcgcaattgctctggccttggtaatcagttgtaaactggtcggctccaccatcgaaccgtccgtttgcacataaactgcaatcattgattgtgccattttattcaccccgctaatttcgaatccgcgccagcagttctttgactgccgttgcactgtcatcactgagttgaaccgtttgacggccctcacgttttggtgcgtacaccttttgtaccgtggttggtgaaccggcctgaccaatgcgcgttgcatctaagtcgaggtcgtgttctgtccacacgtcgattggtttttcaaaactggtttgaatgttaaccggcgtttcgtagcgtggagtgtttaattcactgcgcaccgttacaacggctggcaatgtcacttggacactttgcgttgcgccatccaatagacgttggccgtacaaggtgtgttcatcgacaaaccgcagttcttcagcaaaggtgacctggggcacgtttaagtactcggccacgatcggtccgacttggccggtatccgcatcgactgattggcgtcccagcaataccaaatccacgccaccaatttttttaattgcctgactgattggatagccggttgcgagggtatcggcgcccccaaaggcccgtgagctgaggagaatggcccgatcagcccccattgcgagaccgtcgcgcagcgaactcatgtatccgtccggccccatgctcagcaaaatgacttctccgccaagttgatctttaatccggagtgcttcttcgatcgcatttttatcaaatggattgatgaccccttcgacattatcccgtaccatattgttcgtcttgggatcgattttaaccgaatcactttttggtacctgtttaatgcagaccacaattttcatgttgttcaccccttactgattaacctgtttcagtgcaatttcaccgctcatccgttctaccgtaccttcagcaatttccatggcccgcgcatcacgaatgaggtgttcgatcggatactcgcgactatacccgtagccggccagtacttgaagcgccatatcgccgcaccggaccgccgaacgacttccgtacgattttgccatcgcggcaacttgggcatacgattgccccgtgatcttcaactgtgccgcatgctgatacagcagctccgtgttctgacgggcaatcgcgatttctgaaattttttcttgaatggtttgtaattcataaagcggggtatcgagtgctttacgctgcttcgaatagtcgaccgcaatctgtaattcgtgttccataatgcccgtgaggacggcgcccatcaaaatccgcgcgtcgtcgtgggcgttattgccaatttcgaggccttggccgatctgaccaagtaggtggtaacccggcaccttgatatgatccatcacaatctcgccgacgggtgtcccgcgtagaccaatgaagtcttcacgctttccaaatgaaaaaccaggcatatcctgatccacgacaaacacggccatttgatcatcttccgttttagccaacacacagtatacctgggcgaggccgccgttcgtgatcataattttatcgccggtaatgatccaatcatcgccactcttcacagcccgcgtagcaatcccacgcgggtttgagcccccagacgattcagtctgcgaaaaggcaaaaattcggtgggctgcactcgtgagatattcatcctttaagcgctgatcaccatactttaagagctgttccaacgtcttaaagtggccttccagtgtaactgccatgctggcattaccaatggccattaggtgaatcgccttggcaacgctgtcatagctaaagcctgctccgccatattcacgtggtagtgtcattgttaacaagccattatcaatcactttttggaataagccttgcggataatcaccctgggcgtcgatttccatatccagcggtgctagttcgttttcggtaaattcacggaccattctatgcaacattgaagccgccattttttcttggttttccattccgtgccaccccttttagtttaataattcacaatctctcaccttctattgtatattccattattatattagtcaatacatacgattagaatttttaaaaaggggtgattgacgtgggaaaactcagcccttacaatgaacgtgatctgtctggggtgccacgtgctgagaaatacccattgaacctgaagcagttaatactgacgcagggagacaacgcgctgaaccggcctcgcgacaggtacaaaataaaacgaggtgtcttactatgacctttactgaccagctccacaccgctgccatgcctgtttggcaacaaagttttcaccatccattcattaccgaaattgcagacggtacgttgcccctcgataagtttcgcttctatttgaaacaggatcggtactaccttgaacaattcggtgatctgcacgccgctatcgctcaccaaatcagcacgccggccattaagcagtttttactcgatggtgcggccgggcttcacgacggcgagacccagattcggcacaccatgttcaaggaactggccattacaccggcggaaatcaaaaccacgccgatcgcaccgaccgcttacggctacgtgacccacatggattttcagctcagccacgcttttccagctgctgcggtcgctgctttattaccgtgttactggctttacagtgaaattgggcaaaacctaaaggacgttcattcaccagtgacggtttaccaacagtttttggacagctactcggccgccgattttaacgacggtacccagcaaatgattcaaattgtcgagcaactatgtgccccgctgggcgacgaacagaaagcctacgttcaaaaagttttcctacaaagcagtacctatgagctacacttttggcagatggcctacacgaaagaacaatggcccttttagatgccgcaaaatttctgttcaggcattcgaaacaaagaatcagtgcgtcgcacccaagaaaactaggggctgtcaggtctcaatcgccaaaattattggaactcgatatttttattctacctataatgtagtaaactaagctcagacgacccatcaaagatgggtaaacattgataaatcaactaagaaaacacttacactttttggcaatttaatttcctatcgatgagtcttctggtaaactatctttaatggataaaaaaaatttggaggcgtactggatgcaaagtctaacagatacttatacattaaataacggcgtcgaaattccaatcgtcgggtttgggacgtggcagactcccgacggagatgtcgcctatcaatcagtgcaaactgcattagcggcgggctaccgccatatcgataccgctgcggcctacggtaacgaagaaagcgtcggcaaagccatcaaggaaagtgacgtcgatcgtcatgacattttcttaacgactaaactttggaacgaggatcacgggtacgaggcgactaaaaaagccttggcactctccctcaaaaagctccaaaccgactatcttgatctctacctgatccattggccgaacccgctcaccttccgtgataactgggaagaaactaacgctgaaacttggcgggcgatggaagaagcctaccgtgacggtaccgtacgggcaattgggatctctaacttccggcccagccaccttaccacgttgatgaaaaccgccacgatcacgccggcggttaaccaaaattacctcaatcccagtgacttacaaccagaggtcacacgcgtaaacgcctcatataacattttaaatgaagcctacagtcctttaggcactggcgagcttcttcaggttccaatgctccaagagctggcggcaaaatacgatcacagcgttgcccaattgatcttacggtggtcactccaacataaattcttgccactccctaaatcaactcatgcggatcgcatcaaggacaacaccaatatttttgatttcacaatcaatgatcaagacatgcaatcaattgatgaattacaaggcattacgcgcatcgctactgatccagataccgctgatttttaaccatttaaccgcgacgccctgtcgcggttttttatatttttatggcaccactatccattgaccacatgactagcaagaatgggggacaacctgtataattgactagcattgacactccagttcacacttgaaatcaggtaaataaactattatgaatactcatcaacattacgccaaatcaaagccacgtgacgtggccgttgaaattggccaacggtttccactgacgatcaaacgtctcggtattaacggtgaaggcattggctactaccaacgtaaaatctgtttcgttccctacgccctgcccggtgaagtcatcgtggctcaggtaaccgaggctaacgcccactttctccgggccaaaattcaccggctgagaaaggcgagtccccaccgcgttgaaccgcaggacccctacgcaaccgaggttggtggctttgaactcgaacacctggcctatccccaacaactcgccttcaagcgcgacttgatccggcaggccctcgacaagttcaagccgtacggttaccgtggttacacaatccatcccacgttgggaatggattttccttacgagtaccgcaataaggcgcaatttcagattcgaatgattgacggtcacgttgccgccggtctttataagactggctcccatgacctcgtcgatttaccgacctgcgccgttcaaattcccgtcaccatgaccgtcatgcgcgaaatggtgcggctcattgaagacctccaaatccccgtttacgatgaggataccaaggctgggattatcaaaaccattgccgtgcgggtcgcagatggaacgggtgaagtgcaactgacaatcatcaccaacacgcctaaactcccacacgttcaccaacttctggacgccatcgcaacgcgccttcccgaagtgacttcggtcatgcaaaacatcaatccgggaacctcaccactcatctggggtgacgaaacgatcaacctggccggcaacgatgccgtcaccgaagtcattagtggcctgaacttccggctgtccgcacgggctttcctgcagctcaatcccgaacaaacccaggttctctatgacgaaacggccaaggcccttaaaccggcccgcaccgacacattgatcgatgcctatgccggtatcggcaccattgggctttccctcgccaaccaggtcgatcaggttttggggatggaagtcattgaagatgccgtcaaggacgcccatttcaacgccgaacaaaacggcattaccaacgcccgttatgaagtcggcgctgccgaagacgtcatgccccgctggcttcacgaaggggttcaattcgatgcgttggtcgtcgatcccccacgttctggcttagatgacggcttgattaagcaaatcttacgggctcaacccgctaaattcgtctacgtttcatgtaacccatcaacgttggcgcgtgatttagtttcactcactcgcgcctacgacgtgaagtacatgcaaccagtcgatatgatgccccaaacacccaagtgcgaagtagtggttaaactcgcgcttcgtcagcgttaaaccagttaaaaaacaccgctcaagtgagatcggtgtttttttgatgcgcttgatatagttgatcctgctgtttaataaaggctcgcagcttgaaggtcgtcccatccccaaactcaccgctcgtttcgataatgtcagtgacgaggtgcttcagttgcggttttacctgcggccatagatcctcgtaggccaccatcaattgttggtgctcccgttcaaaggccgccggatccgcggccacatacttttgtgtccgcagataactatcggccacgtaatcgccaaacgttgccagtaggcgggccggtagctgcattgcgatcatgtctaggtaggcatgattcattcgcgcccacacatggagctggctcgtgaaggccccatcattttgtcgaaccgttgactgtgcgttatggagccacacataggtcacgtcgtccatgtagtaaatgcgctcggccaaatcacacgcgagaccgacaaagtaggtatcctcaaacactcggagatcatcacgccaccgcagaccaatttcgtcgataaacgcacggttgaaccacttggcgactggcgccgtccaattgtgattacggtgaaccacataccggtaaccgccccgctcgtcgtccaccaactgttctaaatacttactaatcaggatgtctcgatcaccatgaaattgaaccgcgcgaaagaaggtttccagcgcattcacattttggagctgatcgtccgcatccacgaacatgtagtaccgaccagtcgccacatccatgccggcctgccgggcgacccctgccccttggttatcagttcgttgaatcatccgcactgtaaactgtagcaccggtgctaccggtaatgtcatttgggggccaccatcattaacgagaatcacctcgacacgttgaaaatcaatcccaatttggttattgattgacgtcaacaccgtatcaaggcgttgctggctaacacgataaaatggaataataattgaaacgagtttctccaccgtggtcatctcctccatcgtttttatcattttctcacgaatccctaaaaatcgccataccacaatatgtggtgtttttattttcttttactctcaatatattgtgctataatggatattacaacgttaactacactaacagaaacggggtcatcgaatgtcatttactgcaactcaagacaacttaacacactcaatagaccaactggccgacggagccgaacacccccattcagcacgccggtctccgtccaataatcttttcaacgcccaattcttaaaaacgcacacttgtaacaagttttctgatttcggtcattttgtggcggccggatttcccgacaccgattttgaaagcatccccgatgccaaatggaatcggtggatcaagcaaaataccaactttgcgacatggaacgacatgaaaagtgccgcgttaaaggcctacatggccggacgcctgacctttcaataggccccttaggcgacccccattttgattttggccgcgttgtaccacgctccccaatagttctgtgatacaatctgggtgacctgaaaaatgattgggaggcggccacatgatcgtgattgacgaaaccaagcgttacttcgatacgattcaactgatgaaccaggctgggcagcgcgagcacggggatgtcttcacccggcggttggttatcgataatcgctggctccttttcatttctacctaccatggcggatgggaggcctcgatctcgtgtatcgatggccaccaaatgaccaaacccgaattcaatttggcagtcaaagcgctcatgtaccaccgcgtcgtcccccgctgccatcaggtgagtgccagctcgtttccccattctatcgtgatgcattttcgcgccggccattaaatcaatgacgttaaaaagcagcttgaaaaccagatcggttttcaagctgcttttgtgattaattcgttttttgcttagtagacttggtcttacccaaatactgtcgttctgctgcttggcgcgcctcgaccgcttcttcaaacgtatcaaagctcttcatcaacacgtagcggccgtgaaacatgagccgcgcaaaccagtggtccgtcttttcatcgtaggataccccgatgacaccactatggttacgtttggaccgtttaattgaggcgtaggccacacccttactgtcgtagaggttggaagaacgccccttaaacttttgcatgacggggttttcttgatactgttttttcatgacttctcgccggagacacccacagctcttcgtggtcccacggcggagttcaaacccatctacgatagcattgttgccacagtcacaatgacacaaccaccgaatattaccgttgatactatgtccctctggtcgaatagccaccagccgaccaaacctttttcctgacaaatcaattagcctcgacatgtaattcacctcaattataagtcccgtgcgtactctctttataccgaatattcttcaagtttgtacatcacaccaccagttcatcagtcgttgtcaccaagaagcggctgatgccaccaatggttgatgtacatgattaaccgttgcaattatggcttattatagtccatgtttataagggttgtacactattatacgtaaataagtcctctttttttatttttaagttgattcatcccgattatgtcgatcatcattgaacagattaagataattcgtttagaataccgcctcaatgcccccggctaatcgagttcatttttaatgcgttgaatcaatgtattacttttccctgtttttttccgaattgcatacattgactctccctgttcaagtaactgtttaatctcaaaataaactgcccgccggcgcttgtccttcacgttcgggccaaatagaatcggtcgccccttgtaaacccctcgctgcagagccaaatcaatgccttgccgttgccgttccaaaattttattgcgttcctccgacgccaaaaactttttaacttcaaccagcatggaactgagcaaccgtttaatgttttggttttcaacctcttcaaaactgggaacgtccagggcccgcagacgggcaccgcgtaacgataatttaacgattaacttcgtcgtatcatccgcatcacggctgagacgatccaaactggtcacgaccagttcatcaccttccttaattttactaataatttggtttaaaattggtcgatctaaattggcccccgatgccttttcctgataaattcgatccacctgtaaatccgtcaatattttaatttgccgtgccaaattttgatcatgggtgctcacccgtgcatagccatatttcattgttatcctcctcgtcttgtcccggtttaaaaccggcttaatcatcacgcgctgtatatcatagcgtatccgagaatataattatttctaaattatgacagaagttcaactaatacactcgcttacgcgactatctcaccactccgggtaagtaaatagtcctttcaattccaaaggctatgccaatatggtatgatgagtagacaaataaaagggggaattccacgcaatgcaagatccattcaaccgacaaaacgatccgaacaacgacgaccaagatccactttccaacctcccattgccaccgaactatgctaaggttgtcaatccggaaaacggccaaattagagcggcaaaagtcggcgtatcatggacgaccctctggttcggtcccatccccgccttaatgcgcggtgattggtataatttcgccctcatgatcgttttagacatgatctatttcatgggtgtttcgatgttaggcttacagattaccatgcccattccggccatcatttttggcttaatttataacctcatgtacttccgtcacctctttacgctcgggtaccaacccgcagatgaccggtcgaaggaattactcaccatgtggaagtattggaaagaataatgaacgcatacaaaaacacaatgacggtttcgtcattgtgtttttgtatctactaccaccaactcataatggggccgaccatataaagaccaaatatcatcacgatccagcaaagaacggtgaccagccacttataccacccatgcatccgatattgttcgggcaagacacgggcttccaaaagcagcaaaaagcctaatacgattggcaacaacaaggcgttcatgacctccacggccaccgcaatgttcaccaaatcaaagtttgccagtaccagcacggcaccaatcacgtgggccagtgtgtacatgatgtaaaagcccgcatttttccgattcaagggctcgttcaggctgtgcttccaattcaaaacttccgtaatgccccaggtgccggctagtgccaccacgagagcagccaccagagcaccaccgagcatactagccccgatcaaaaccttagccggcatacttccgatgaacggtgacaaggcgtgtgccaggtcgcccaccgtgctcagaacttgtggatgatcggcatggccgaccgttgctgcaaaggcaatcacaaagatcaacatgatgccttgcgtcatcagcgtcccgacaaacgtatcatggcgctctttaggaagcgcactgggctgcagatgtttatctaccactgcaccttgctgataaaaaatcatccaaggcatgatgaccgccccaacattggcggccactaaatatatgtacgatgaatgtcgccagggaatggtgactaatccctgagccatctgggtaaaacttggtcgaatcatcacgaccgcgataataaaggcgagttccgcgagaccaatcaccacaccaattttttcaactcggtgatagctcccgctaaacgcaatgccaaccagtagcaccgtcgcaatcggaatggtaatccacttcgaaataccaaatagttcaccaacaccggccaccccgacgaactcggttaatagggctccgacggccgaaattgccaacgttccagcagaaagccaggcccatccaaccccaaaatgttcacgaatcaactcaccatgtcccttatgcgttacaattccgagccgcacggtcatctcctgagccatgtataggattggaatcaacagcagctgtgggagaatcatggtgtacccccactgcgttccagactgggctgccgtaatcaggcacccagcgtccgtatcagcaagcataacaatcaatcctgggccccagaccttcaaccagtgcgtgtgcgtggcggtcatttttgctggacgtgtcgggccatgccacatccagccacttttagtgtcaacctgtttcattttcatcactccaattcttttgggacaccgttgctcattatagtagcagattttctgcgtcttgaaacccatgatctggattaaatttaaaattatattccatttttatataagaatcctaaatttgactaaaaaaaaatcatctcatggccgctattgtgcccgagatgatttttttatggttacccctttgccagccacttagttggatcggcacgccactgtttaagtgatgccaagtccgcgtcagtgatatcgccgttttgcttggcgacgtcaatcagcgttgaatagttggtcacggtgtgaaaactaatttgttcgtcggtaaagttcttggttgcagccgctaattcatatgagaataccgcgacgacccccattacttctgcaccggctgcctgaacggcatggacggctttcaaaacactgccgcccgttgataagagatcgtcaatgacgaccactttttgccgtggttgcaggaccccttcgatttgcttgccttggccatgatccttgggttttgaacggacgtagaccattggcaaatccatctgctgggccacccaagcagcatgcggaatgccggcggtggcagttccggcgatgacattaacctcaccatagtaatgtttgatcaagtcggtcatgccgtcgtagatgcctttacgcacactagggtacgaaatcgtgagccggttatcacaatagattgggcttttgagaccacttgcccaggtaaatgggtcgttaggccgtaacgtcacggcgttaattgagagtaagtcttgtgctacagattgtgctgcgttcattaatttgcctccataaatgcgcgttgaattgcttgatatgcggccgctgggtcggcattttgcgtaatgggccgtcccaccacgatcccgttactgccgagttcacgagcctgagccggggtaacaactcgtttttgatcgtcatcatggttaatttccggacgaatcccgggtgtaatgcaccagaaatcatcgcccaccacctgtcgaatggcggggagttcctgcgcggaacagatcacgccatccaaaccacactggtcggccagctgcgcatagttttggacggactcgatcaacgacaacgcaacgtgttgttcatcgcgcaaaatggtttcgtcgatggatgtcagttgggtaatcgccaatagtttaggtgctggtaatccggccgcttgtgctcccgcatccaggccggccttaccagcctttagcatctcactgccaccggcggcgtgaatcgtcgtaaaggccactcctaggcgaccaatggcagtcattgcacgtttaaccgtattgggaatatcgtataatttcaaatcgagaaagacgtcaaatccacggtcttgaaccgtcttaacaatttctggaccgaaatgataaaacagttccatccccactttgataaacggcttgggtgtcaccgttaattgatcgagcagcgccaccgcgtcttctttagtggccacatcaagcgccacaaatggtgttaatcgtttcaaaattgtccctcccacaaatccgttaaccgatcgacatggtaataatccatgaccgttggcaggtccgcaataattttaggacaggccaggggatcatggaagctcgccgcgccgacttcaaccgcgttagcgccggccatcataaattcaaggacatcttcggccgtcgtcacgccaccaacgccgataatcggtagttgactcacgcttcgtacctgatgaatcatgtggagcgccattggcttcagtgctggaccggataagcctcccgtaacgtgggccagttggggttgccgtgttttcaggtcaatccccagaccggttaacgtgttgatcatcgtcaatccttgcgcgcccccgcgttcagcggcttgggcaattgggacgatatcggtgatgttcggcgtcagcttaatgtacagcggtaccgtagccacggcctcacattttttcactaaccgttcaaccgtttccggatcagtgcccatcgcgaggcccccgtgatcaacgttgggacatgacacgttgacttcgatggcactcacaaacggagaagcggataatttttgcaccacatgaacgtattcatcctcgctaaaaccagcggcactcgcaattgctggtaattgcggataatgttcgccaagccagggcagtttttcatcaacgacggcgtctacccccacgttttgtaacccattggcattcatccaaccggcagtcgtttccgcaacccgtggtttgggattgccttctcggggggccttggtggttgatttaagcaccagggatcctaagacgttcagatcatagcgttctgctaactcctgaccataccagcacgtgccactggctgggatcacgggattcttcaggtcgaggcctggtaatttaactgctaagcgctctgcattcatgatggtgcctcctcgtttattttaaaaccgtttttaaagtgcttctagtgcgtaagcgcggtcctcgagcatcgttaagatcgccgataccgtatcaagcgccgtcatcaataatacttcatgactaatggccatcgcccgcatccgggcgccgtcttgctgcccattttcagtatcgtcaaccgtgttgaccacgagcgatacccgcttattaaccagtaggtccataatttcatcgtcgctaccatcggataacttagccacccgcttcatgactggcacaccgtgttgttcgaagaagtcggccgtcccctgcgtcgcataaatgctgaaaccaaggttcgtcaaccgtcgggcaacttccgtggccttcggcttttgttcgtctctaatcgtcatcaagattgatccatgatcaggaatctcatagccgctcgcgatgaaggccttattgagggccttcggtagactcacgtcgcttcccatgacttcaccggtcgacttcatttcaggccccagcaaactatccacatcattcaacttgctgaatgagaagatgggtgccttgacgtgaatcatcttatcagcgggagcgaggccatccgtgtagcccttatcagccagcttttgtcccataatcacttcggttgccaactgggtcattggaatttttgtgaccttgctcaagaacggcaccgtccggctggcccgggggttcacttcgatcacgtaggccgtcccctcatgaatgacgaattggacgttcatcaatccgatacacttcagggaatgggctaattgaatcgtttgggtttcaatctgggaaatcacatcatcagaaagggtttgtgaggggtagacagccatcgaatcaccagagtgaataccggccccttcaatgtgttccatgatgccggggatcaagacggtggtgccgtcacagatcgcatcgacttcacattcttttccttgcaggtagctatcgattaatacggggtgttcgtgtgacaccttaatcgcgttcgtcatgtagtggtgtaattgttcccgattatgcacaatctgcattgcccgaccacccagcacgtagcttggccgtaccaacacgggatagccaatctcttcagcagcctcgagggctcgtgcattcgtgaaggccgtctggcccacgggttgaggaatgcgtaaatcagtcactactttgttgaattcatcccggtcttccgcacggttaacgtctttaacctgagtgccgagaattttcactccccgatcagccaagggtttagcaaggttaatcgccgtttgaccaccgaattgaacgacaacgcccaacggcttttcgaggtcgatcacattcatgacgtcttctaacgttaatggttcaaagtagagcttgtcagaaattgaaaaatcagtcgacacagtttccgggttgttattcataataattgcacggtagccggcatccttcagtgtttgaacacagtgcacagttgcgtaatcaaattcaattccttgaccaatccggatgggtccagcgccgataactaacacagttggttgatcgaatggggtactttcgttttcatcttcatatgtgctgtagaagtatggcgtgtgggcgtcaaattcgccggcacaggtatccaccatcttgtacgttggcacaatgtcgttagcaagtcgttggtgccgaatctgatcggcgttcgtttgccagagatcagctagtacagcatccgcgaagccattttgctttgccaatttcaaggtggcggcatcgttttgatgggccacaatttcagttgtcatttcgaggatgtgaaccaacttgtctaagaagaagaagtcgatcttcgtcaattcgtgaacttcttccacaccccaaccacgcttgagtgcttggtaaaccgcgaagagacgatcgtcagtggcggccaccagcaagtcagccaattcttcgtcagacttatccgccatttcagccatatcgagtgtttgggtcccgatttccaacgaccgcactgccttttgcgtcgcttcttcaatattgcgaccaatggccatcacttctccggtcgccttcatttgggttcccagatgccgatcggcctggttgaacttatcaaatggccagcgtggaatcttgcagacaacgtagtcaagcatcggttcgaacattgcaaacgtcgtcttggtgacgggattttcgatttcgtctaaggtcaagcccaccgcaatcttagcggctaacttagcgattggatacccagttgccttggaagccagcgcagatgaccgactcacacgaggattcacttcgataatgtaatattggaaactcttgggatcaagggctagttgaacgttacagcccccctcaatcttcaaggccgaaatgaggcgtaaggcaacgtcacgcagcatttggtattcgcggtcagatagtgtttgcgtgggagcgtacacgattgaatctccggtatgaatccccacgggatcgaagttttccattgaacaaacaaccatcgtgttatcgttgcaatcacgcatcacttcaaattcgatttccttgtagccggcaatgctttgctcaatcagcacctgcgtaattggggacaaagccaagccattgctacaaatttcgtctaattcttcttcgttatccgcaatcccaccaccggtaccaccgagggtgtaagcggggcggataatgactggaaacccaatttttgcggtaaattcttgggcctcttcgagcgtgttaaccgtcttggattgtggtacaggctcgccaaggtcttgcatgagttccttaaactgttcccgatcttcagcttgattaatggattttaggctagttcctaagagttgcacgttgtactgttccaagaccccttgctcatcaagggctttagccatgtttaggccggtttgaccaccgaccgttggcaagatggcatccggccgttctttgcgaatcacacgagccacaaattcagcagtaatgggttcaatataaacctgatccgcaatctcttggtccgtcatgatcgtcgctgggttagagttaatgaggaccacttcgtaaccctcttctttcagtgcgagacaggcttgtgagccagaataatcaaattcggccgcttgactaataatgatgggaccggagccgattactaaaattttatgaatatcttcgcgtttaggcattttcttctaactccctttgacgttgattgctagcaataatttccaaaaagtcatcgaagaggtgacttgcatcgtgtggacccggcgcagcatctggatgaaactggacggaaaaggctgggtaattcttatgtcgtaagccttccaccgtttggtcattaatttcttgatgggtaattaagagatcggtattttcaatcgaagcggcatccacggcgtacccatggttttgtgaggtaaagtcgatgcgcttcgtggcaatttcttccaccggatggttaaaaccccggtgaccaaatttcattttgaaggtgtcggccccgttggcgagcgcaaacaactgatggccaaggcaaattccaaagaccggtacttgttgttccacttcgcgaatcattggcaacgcatgtggcacgtttttgggatcgccagggccgttgctgagcagtaccccgtctggttgatagttaagcacttgctgggccgtagcggttgatggtaagaccgtgacgttgcattcgcgcttggcgagttcgcggaggatactgtgcttcaaaccaaagtccacgaccacaatgcggtaaccagtcgctgggttgggataggcattcttagtgctgctttgggccaccacctgcttgagcttttcagttagcccgtcaattaatacagccgcgtcggcgacgtgatccacgatggccgcgcggatcgccccctggtgtcgaattttcttagttaatgatcgggtatcgatcccctgaataccggggatttcgtgttgtttcaaaaagtcatcgaggctgagacggttgcgccagttgctggccttgcgtgcaagttcgtgaacgaccactccggccgtcgttggcgcaacagattcgtcatcgtcaaagttgatgccatagttcccgattaacgggtaggtaaacattaaaatttcaccgttataagattggtcggtaattgattcttggtagccggtcatccccgtattaaaaactaattcaccggcagtggttacatccccgccaaatgcttgtccttcataaacggtgccatcttgaagcaccagataccttgctttactcatttgtacccctccgatacacaacttgtccatccaccatggtgaggacggttaatccattcacgtgatctcccacaaagggtgaattgtgacccttcgagaagaagttttcttcatcaattacaaaatcagtcgttaaatcaaataccgcaatatcagcggcgtccccaactcgcagttgaccagcgtcatcgaggttaaaaatttgaattggattgatgctcatccagtccactagttgttgtaacgtccaaatgccgctcttcacaaacttcgtgtacagtaaggcaaaggccgtttctgatccgacgatgccatttggtgagttcaagaacccatgctgcttttcctcgtccgtgtgcggtgcatgatctgtcgcaatgatatcgatcgtgccatccatcaaccctgcaatgcaggcctgacgatcggtcacttcgcgcagtggcggattcatcttaaattggggatcgtcttccttgatatcatcttcatctagtaataagtggtgtggggtgacctcacaggtaacgttcacaccatgtcgcttagcctggcgcaccaattcaacactttcggtggttgagacgtggcagacatggtagtgcacgccagtttcctgcgcgataatcaagttacgcgcaatttgtgcggtttcactgatgtctggtaaaccaggaaggcccagtcgttctgatacatcaccacagttgatcacaccaccaaaggagagttgctcatcttgcgcatgatcacacagtggcaagcctaacttagccagttgcttcatcgcatcgaatacgacggccgcgtcttgaatgcctgaaccgtcatcactaaagacctgtgcaccggcttcatgaagcgccgcaaagtcgattgcttgatgtccggcgcgtccctgtgtcaccggcgcgtactgtttgatcttcacaattccggcttcattgcgttgttcctgagcatgaaacttttctggggtatcgcaggtcggattaatattcgccattgcgccgatcatggtaaagccaccgtgagctgctgccttcgcccccgtcacaatggtttctttattggtataaccgggttcacgcaaatgaacgtgcatgtcgacaaggccgggcgttatgagcgccccgtgcaaatcaattacttgatcagcatcggtttcgatttgaccctgtttatcttgaatgacaccattatcgattaagatatcttgtgtaatgagttggtgatgatcaatcacttgaccattttttaataggattgacattgatttctccttatagagctttccgatagcgtagaatgcggctcaaaatggccatccgaacaaacaccccattttccatctgggtaaaaatacgtgatttaggactctctaccaagtcactatcgatttccacaccgcgattaacgggggctgggtgaatgataatggccttttccttcatctggtcgtaacgggcctttgtcaggccgtagcgttcgtgataatcaccagtatcgacttcaatatcagcgccgagacgttcgttttgaatccgcaagaggttaacaacgtccatttgggggagcaggtcgtctaattcgccgtattcaccatactgggtgaaggcgtcatcgaaccactgcttaggacccgcaaagtaaaccttggcaccgagacgtgtcaacatttgggcattagaacgggcaactcgtgaatggctgatgtcgccgacgatcaggacctttaagtcgtgaaagcaatggaactgttccgcaatggtcatcatgtccagcagacattgtgaggggtgctggccactgccgtcaccggcattaacgatgccgatattcaaatgatgattttttaatagatcacggtagtagttattctctgagtggcgaataaccgcaatgtcgactccaattgattcaatcgtcttgagcgtatcgtacaagctctcccctttattaacagaacttgtttgagcattaaagttaataatcttcatgcctaatttaagctgtgccatttgaaagcttgattttgtccgggttgaatcttcaaagaagagattcatagcgtatgccggccgtttcagttcgacagtcttaccagccttataggcttgtgcctcatgaatgaggtctagggcgtcctcggcgtcgagttgatcgattgttacaagattgggttgaatccgttccgttatcatcattgtgatcgtcctttctaaatgccaaacaaaaaagtgcagttttaatcatttcctgattaaaactgcacttgtattgttcaatgcatccactacaccgcatcaaacgctactgtaccgttttgtatctctcaggaaacaattaaatggttcagtgattattttattttttcaattgtgacgtcctcgtgaccatcatattcttccatggcaacttgaacttgttcgtccattgcagtaggaatgttcttccccacaaaatcaggacggattggtaattcgcggtgaccgcgatcgactaatacagctaaggagattttcttaggacgaccaatgtccattaaagcatcgagggcagcgcgaactgtccgaccagtaaagagcacgtcgtcaaccaagattacatgcttatcattaatatcaacattaatattggcagcagaaacttccggttcgcgatggtaatcgggaacatgacggtcgtctcgataaagtgtaatatctaattctccaactggaatttcaatttgttctaattgcttgagccgtttagctaaacgcttagcaatgaaaattccacgcgtcttaatgccgacaaaaaccaggtcatcaacacccttattttgttcgataatttcataggtaatccgtgttaatgctctttgcatgcttgatccgtcaacaacttcgtgtgccaccaatctcactccttctttattaatacaaaagacctcttaatctcgtactgcgactaagaggtcttcaaaatatttcctaaatattctccgaatccttcttagcctcgctggactatcttaaaggttgctcattaggtgtaatgatagttgaaaccgacagggttgtcaatcacgaattttagagcgtcttcattcgttggggtgacaccacaaattaaggtctatcgtcataacttgatttttaccattataggttgtaatctgcccgttgaagcgcaaccagcagattatgatccgcgtcttccaggtaagaaactggcgaactttgtaaaattgacatcaaatgtctcactcatccatcaagctgagtacgtcaacccactcacgaaaattcatcataatcactgctgttaaatattagccaagtaattgaaaaacagcttatttcagtgcaatataggaattaattagtcagaaagcgggcgaacacatgcaggtttattatcttcagccagtcgaaacggttcaaaaacacacgaacgcatcggggcctggcgccattcccaaattacaagcagatttacagaagtatttcacagaaattaacgttaaaatattaccaatatatacttttcgatgggacgatgaacccgaacaaagtgtcagtgtgagaacggacggcctactcggtggcctccaacaagatgatattttactaatcgccacccctactttctatatctccgaacgctatctcaatacaatcattgaccatgctaagcatgtgtttggtgtcaaagtagtcggcatcacattcgatttgctgtcatttcgacatgagctacgtttcgcacaggaacaccattttagcgacttttttatggatgggtctcggcgtgaaaaggactttcttgcccagtgcgatgccattatcacacagtctaatgaaatggctcaggctatgatcgataattttgctatcacgagccccattattgttcatggaccttggggattctatacagaaaaggttcccgcaccacagtctaaaaccaatacgctgttatttgcagggagccctggcaaggccggttatctcaatcagttgagtcatcatattcaaaccgatttcaacattatctcagacttcgcccataccgttgccaacatcgaggccccgaactttgacgcacgttggacgatgcacgatgtcgctcctaacatccatatcaccggtcaccaatacgacgctagctacgttgaccaaatgctgtcaggaagttttggcttaatttgggattcgttgacgtatccacaagtcactggtgcgtttggtaagtacatgcaactcgccatgcctcataaattttcaatgtacacggtagccggtattccaagcattgtgtggtccaaatcgtgccttgcaccacttgtgacacaaaagaaaattggctgggtgatcgatgatttaactgaattggatcagttgattagtgacattactccagataagtacggcgatcgggtttaccgtttagatgaattttcaaacctcattcggagtggtttctacactaaaagagccatttttaacgtaattggtgctctatacgatcatcagtatgttcaaccaagcgctgatctgcacctcaccgttggatatcaatagaattagcataatcgatttagaatagcatgagagtcttacaataactagcccatgtacgcgggacgtaaggctcttttattttgaattaaaatacgcgtcagttcatcgttagtggccccaagactagagaaatttatgaatttggtaataacccagatctacgttcagtaaactaccatgtcatttacgcgttaatggaacacaataaaaaaaccgctagtcttccgactaacggttatcgtgcatggcgacgtcctaccctcgcagggagcgatcccccaactactctcggcgcttagaagcttgacttctgtgttcggcatgggaacaggtatatccttctagccatcatcaccacactagcacttacgtgctgagaacttgcgctctcaaaactaaataatatctactctttttcttaacagccttcaccgctacttggttaagtcctcgaccgattagtattggtccgctccatgcatcactgcacttccattccacaaacctatctaccgcatcatctctgaggggtgtactcttcccgaaggaagatgggaatctcatctcgaggcgagtttcacacttagatgctttacagcgtttttctcatcatacgtagctacccagctatgctcctggcggaacaactggtacaccagcggtatgtccatcccggtcctctcgtactaggacagctcctctcaaatttcctgcgcccgcgacggggaaggaccgaactgtctcaacgacgttctgaacccagctcgcgtaccgttaatgggcgaacagcccaaccttgggaccgactacagccccaggatgcgatgagccgacatcgaggtgcacaaaaactccccgtcgatgtggacttgggggagataagctgttatccccagggtagctttatccgttgagcgatggcccttccataccgtacaccgtgatcacgaagcccgatttcgtccctgtcgaacctgtttcgcgagtcaagctcccttgtgctttacacctgcgaatgattcaaccattctgagggaacacttgggcgcctccgttactttttagaggacgaccgcccagtcaactgcctacctgacacggtctccaccacgatgagtggggcgggttagagtggtcatacagcgagggtagtatcccataatgcctcgcgccgaaactagcgtcccggcctctacggcttctacctattctgtacaagcggtacaaacactcaatatcaagcacagtaaagctccatggggttttccgtttcctgtcgcgggtaacctgcttcttcacaggtatataatttcaccgagtcctctcgttgagacagtgccagattcgttacgccctttcgtggggtcggaaaacacccgacaaggattcgctaccttagacgttattagtggcggccgtttacgggctcaatctgagcttcgccgaagctaaccatcttgaaccttcgccgcggacaggcgtccagccctttatactcatgcttacgatttgcgttacagaaacctgtgttttgagtaaacagtcgcccgggctttcactgcggctgcactgatgcagcaccttcatccggaagttacaggggtcattttgccgagtttccttaacgagagttcactcgctcaccttaggtagtctctcgcgactacctgtgtcggtttgcggtacgggcagttaactagttcactagaagcttttctcgcgcatgtgtgacatcggcaacttcgtacttaaatttcgctccatcacaagtgccgtatagattaagcattcactctacatcaagacgtgcgctggcagacatatcaacagtcgtggtttgtattagccatgcgtccctccatcgttccaaaaacagttaaactgttacaggaatatcaacctgttatcccatcgtctacgccttcgagcctcaacttaggtcacgaccctaccgggaggacgagccttccccgagaaaccttagttcattcggtgtgacaagagtcatcacttgtctttcgcactacataccggatttcacttctacagcgctccacagcctccacggctttgactcattgcccgttagaacgcttctctatctaccatccttacgggagtccacagtttcggtaatatgcttaccccgacggtacattgtcggcgcaggatcatccgactagtgagctattcgccactctttaaatgatggcgctctgagccaaacatcctgttgtctaaagcaatcctccacatagcttttccacttacgcgatattttggggacgcgacttacactgggatttctgggcggttcccttttgacgcggatcttgatcactcaccggctgactccccggacatataa

SEQ ID NO: 426 - DNA, 843395 bp, Unknown
  Metagenome-assembled genome
tggggactttctggggacaaactagcacaaatatagaggttctaagagccacataaaaataaagattcctattataccgcgcgtagtttaattttaaattctttctattttttacataatctttacattagtatgggtataatagcagtaacgtttaactggatcatactgtaataatggagggtgtctcaatggacggattattttcggatgaattaaaaaagctaaagtggcactttattgaaatgggaattaacgtcagtgaacagatctatcaagcaacgaaggcgtttattgaccacgataaggagctcgcacaacatgtcatagaacaagatcaaactactaatgaagaagaaactgggttggaagttcaggcgttgaatttaatggcgctacagcagcctgtggcggatgattttcgttcaattattagtattttaaaggccagttcagatttggaacgaatcggcgatcatgccgttaatattgcacgcgaaacgattcgcgttagtggtagtcaacgggttgtgggaattgaaaatgcgattgctgagatgacggcttcggttcggagcatgctagaaaaagtattggatgcgtatgcccaagcagatgaaaaagtcgcgcgtgaaggagctgccgctgatttggaagtcgataaacagtatattttagtacgcgacagcatcaccgccgcaatgcggcaggatgctaaaacgattacggctagttctagttacctcatggtatcacggttattagagcgggttggtgatcacattgttaacttgtcagaatggattgtttatagtcgaaccggggaattagttgagcttaacccgggtaaatcagatccagaaatgttgcatacattattgaataactcggaacaagagctgaatcaataggttacaaagaactactcagatgatctcaagtggtgtggtatcaatagatgaaagtttagggaccgaacagaaatttactttttgttcagtccctttttttgtggatgcacggtcaaaatcgtgggcttagtggcggaaaaatgatttacatcttttttacataaatatgactggatatttacgttcgttgtttatattaagaatgtaccaagttcagacaaccagtaatcatttgaaagggagatcagaatgatgaataagaagagattttttgcaacagttgcagcgttgggagtcgtaacgattggtttagcggcatgtggtaatggtggtgggagtgctagcagtagtagttcctcatcgtcagccaagatcacggcggttggctcaaccgcactacaaccattagttgaaaaggctgcatctaattatcaatctcagaacaaaggcgtcaacatttccgttcaaggcggcggatcggggacaggattaagccaagtccaagagggatccgttcaaattggtaattctgatatttttgcttcacaacaaagtggtattaaagcaagtaagttagttgaccacaaagttgccgttgttggaatgaccccggtcgttaacaaggacgttggtgttaagaatgtgtcgatggaccagctaaaacaaatttttacaggcaagattaccaactggaaacaattaggtggtaaaaacgaaaaaattacggtcgttaaccgggctaaaggtagtggaacccgtgccacgtttgaagcagccgttttaaatggtgaaacggccgtcaaatctcaagaacaagattctaacggaacggttcaaaagattgtctcaacaaccccaggcgcaattagttacttagctttctcatacgttaacgattcgcttcaagcactttcaattgacaatgtgaaaccaaccgatgcgaatgtagaaacaaatgactggaaaatttggtcatatgaacatatgtataccaagggtcaaccaaataaagcaaccaaagaatttctagcctatattgacgcgaagaaacagcaaaatgggttagtgaaaaaaatgggttatattagcattcacgatatgaaggtatctaaggatgcgaataacaatgttaccgataataagaattaagaaatagctgcaataccccaaaacggcaagctctaggagggttacgatggataaagataatattcaagtgcgtttgatgaaatcatctaaagcgacacgcgaagattatttcggaaaaacaatttgttacgtatgtattggccttatcacagtattggtcggctgcattttgtactttattacttcacgtggaattgccacttttacacagaaccatgttaagctggggcaatttttatcgggtacaaattggaatccggggatgcttgatagtcacggaaatccagaagttggcgcgttaccaatgattgtcacatcatttggtgtcacaattttagcagcgcttgtagccacaccgttcgcgatcggcatggccgtcttcatgaccgaaatctcacctaaacgagggaccaagttacttcaatccgtaacagagttgctagttggtattccatctgtcgtctatgggtttgtcgggttatcagtgattgtaccaacagtacgccatattttcggcggcactgggtttgggattttgtctggcacattggtattgtttgtcatgattctaccaacggtgacctcgttatctgttgatagtttacgagcagtgcccgttcattaccggcaggcctcattagcattaggggcgacccgttggcaaacaattcgaaaagtggttctgaaaacggcgactcctggaattttaacggcaatcatctttggcatggcgcgggcattcggtgaagcgctagctgtacaaatggtgattggtaatgcggtgttaatgccaacgagcttagtctcaccgtcgtcaacgctgacaagtcagttaacaactcaaattggcaatacggtcatggggacgatgcaaaataatgcactctggtcattagcattgatcttgttactcatgtcgttagtctttaaccttgttgttagagttattggtaattgggggaagcataagtatgaatcctaaacgatcaaatcagattgcaactggtacaatatttggactcgttgtgattgtggtattaattttaatcggcctgattgggtacattctatttaatggcgtaccgaatatttcttggcactttatcacagcggaagcacaagcatttagtgcgggtggtggtattcgggatcaattatttaattcgctgtacctgttaattttgacattgctgatttctttcccaatcgcattgggtgcgggaatttatttatccgagtatgcgagtgataactggattactaatgttatcagaacaatgattgaagtgttaagctcactgccatcagtggtcgttggtctgtttggctacctcctgttcgtcattaaattcgggtttgggttctctatcttggctggtgcgattgcactaacttttttcaacttaccgctgttaactcgtcaaattgaagagtccttgcggacggtaccaaacctacagcgtgaagctggaatgtcattaggactatcgagttggaaaaccgtgacgggaattatactaccagcggcattaccaggaatcatcacgggaattattttgtgtgctggccgggtcttcggcgaggcggctgctttgatctataccgctgggcaaagtgccccggtagtggattatttgaactttaatccgctcagcccgacgagttttttgaaccccatgagaccggcagaaacgttagcggtgcatatttggaaattgaatactgaaggggtgacaccagatgcccaccaaatttcaagtggggcctcagcggttctaattattgtcattttgatctttaatttaggtgctcgggcactcggaagttatacgtatcgtaaaatgacggccacaaaataaaggtgagagaatgaaaaattataatttagatgaaacctatattattaatccacaggaagaatccgcactttcggcgaaacaggtaacagtctcgtatggaacgaatcatgtgattcatgccgctgatttaaatttcccccggtataaaatcacctcactgattggcgcatccggttccggaaaatcgacgtatctgaggtgctttaatcggatgaacgataaaattgccacggtcggcggtcaaattatgtaccgcgatacggatattaataaccccaaaatcaacgtttatgagcttcgccgacatattggaatggtatttcaaagaccaaatccgtttgccaagtccattcgagagaacttgacgtttgccctgaaaaaaaacggtatgacggataaaaatgaactggaaatgcgactagaaacgagtcttaaaggtgttgccttgtgggatgaagtcaaggataagctagatcaaagtgcactggcattatcaggtgggcaggctcagcggctttgtattgcacgctcaattgcaatgcagccagatattttactgctggatgaaccggcaagtgcgctagatccgatttcaacggctaagttagaagagacactaaaaacactgagcgatcagttcagcattattattgtgacgcataatatgcaacaagcgtcccgaattagtgactataccgcgtttttgcatatgggccatgttattgagtatgatgaaacggaaaatgtgtttacgaatccccatgtgcgggccactgaagattatatttctgggaattttggttaggaggactggcaatgagcagcgtgattactactgaagatgtccatttgtattacggcgaaactgaggcactccatgggattaatttgaattttgaaaaaaacgaaattactgccctgattggaccatcggggtgtggtaagtcaacgtacctcaggtgtttaaatcgaatgaacgatctgattcccaatacaacagtgactgggagtctgaagttgaacgggcaagatatctattcgcctaacacggatgtcgttaatctacgtaaacgagtcggcatgctgtttcagcaacccaacccatttccgttatcggtttatgaaaatgtcgtttatggcctgcgtttagagggtgtgaaagataagcagcgtcttgatgaacgggtggaaacaaccctcaaacaagctgcaatttgggatgaggttaaagattcgttgcataaaaatgcgctggccttttcaggtggtcagcaacagcgaatttgtgtggcacgtgtgctagcggtcgaaccagatattattttaatggatgagccaactagcgcattggatccgatctcaagcgctaaaattgaggatacactagccgcaattcggagtgactataccatcatcattgtgacccataatatgcaacaggcttctcgcatctctgataaaacggcttttcttctaaacggtaatttaattgaatttgataatacagaaaaaatgttcatgcgaccagaccggcaagaaactagtgattatttaaatgggaaatttgggtagggggaaatgagatgagagaattattttcagatgagctcaaaaaattgcacgggcgatttatggagatggggattaacattagcgaacaaatttatcaggcgacctcagcctttactcagtatgataaaaaattggcccagcaggtcatcgatgacgaccagcggacaaacagtgaggaaatttttcttgaaaaagaagcccttaaattaatcgccctacaacaaccggtggcgtctgattttcgagaaattattagtattctaaaggccagttcagatttagagcgcattggggatcatgctgtcaacattgcccgcgaaacgctgaacacgagcgatcaaaaaaacgatgtcaagattgaaaaacaaattggtaaaatggccggtgacattcgaaagatgttagagcaagtcatggatgcctacgttaatcgtgatgaacggcaggctcgtaaaggtgctgaaaaagatttaaaaatcgatcaacagtatatcgatattcggaaggctgtgaccagcgcgattgaatcccaagagacaaccgctgaacggggatccagttatttgatgattgatcgtttattagaacggatcggggaccatatcgtcaacctatgcgagtgggttgtttataatcaatcgggaaaaattgttgaattaaatgctgggaaaatttcaccagagttattgcagaattaattttttgaaagtgattaaaaatagttcgtgatggttaaaatcatatcacgaactatttttgcgttttaagatcaaaattaaaagaaatcacagaatttgtgcaatcgattgaaaaattgatatatcgggtaaaatgagaatatgttaaactgtattttaacctatttttaatgctaaaggatctactaataattttaatatatctataccaattaagaagagtggttgtcaaaaaggctaaaaaacaagttttttattaaaattattgcgtataccaatatgaactggtatgatgtttacatgccagaggtaattaactttaaaaatttagcagtcataatgacaatcaaaatcgttggaggaattcaaatatgtttaatgaaacagatcaattaagtgtgactaatttacgaatgttgagtgttgaccaagttcaagctgccaattcaggccatcccggtttaccacttggtgccgcaccaatggcctatgttttgtggcaaaagtttttgaacactaaccctaaggatagccagtggatcaaccgcgaccgctttgtgctttctgctggtcacggatcagcaatgctgtacagtctacttcacttgtctggctttcagttgggcattgacgatttaaaacaattccgtcaacttgatagcaagacccctggtcatccagaacatggctggaccgacggcgttgatgcaaccaccgggccgttgggtcaaggaattggaatggctgtggggatggcgatggcagaagtccacttacgagcaacctacaacaagcctgaatttcctgtgattgatcactatacgtatgcgatttgcggggatggcgacttgatggaaggtatctctcatgaagcagccagtttagccggccactatggtctggataaattgattgtgctgtatgattcgaatgacgtttcactggatggccccctcagtaatgcctttaacgaaaatattcaagaacgttttgaagcctaccactggaattatttgcgggtggaagatggcgatgacttggaagcaattgccaaggcaatcgaagctgctaagcaacaacatgatcaaccaactattattgaaattaagacggaaattggtcacggtgcacctaatgccgggactcacaaagttcatggagcaccactgaaggatgacgaattagttgaactccgtcgcttctacgattgggatcagcctgcgttcactgtcgaagatgcggtttatgagcaatttgctaacggaatcgccaaacggggtgctcagtcagaagatgattggcacgatatgattgtgaagtaccatcaacaattcccagaattggctgcacaatttgaccaagcattggcaggcaaagtaccggctaactttgatttcttaccacattatgaaattggtgacacacaagcaacacggaaaacgggggcagaagtactccaaagtttggctgaaaatgtgcccacactgtggggcggttctgcggatctgtttagctctaataagactcagatcgacgactcagatcggtttagtaaggacaatccaacgagccggaatctctggtttggggttcgtgaattcgctgaagcggcagccgttaatggaattgctttacatggtggaacccgtgtctatgggagtaccttcatggttttctcagattatatgcggtcagcactccgattagcagcactgcaaaaattaccagtaacctatgtctttacccatgactcaattgcggtcggagaagatggcccaacacacgaacctgtggaacaacttgcaggattacaagcaattcctaatttggatgtgatccggccagctgatggtaacgaagtcgctcaagcatgggaaaaagccttgcaatctacagatcatccaaccgtattgatcctaacccgtcaaggattacccgccctcaagggagctatcgagaacccaaccggattggcacatggtgcatacgtagtttcaccacaaaagggtgaacagccggaagcaatcctgattgctagtggatctgaagttagtttaagtattgaagcccaacaacggctagctgctgaaggtaaggacgtatcagttgtttcaatgccagatcaaaaagaatttgatcgtcaatccgctgaatacaaggaatcggttttaccgaatgatgttcgtaagcgggtgtctgttgaaatgggcgttacccaaacatggggtaaatacgtcggtttagatgggatcagcctcggaatttcaacattcggtgaaagcgggaatggagcggcggttgtggaacgctttgggttcacgccagaaaaagtggctgctgcggttaactcactattttaattaaaaaatgaatataaaaaggacgcctccaaaatcgggggcgtccctttgtgttgattgctaggcttgcatgatgaaattaggatctccatctggattgccataccattgataattatcataccaccgagaatgttcttcggtatttagtgaactaatttgggccatttcatcggctgtcaggtcaaaatcgtcaattgcagcattttcaatcatgcgtgattcatgcacagattttggaattacaatcaggccttgttgggtttcccaacgaaggatgatttgagcagctgttttttgatgggcggtcgcgatttttccaatgaggggattactaattgactgtccattaccgagaggggaccaagcctcaacctgaatgccctgtacccgacagagatcaacaactgcttgttgatgaattcgcggattgaattcgatttgattaaccgctggggtgatggatgcgtgtcgaaggaggtcagttagacgctccacatcaaagttgcagacgccaattgcgagggctttaccctgacgatagatggattccattgcctgccaagtttcattgtataagtcgttaactggccaatgcatgagtagcaagtcaacgtggtcggtttgaagacgttccagctgaccgttgatggcagccagagtttgatcatacccttggtcaccactgaaaaccttagtagtgatgaaaacatcgtcacgagtttgttgtgtttctttaagaccccgaacgattccattaccaacgccggcttcattaccgtattgtttggcagtatcaatcatgacgtagccgttttttatggctagccgaacagcttcttcggcatcctgattgcttgctttccataccccgaggcctaattggggcatcataatttggttgttgaggcggattgatggttttaaaacgcgtgttgtcataaatctccatcctttcggtctaatagttatgtctattgtaggcggttcggctaaaaaaagccaacttccagaattagtaaattgcaagcaaattagtagagcttttcacaaaatggaattataataaaattatggtttgaatttatggttcaaactgattagcattgatagtggaatcaagataaagaagggaagttataagtatggcaaatggattacaaaaacgtcatgacgatttctttggtgattttggtgattggatgaacgacggattcttctcaaaccttggaaaagctttctattcaataacgccggaacatggcacaatgaaaacagatgtgaaggaaacagatcaagcatatcaattaaagattgatttaccgggctttgataaggcggatatccacctgaactatgccaatgatatgttagctgttactggtcaccggagcagcttcagtgatgatagtgataagaaaggcaacatgattcacagtgaacgcacttatggtcaggttagtcgtcaataccatctgccggatgttgatcgggataagatcaccgcaaagtatgaaaaaggtgttctcagtatgacactaccaaaactcgatcaggctgtggataatgatagtcacattgaaattgaataattaaataaaaagatcgaagcaaagtcgcttcgatctttttattagattaacctaaatgttctttaatgccattgggaaaatctttgtcaatttcttttaggattggtaaaagatagttgatataggtatggtaggcatcaatgggtcgatctcccttagtgttggtagacgcgagagcaagagcaatatcatgtgcacgttgttcgtttgaaatcattttttcacctcatattatgtagactgaacttattaacaagtagacgggtgctaaactgagatagagcataaattaggatcataccaatccagacaccacaggcatttgtaattaggtcatcaacctcgacccagcggccgagttggacgaaccaattaataataaattgggttgtttcaatggtcagaccagtgccaatgcctaaccataccttaacactcaaccggcgtggattgaagattaacatgtagtaaataccggcggggacggtcataaggacgtttagccaaaaggcggtgtccatcgcctgaaaagggaccagattgacaatcatcccatgaatgagaaagtagtgaatctcatgaaccgcaggaaaagaaaacggtgcgggagcaaagcagatccgacagataaaaaagagatagacccaacttgtcagaagggtgattttttgccagatcgtgtcagtctgttgccgaatcagtttaacgagcaacactaacaataataaacaaattaaaataaatggaatccagatcttcatgttcatactcctcgaagttactgttaaatatgataaaggatctggggatgaattgctagttttcctcattattcaggtgatttattttaattcattagccattaaagtgatgaatgatacgagttaatcccctttttttatgaaaatcggattaaaatccgattattactagctacatggtgaacaaatgcgctataattttttacatgtattgtttttggtaaaagggaattgaaaaaaatggaagaagtgatcaaatggcacaacaagggaccacggaacttgcgcggaaccttaaaaaccgacatgtacagctgatagcactgggtggcacgattgggaccggactctttttaggctctggacagtcaattcattctgccggaccttcgatcttattggcgtatgtgattgccggattggcgtgcttcctcttgatgagagcattaggagagatgttgctttcaaacttgcattatcgttcatttattgaagcgattcgagattatttaggtgaaaaaattgcatttgttaccggctggacctactggatttgctggattaccattgcaatggctgaaatgacggcgattggaacctacatcaaactatggtttccaagtgtcccgcaatggttgccggggctcgttgttttaattattttgttaggggtcaacttaatcacggttggcgcattcggtgaagttgagttctggtttgcgttaattaaaattattgccattattggtttaattttagttgggatcgtccttctattggtacgattcaaaacgccaattgggcatgcgtcggttatgaatttagtcaaccatggtggcttcttcgcaaccggaattaaaggatttttgctttcctttcaaatggtaatctttagtttcgtgggaattgaaatggtcgggatgacatcagctgaaacacaggatccggagacggtgattccaaaggcgatcaacgatatcccaatgcgaattatcttattctatgttggtgctttgttcattgtgatgagcatttatccatggaatcagttacagacaaatcaaagtccgtttgtcatggtgtttaaagatattggtattaaaggggccgcaagtgtgatcaactttgtggttattacggctgctgcttcggcttgcaatagttctttatacacaacgggacggatgcttgcagaattaacaatgggttccaagaatccacgtattcgtcggattagtcggttatctaagcaccatgtaccagctaatgccttgattttatcaacaattttaatttctgtttcggtattgttaaactattttattcccagtcaagtattcacattggtttcaagtgtggcaacggtttgctttatttttatttggagcattattattttggcgcacatgaagttcaaaaagacagaaaaaggccggcaatcgaccttcaaaaccccattatatccggtgggagattatctaattttactgttcttaatggcagtggcggttgttttatgcatgaaacatgaaactttgattgcgttagtgctctcaatcgtctggttcgtagtgttatacggcttgcggttacgacagaaaaaagtaatcaattaaaaaaatcgagcaaatccgatctaaatggtcgtatttgctcgattttttacgtatattaactggaggagatgagaaaatgacgaatatcaaacgccctgaatgggctcaaaagacagcgttgatgcgcgactattacgatcatgaatggggagtgatctgtcatgatgatcggcagctatttgagatgctatcattagaaacctatcaaattggattaagctggcaaacagtgttgaataaacgaaacgcatttgaagcagcctttcatcaatttgaaattgagaaagtggcggcgatgaccgcgcaagatgtgacacaattactacaagacccggcaatcattcgtaaccgtcgtaagattgaatcaaccattcataatgcgcaggttgttcgccgaattcagcatgaatttggtagtttggaccattacttatggcatttagttgatcacaaagttcaacgagtcgtcttggcggccaacgaacaactgccacccaagactaaaatgtctgaggcggcagctaaacgattgaagctggatggatttaaactagttgggccggtaactgtctattcgttcatgcaggcaacaggtatggtgaatgcccgtttgtaggtgaattaccagtagatcaacaggactaccaacatttgaacaaaactgtatttgaggtagggttggctcattttaggaaagttattcatgactaaccacgcacaaacaatgaggataatggcaataatggcgggtaatgaaagatgccgaaataaaagtgtcacaattaaaatgaccccaacaatcagtgcaacgataactgctttttggggctcccgggctaaaaagatgggggtcaaaaaaagcagatacgataacatcagtggaataagtgtcataacgaaggaccaggacagaaaatgaacgcttaaaaaggccaatgcactcggaagggtgagagcagctaataagctgtaaatgaagaggccgaattcgttttgtaactgtaatggccggagttgcacggtaaataaaaatacgggtaacaaaagaagcagtaaaatgatgacaaattttccgtgaatgactcccgaaaaggccaagaagccacttgcaataattgttagcaatgaaaagcgggaagtgaagttcgtactaaagagaagaaatgatgttgcggcgactgccaattcatataggaaaataaaagcgaggttatattcaaaggtggccgttgaaatttggacggcatattgaaacgggacataccaccaaataacggactgaatgacgagagatgggatgagttggcgccaattaatggaacgccattgtgacgcgattgtttttagcatatgatgctcctttatcaatctttgcttccatgttaattaatttcaggcgaatcgtcaatttgatttttgtttcttttttttcatgactattgactttttgatgcaaattgatataatcaattgtgaaattaataactaaatttgacgaggatgattaaaatgacagacaagaaagttgcattaattactggtgccggccaaggaattggcgaagcaattgcgaaacgccttcacaatgatggcttccgagtagcattagttggtcggactttggctaaggtagaacgagttgctaaggaaatcaatgctgatggtggcgaagcattcgcaattgccgctgatgtttcaaagcgtgaagaagtttttgctgccgttgatgaagcaacaaagcactttggtgattttaacgtcatcgttaacaatgccggtgttgcaccaacgacaccaattgacacagttacaccagaaatcttaaatgataccttagcaatcaaccttggtggtgtaatctggggaattcaagctgcaagtgctaagttcaaagaacttggtcatggtggtaagatcattaacgcgtcatcacaagccggccaagttgggaacccgaacttgacagtttatggtgctactaagtttgcgattcgtggtgttacccaaacaactgctaaggaattggcagaattcaacatcactgttaatgcatattgcccaggaatcgttaagacaccaatgatgaacgacattgcccaacaagttgctgacaatgctggtaaaccattcgaatggggaatggaacaattctctaagggcatcgccttaggtcgcctttcagaaccagaagatgttgctgcttgtgtggcttatcttgccggtcctgactcagactacatgactggtcaatcactactgattgatggcggaatggtcttcagctaaaaataaccaatgaaaaggctaccattatataggtagtctttttgtgtattcaaaaataataatcaaatttaagtattttgttaaaaaatgacgaatccatgattgttatgttgatcacacaatctgatttgtgctaagatagctcaagttatgagtattcccgataggattcactacctgtgaagaagccttgtaaccgaaaacggccgtcagttacggtcagaaacaaatgggggaatttattttgtcagaacgacacttatttacatcagaatcagtttcagaaggccatccagataaaattgcagatcaaattagtgatgccattttggatgccatgttagcacaagacccagacgctcgtgtggcttgtgaaacgtcagtgactaccggacttgtcctagtctttggtgaaatttcaaccaaagcctatgttgacattcagcatgtcgttcgtgaaaccatcaagagtattggatacaccgatgccaaatttggttttgacggagatacctgtgccgtaatggtcgcaatcgacgaacaatcacctgacattgctcagggggttgacgatgcactagaacgtcgccaaggagacgaagatccgctggatcaaatcggcgccggcgaccaaggcttgatgtttgggtatgccattgatgaaacaccagaattaatgccactaccaatttcattgagtcataaattgatgcggcgcattgcttggctacgtaaaaacggaacgattaactacttacgtcccgatgcgaaggccgaggtgaccgtcgaatatgatgataacaatcaaccacaacgggttgatacggttgttttaagtacgcaacatgatccagatgttacgcttgatcagattcgacaagacgttatcgaagaagttattaaacatgaaattccagctaagtatctggatgacgatactaagtatttgattaatccaactggtcgtttcgtgatcggcggtcctcaaggggatgccgggttgactggtcgaaaagtaatcgtggatacctatggtggtgcggctcatcatggtggtggtgctttctcaggaaaggacgctactaaagtggatcgttccgcaagttatgctgcacgttacattgccaagaatattgtggctgcgggatatgcgcacaaggttgaaattcaactggcctatgcgattggggtcgcccaaccggtgtcaatttcagttgacactttcggtacgggaactgtgtcagaggctaaattaacggaagcaatccgtaaaatctttgacttacggccagccggaatcatcgagatgctcgacttgaagcggcccatctataagcaaactgctgcttacggtcattttggtcggacagacattgatttaccatgggaacacactgataagattgatgaattaaaagcagtattaggatagttataaaaaggcaacgaacatttttgttcgttgcctttttataattggtgatggcgtggtgagtgatggtagccaaagacagtttgaccaacaaaaacgacgatatatcccaaacaaaatcctgcgaggacatcactggggtaatgaacgccgacatagatacgcgaatagcctactaagagaataaaaatgaagatcacgatattaatgacataacaacgttgacgtttgatcataaagctgctgatgagtaccatcacacagcccagtactaacaccgcgccgctggagtgaccactcgggaagctatagccaccgtagtgcatgagcgggtcaaaactgggccggggacgcttgaccagcgctttaatcaccgaattgaggatggttcccaataccggagtgaagagaaagaagaacattgctcggtagtagtgttcgatgaataggattaaggttccagctaaaataaaaataattagaggaactggattgaaaaatgtggtgtaccaggaaacaattaaatttttccatggtgtctgtggaaagcgtacggcacggatgatgagtcgatcaaggttaatcacccattgagcgtgagtcatgattccaatggtgagcatcacaaacaagacgagtgagattcccaacaatccccattcccataaattcgggcgtcgtgtatcgttcatttaaattcctcccaaaaagatcgatagagctattgtatcatagtcaaaattgacggaggaagagaactttttgttttcaccaaggcagttgctcaccggaataaacttgcaaattctggtgggctttgttaacattgattcaatatttaatcgttgagagggactattagagcggtgctgttttcagagaccacgtgatgctgcaaacgtggagcagttacttttcgaactcgtcctcgaagattttttactgaaatcaagagtaggtaaaaacgtggattcgcgttacggatactaagagctacattttgtagaacatgggtggtaccgcggagtcattcgtcctgtaggattttttcctatgggctttttttatttcaacgattatacataataagacttaatacctgaggagacgattattcatggcttacgatcatgatacaattgagcgcaaatggcaacgctattggaagaagaacaagacatttaaggctgacattgatcagtctaagcaaaaatactatgcattggatatgttcccgtatccatctggtcaaggattgcacgttgggcatccagaaggctacactgctaccgatgcagtttcacgtatgaaacggatgcaagggtttaacgttttgcaccccatgggttgggatgcgttcggcttacccgcagaacagtatgctttgaagacggggcataaccccaagagttttacggaccaaaatattggtgtcttcaaaaaccaaatccaatcgttaggattttcatatgattgggatcgcgaagtcaacaccactgatcctaagtactacaagtggacacagtggatctttgaacaactttacaagaagggattggcctacgaagacgaaatcatggtgaactgggcgcctgactttatgggtggcacagttgtggccaacgaagaagtggttgatggaaagactgaacgtggcgggtaccccgtataccgggtcccaatgcgtcagtgggttcttaaaattactgcatacgctgaccgtttgatcgatgatttggatgaccttgattggcccgaaagtatcaaagaacaacaacgtaattggattggccgttctgaaggtgccagtgtgttcttccaagtggccggacatgatgatgcccgggtagaggtctttacgactcgcccagatacgctatttggtgcttcatacatggtattagcgccagaacacgatttagtagaccagattacgacgccagaacaggccgctgctgtcaaggcataccaagaagagacctctcgtcgttcagaccttgagcgaacagatctcaacaaagataaaaccggggtcttcaccggcgcatatgggattaatccagtcaatggagaaaaactgccaatctggatcggcgactatgttcttgcctcatacggaactggtgcgatcatggccgttcctgcgcatgatgatcgagactgggaattcgccaagaagtttggcttgaagattattccggtcattgaaggtggcgacgttgagactgaagcctatacgggtgacggtgctcatatcaattctggatttgtggatggcatgaataaaaaagatgcgattcaagcaatgatcgaatggcttgaggatcatcatgctggtgataagaaggttaattatcgtcttcgtgactggatcttctcacggcaacgttactggggtgaacccatcccagttattcattgggaagacggcgaaacgacacttgtcccagaagatgaattaccacttcgtctcccagacacgaagcaactagaaccatcaggaactggtgaaagtccacttgctaacatcgatgactgggtcaatgttgttgatgaaaatggacgcaaaggaaagcgtgaaacgaacacgatgccacaatgggccggatcatcgtggtactggttacgttacatggatccacacaatgatcaagaatttgcaagccaagaggccttgaactattggtcaccagttgacctgtatgttggtggggcagaacacgcagtcttgcatctactttatgcccgtttctggcacaaagttttgtttgaccttggtctcgtaccaacaaaggaacccttccagaaattagtcaatcaaggcatgatccttggtgaaaatcatgaaaagatgtctaaatcgaagggtaacgttgttaacccagatgacattgttagccaatacggtgctgatacgttacggttgtacgaaatgttcatgggcccactagaggattctgtgccgtgggacgaaaagggattgcatggtagttacaagtggatccaacgggtatggcggttattgatcgatgataataatcatctgcgtgatcgggtgacgacgatcaatgacggtaagttgacaaaaatttataaccaaaccgttaaaaaagtgacagaagactttggtcggatgcacttcaacactggaatttcacaactgatggtcttcgtcaacgaggcctacaaggtggatgatttaccagttgaatacatggaaggtttcgtgaagatggttgcgccaattatgccgcacgttgctgaagaattatggagtcaattcaacgaaagtgaaaccatcacttaccaaccatggccaacatacgatgaaacccaactggtcgaggatgaagttgaaattgccgttcaagtgaacggaaaagtcaaagctcacttgaaggttgctaaggatgcttctaaagacgagatcgaaacacagtcgttagctgaagaacatgttaaggctaatttgactgataagacgattcgtaaggtgattgttgtcccaaacaagattgttaacatcgttgccaactaaataataggacgtcatttaacacgattaggctgccgtctaatcgtgttttattatgcagtgagcactgaatgatgatggttttgcgggtaaattgttaaaaactgataaaactttaaaaataaattgcgtcacccatgtataaaggctaaaataattaggactgattattagaaagtaggcaaataatggctaagcaacaatcatcagcgctgaaagttggaagtaagcgtgatgcacaaagtaaaatgctgagcggttcagcttggatgactgccggtagtatcttttcacgaatcttaggtgcaatttatattattccttgggtgacgtggttaggatctaatagtgatcaagccaatgcattatttgcgaagggctataacatctacagcttgtttttaatggctgccactgcgggggtgccatcagctatttccaaattggttgcgcattataacgcactgaatgagtatggcgtggggcgtcggttataccggcacggaatctatgtatctgccttaaccggattagtctgtgcacttgtgctatattttggtgcgggcattttggcaaatggggatcccaatgttgtaccagttcttcgatcgttgacgttagcagtactgattatcccgaccatgagcctcaccaggggcttttttcaggggtatcaaaatatggcgccatcagctatttcacagtttgttgagcagctattccgggtgatttatatgctgggggcaacgtatttaatcatgaagccgatgcatgggcgctggcaagatgctgtgactcaatcgacgtttgccgcatttattggtgcgattggtagtttcctgattctgggattttaccacatgaagaatcgagccgaaatgaatgccttggtggctcagagtaacgatgaagtttcgatttcatcgtggtcgcttatctcgaacattattaaacaggcgatcccgtttatcattattggggctgcgacgagcattcttcaaattattgatcaatacacgtttttcccggcaatgaagcaggtagttcacctgacaagttaccaattgaattcgctatatgcgctgttttcatttaacgctaacaagctcataatgatcattatttcattagcatcggcgttggccactacggtaattccgttgttgtccggtgctcgagcccgcgatgatgttcgcagtattcgtgagcaaatcgcaaatgtgctcatgctcttttactttgtaatgatgccggcgtcgcttggattagcagccgttgcacagccgatatataccattttttatcggtatagtgctgcagggacgacgattttaatctttaacgcttttattggaattttactgggcttattgaccgttgtttctgcggtaatgcaaggaatttctgaaaacacgaagacgttaaaatatcttggaattgggttagtcatcaagatggtgatccagttccccgcaatctggttattccaaacaatgggaccgttattagcgaccggtatttcaatggcgattaccgattacctcatcattcattcgttgaacgttgagtttcaattgccgtttaagaagatgtcaaaaccaaccaatcagattctagtatattcgctgattacgtttgttgtggctaaagcggttgttagcggtgcctatctggtcttggcgccaggggggcgtttcgcagcatttgttgtgatcattccagccgttgctttgggtgctggaatttacgtgtacctaatgctgagatctcatttagcggataagttattgggtgcccgagtggcaggacttcgtcgtcggctacacattaaggggtaagtaatgagaattgataaatttttacatgatcagcaatacgggagtcgttcagaaatccacgagttaattaagcggcgccaagtgatggtcgacggtcaaccaatcaagtcgtttaaggctaatattgatcctgacgtaaatgcgattcaggttagtgggcaatcggttcaagtacaggcaccatttgtgtatttgctgcttaacaaaccagcaggggtcatcacggcaacgcatgatgagacacaagcgaccgtgatgagtttaattgcaccggccgatttgcgaaaggacctttctccggttggccgtttggataaggatacgactgggatgttactattaactaatgatggacaattggcgcaccagttggtaagccccaggcaccatgttcaaaagacgtatcgtgttacgactacggggcaactgaccgcatcgcagttagatgagttggaagctgggattacattacgggatggctcacaagtgcgtgcagacgactgccaattggttgagcaacaagcggatcactcaattgtgttgattacgcttcatcaggggaaatatcatcaaattaagcgaatgattgggtaccttggtcaacgcgtcacgcaacttgatcgggaatcatttgctgggatacaggattcaacgcttgaacttggagcctatcgtgccctaaccgcagcagaaattgaacaattaagcaaataaaaatgcagatgactaccattgttggtagggcatttgcatttttttggcgctattgattggcgtagcgttgcatgaaagcaggtagtgcttcggtaatttggtgtggtaaaacaacatagcgtgtttcggccagctcttctgcaatggcgctatgtgcataaacggctgctaatacagcagcttggtgatctgaaaattgagcggtaaacccaccaattataccagccaaagtatctcccattccgccagttgcttgggcgggcgttccaagtgggagttgatagatttgaccagttggttcataaatttcagtgtggtgttttttcaaaacgacagttgcttttagctgttgttgcacggctagattattagtggttgtttgatctgcaatttcaattccgctgaggcgttgccactccatttgatggggggtgtagatcaggtgtcctgcgggttgagtgatcttttggtgagccatcattgtgattgcggaaccgtcgataactacggtctggtcgggttgcgtattagcaaagacggtggccagcacttcctgactacgaaaatcatctccgagtccgggaccaatgacaattgtatcggcctcactagttaagttgctgagctgaactttatcatggtagttgacgaacatggcctcaggaacttgagcgtgtaaactgccaagattaacggcatcagtggcggtggtgacgaggcctgcaccagcgtgaactgcagccatggtggccataataatagcgccgccaaagttttgattaccaccaactaatagtacgcggccgaatgtccctttatagctattagcggggcgtggttggattacgtgagttaaaatctgatctgttaatagttgcatagttttcatcccttaatgattagtcaatatcgttattgtagcgcatgttgtctgatcacgctattcagaatgtctcgatgaaacttgaaaggcactatggtacaatgaaactctaagatcttaactggaggaattcgaatgatagactggcaagccaaggcgcaggagcaacaagacgagtacttgaatgatttgatggccttgatcaaaattccaagtgttcgtgatgatacacaggctaccgatgagtatccgctcggtccgaagccggcacaggcattgcacgcaattttagaaatggcgcaacaggatggtttcaagacaaaaaatatcgataatgtggttggttatgtagaatgtggcgagggcgatgaaaccttagcaattttagctcacgtggacgttatgccagctggtgatgggtggcaaacggatccattcgatccagtcattaaagatgggaatatctatggtcgtgggacgtccgacgataaaggccccgggttggcagcttactatgcattgaaaacgcttaaatctatgggtgttaaatttaatcaaaaggtccgtatgatttttggcacggatgaagaaagtaattggaccggaatgaaacggtattttgaagtcgaaccagcaccaacgtatgggttttcaccagatgcgagttttcctctaatcaacggtgaaaaggggaacgtctcattgaagcttaactttgatgcaacagcgacgggaacggtgactttaacacgctttgacgccggcttacggcctaacatggtccccggtaaggcaacggcgagtgtgcatacaactgcagcccaccaaatggccagtgcgtttgatgattatctcgccgaacaaccggttagcggatcagctcatgtagacggtgacaacgttaactttgaggtgatcggaaaggcagctcatggaatggaaccagaaaagggcaacaatgcaggaacctatctggcacaatttttgatgcagtttgattttgcagcagctgcgcatgattttctgaccattttaggacgagatttacatttagatacccgactacacaatctgaagatgaattttgtggatgaaataatgggtgaattgacggtcaatgttgggataatgcggtacgatgcccaagttggtggcatgattgatttgaatttccgctatccaaagggcttgtcagcggatgcgctagttgagcaactgacagtggcaacaactggacaacagttgacaattactcgtggagatgccatggaaccacattacgtagatccccaagatccaattgtgcagacattgatgaacgcgtatcgcgatcagactggggacgttgatagtcagccagaggtcgttggcggtggcacgtatggtcggatgatgacacgtggtgtagcgtttggggcgttgttccccgacacaacgaatacaatgcatcaagcgaatgaatttcagccagttaatcaacttgttctatcgatggcgatttacatgcaggcgatatatgaattaagtgtcaaaaagtaaacgttttactactcattaatagttaaatttgttaaaataagtgtgagaaagttccttctcaacttctgaacctattctttattgggggtgctatttatgagtagctacaagaatatattagtcggtgttgatggttccaaacaatctgaaatggcattagaaaagggcattattagtgcaatccagaataatgcgaaattaattctattgagtgttattaatggggaacgttatcccaataccagcaccgtaggatacggatttatcgaccgcagtgtgtacgatacagcggttgaagagatgaaaaagaaattaaatgaatttaaacaacgggcagtggatgctggtgtgaaggatgttgaaactgaagttaagattggcaatgcgaagcttgaactcggtacagactatccccgtgcgcatgacgttgatctgattgtggtgggggccacaggcttgaatgtgattggtcgcatgattgttggctcaacttcttcatacgttattcgtgaagcaccgtgtgacgtaatcgttgttaaaacagataaagataatcgagaagtggatttacaaaaaaccacctacccagaaatctaaaatagtgtattgctttaaagccttgtgcccgttgggatcacaaggcttatttttatacatttttttatcacgcccacgaaatgcccacattacaccgaaaaaattaactgggactatttaaatatgcatccaatagatcaactgcttttcgtttatcactgtcggaaacatgggtgtaaatatctaaagtagtctgtatttttttatgtcccaataaaacttgtgcctgtttaggtggcacactagcttgcagcagaaacgatgcgtaagtatgccggaacccatgcacgttaattgatttgagtttgaaacgatcgcaaatagcttttaattgagcacgaacggtaacggggacgatcggacggttgccaaagggtgatgggaacattgaaccgtcgtcgttcgttacatgaaataattttaaaaaatcgctgcggacatccagccagttatctaaatatttcgataccatgctaggcacgggaacttcacgatatgatgaactagttttcatggtcgggttacgtttgaagtcatcagccagtccgacgtaggtggtggatacaaggttgttatgaagtttcagtgttgcagttagcggatcatatgaatcaacgtaaagggcacacagttcaccaacacgtgcaccggtgccggccagcgtgcagtaaattgctaaatcacggattccgactagataccatttctgcgggccacttttctttttttcaatatatgcggtttgtaatttaatgaatttgtctaagtcatccaatgaccaatatctgctaggctttttgggcttcgttttaggtattttaattccatcaatggggttttcatggaaatagtgttgctgaatagcaaacttaatagctttatgaataacagttaagtccgaagtaattgcggaatgggaatagttatcttgtgctttgtcgtttaagtattttgaaatgatgtcgagattaatacttttaagtgggatattacccagtgctttcgatatacgtttaattgacttttcatattggaactttgtcccatccgctaaacctaccttagcattttctagccatcgatataaaaatggttcaaaaactggattatctgatgtaatcataaatccttcggacaaacttagctcaatcttgttaacggcttcttgtgcatcagattttttagcaaagccacctttagacttttcacgtgtttttccagtataaacgtctttatatcgaattctgtattcccatgcgccgttacgttttctaaatgaagccatgtgtaatcacatccttaatttatttatattttgtccaaaatcaaaattgaatggtagtaggaaattcaattttgtattttttgcaaacatatgttctttgacgtgttaaataaaagccccagataggggcccttgatcatgctgttaaaagtttgtttatttcttcgatatttagtcctttttgttcaattctatctgttaaattagatagttcgctatccatatctattaattttattctttcatcatcactcgttagatcgtcaatcatttggcttattattatttcgttatcatcactgtctatttctttttcattatcaagtgtattttgatttaaaattaaaatgtcactatctttctcatattttgaactaaaagtagtcattttctgataccaatcagtgatgacttctttattttcagaatttggcgctgactgtaataaattaattgagtcttttataccaaaaacaaaatcaatttttaagttaattggaaattttttagaaggagagacaaggacgttactttttattttgctaccaattaaatttttactatcaaaatattccgatgcacgctgcttaattgcgacagtgcgtatatttcttttttgatgagcttcacccaagtatatttcaaatagttgattgaataattcatttttatcatatgcctcagcatatctgggtagatcaataaaaaggccatttggtaggccaaattcaccatgtagctgtaataacattttttgtggatgagtttctaaccctagtccgagatcatttgatttactcatttgcaataattttttcatgtaggataaagtatttttatagttttctttttctgtcgaattagcgaagaaatattttaatttagtattggttgctgggagtatatcaaaaaaagtgtctttatctttttctgaatttaaaataagaccgacgttaagtatttcgtttcttgatgaatttgctacgtatgatatcactgaataccagaagccctgttgtttgtttgccattctaaagccccctctaatgaattttcaaaagcaccattattatatattgattccaacagcatgggaagaagttgctgctgatctagcataaactgtttatagtaatttttttgctgaatacctccagaaacccattcatcgggtattgtatttagcatggataaaaaattattgtcactgattgaagttaaaatatcaatcggtttaataaacggattgatactattttcgaacgtaatggttgattgcattgctcgaaatacatttccaataccagacaatcggttaccaaaaccagcagagtctagtaatgacttaagcaccacattaatatagtgtctgatattatcgggattgctgataggttgaaattgtgcgtgttgtagaatagtctgcttttcccgaagcatttgtgaatagcaaggcccgagaaaggaatgtccataatcaattgaataagcgattcgtctgccagattgatttgcaattaacagattaccattattcccaaatctgtccagattcattaaaaatatatctagtgcgatgatagatggaaactcatcaacattaaccacattggtgaaatacttaatccaagggctcaacaatcttgattctgttaagttttttttcatgttggttgtttgcacgaagttactttccataccatcaatcatggaagttccaaattttaggccaggacgttgtccgcgttgaaacataatttctggattattttcaaccatttttttgcttagatttagagcgacaatttttggaatatgaaggccgagtttttcagcgagcatataaccaatacattcttgaaagaataccgcatcttcttttactaattgtcctcgtgaatttttacctgttggacttttcataatatatttgttaaagtcactatcttgtacaattagcggagcgctcatgccttgtgtgggacgagcattttcaatcagtgtcacatcatatttttcgataatcaattttcaaccacatcctttcaataaaatagtacaacgcccccggcaggactcgaacctgtgaccagacagttatagacatctgatctaaccaaatatgtaaaaggcctattatagccacacccaatacaaacgaaggctaaaaataattttttaatcaaatggatcccaatagttatcaggaatatgatcattttttgataattcccagtggttagacattcctcttttggggactgcatcgggtttcaagcaaacaaagtgtctatgggaactatcttcaataataaaaacacgtttatattcattgtccgaacttatgatagagcagttagagtgtttatatccaaaaatgtcaacgtattccatacaatcacttcttccttaaaactgtctttagatcaatgcaaattaaacagtgtaaaatgactttctgaaaacctaattagttacgaagagcaactagtgattatgatgctagtgaaattagtaagaaatatttgtgccttcatttttataaccttaatgattactaggtacagttaaagttagataatctggtaaatattccaaatcgatagggaggctaacagatttatcaccatcaattctcgtagtgatactttgattttcatttactgaatcaatatgagcagttgaaacatggtattgagtgatagacttactagcgcttaattttccagttagcgagaaccagacatacggtaagagttgacgaaagccaatattgtgtaaaatactcatgtgcattttattaggagctgattcagtataaatgtgaccaccaacagattttattgttgtgatcagggtaaaccatgtttttaatgtttcattggtaccatcatcgaatacatactttattttaaacgatttatttctacctatatgtttaatggctttcgcaacgtaaataatttttccaaattttcttttttcttgctgccgtacatcgttcgaaatatctgctaaattgccaaaagtgagggagctaataacagctttttctttattacaagaaattatgcctacatttagatcgctatgctctttaataattaattcgattgcagcatcgatatcagtggggatttgatagtatctagcaaagttattaacggtcccagaaggtattactgccaaattaactgattgtttagcttgtatcatggctgttattccaatattaattgttccatcgccaccaattactactagtgtgtcaatatggtctaaggattttttgattttattaataaccttatcgacggtatccgcaactagatattcattaggacaatttactttatcaaagctagaggctaatctgtgagcgattctttttgcttcaccgctgccagagttttcgttatagaaaattccgtatgttttattcaccatgatttaacctcctatagtgattccttgttgaagagcgagagataaaaattacgtctttcaattaattaaaagcaccgtgctggggccaaattcataaattacatggaattatctaatgaggtaggggagccaaggactgaacactttaactgcatctccattctcgtggagaatcagaaatctgtctgcattcacatacttagcttcctgcagaagttcgggtaatgagttgtacgttatggcttcctcatttcgtatcattgtgattgatacaacatcctcatatgttttactgatttcaccagtttgatagtttttaaaaataatatcgttcataaaattgcctctaatatccatcgttagggtcgccagtatcgtttgaatctgcgtttgcattaacttcgtcttctgcttgctgtcctttggcggtattagagccgtctggattttcatagccattctgaacagcccaatcatgttgtccttgtacccaagagtcagcagtaccatctggatttgagcctgcagcatggtcttgaccagggagcagcttgtttccgtttggatcatagccacgttcacgattaatttcgccttgagactttgattgtattgtttgctgagttctagctgtcgaactcgattgtgctgcctgtgattgagatgctgccgcagacgctgctgatgatgaactagccgcgatcgaactagctttactttcggattcagctttggccttgctttcagaagcagctttagctttcttaatggattcctttttagcgtgtgcctttttcttagccactaaactacttgaatctttcttagccttatcagatttagcttgcgagttcccacacgccgcaagtgatagggtagtgattagtgcaataccaatcgttaaaccttttttcaattattacatctcccaatatgttacaaatcaagtagctgtttctttttagcgtcaaaatcttcttgagtgattattccatcatcaagtaaagatttcaaattacggagtttgtcgacggtggaatcactatttgagctatcggtatttaattcgtttacgttatcagtatgaacatcgttactattctcgaattcttttgaataaagaaaatggtcttccaagaatgatacctgtttactcaatgctagaaatggaagcacatattctttgtgtgtttggtcttcaaaatgcaagtggcatcgagagggaacttctttttccgttgacgttgtagttgactttctgcctcgggatccaccaatcattgcccctactgggccagcgaccagaccgccaacaagtgcactcccagaacggccttttgtttttgtctgatatgaggtcttatagtttgaattaaaatcaattcctaacactctatatggattgtattgtggatcgttgctgaaaaagaagggttcgtcatcagaaatgcacaaggtcgtgttcacactgttgagtcctaatttatccgctaggggttgtggagctgttaaagcaaatgcagttttagctgtctttccaccgtgacttacggcgtaatcaacagcttgattgacttgatcaggtttcaggccgtcaatgttttttcttaggttaggtatatatattttgttattcaaattcatgaagacattattttttagtggaaggggctttgtaccattttcgtaactagcaacgtaaaaattactatttttaaaagcaataaattccgtttttgccttattttcgaagactttttctggttttacttttttgttcatatttgaatcaacgtatcttttatatccaccaattaacgcaagaacaagtaatgcaataacagcaatagtagtcatcattttaaatttctcccaagaattttacacgtgcaatttaggaaacccgtacatataaacgagtgaatcgtatttttcaggcaattcaccgacttcatcaacatacaaatttgtaagcaatgcaatggcaaacttatccgcttgtaattccagctttcccttgttgagatcgtttgtcacataataggctgcgaggtcagcgtgctcaactatatgcgccaattcatgggccataacgaagtatcgctgcggcttgtccttgatggagtctgataaagtgacaataggttgaccatcgtcgtatgaagtcattccaagcggatttggtccgatactgctccaatagcgttctacattcaatttgtccgatagcacaaatgggtcatgtgtaccgtaccggttatacataagtcgaattaacttgtaaagatgatcattcatgcgcatcacttccatgcttgtgccgtttccaaaaaatttgggtgagggcaattcttaatttttctttttcttcatcggtaagcgatgaaccattataggcgaatttggcattgtcatttaaaaagtttccgagatcaattgtatctttttcagttgcccattctggcgtttgattatttccaagtaggtagtcagttgttacattgtaataattggcaagtgctattagtgtttccccatcaggctggttcctattattttcaaagtgggagtagctggccctggtcaacttcaaatcatttgccactgactcttgagttttaccagtttcttgtcggagtgcttttagtctgtcgccgagcatgtatgaatgcctccttttaattgatattatatgtatcattatagatactaattgtatcgaaatctataaaagatacaaaaagtaccaaaaatctattgacggtacaatttgtatcgtgtattatatagccattgatacgatatgtatcagagagaaggtgaaaagatggaacgcgaaacattgattaatgcacgattgagtaaaaaattatctcaagcacaagttgccgatgatcttggactggctgaaattacggtgcgaaaaatcgaaaaaggtaatcggaatcctagcagcaaaactgctgttaagtttgccagctattttggacgagacatcaaagaactgttcccagatatttttttgccaaattttgatacaaaacgtaccaattccaccgccaaggaggtgagcgtatgaaagtgataatcgaaggcgatgatcatcgatcagtttatgaatcagatgatattgaccatttaaaaaagatcatcaatgacaacatatcccaaaataccttgtcagtaacgatcttcgaaaagaacttttccgaaactagaaaatgttccgctgtaagtactgccaatccggggtgctaagaaccccatctaatggcgggtaactaacaggtgctactaaaaacatctgacatctgcttgattgcaacgatttgataatcgattgctgatcaccaattgtgcggataataattgcaccttcgtatactttgatgaatcgatcgcttggatgtagttgagcacgatttttaactagttcctagttattctttccgggatcaaaagatattaagtacgtgttatacattgcgttcacctcctttggattattatcccacttggcggtgaacatagatattcaattttaaatgagtgaggaggtaactatatgaataaatcacaactagtagaggacctgatgtccttccgtccggaccttaagcggtcgtttcttgaaggatttggaacggacacactaaacaatatgctgaccatcgagcgtggccgcgtagcagatgaagtagccgaaatggctattgaatcatttgcttgattgtattgtctcgctcaaagccgtgaattgaaatatcaatcatccacgaaagggggtgacagtttgaaacaaatggttatgagtaagaagttaactaaccgaacaagccgtttgatggataacggagcattaagcctaacatcgttagccaagttgattggaatcaataaaacagcgttgtcgaattacaaacaagcagacagaaagatgcctgtggatgtagctgccaaaattaatgaagttttacgaaatactgagttgagccaagagtttgctgcaacatttttcaacgcgtttggattgtatagtacaaggcagtggcagtcgttcttacaagacgatccatatgctatcaagtttcagcaacgaattgaggaacgagagcggacagaacttgatgaatcagcatttgaagaactgcttgttaatggcgacaccgaaaaaattaagcaatggtcgaaagaactcgcacaggaaatcgcaattgaaatgttgtggttaatcaagactgaccaagcacgaggaattaatccatatgagctaataactcaatggaatgcagaaatgaggtgatcaaatggatagcgtggaagagttaatcaaccgacgagttgaagaaacggttaatcgattagttccaattgccgttgctaacaagcttgatgaaatgagcaagtgggatatgagtattcaagaattagttagagcaacaggaaccagcaaatcgacgattgagaaattcacttcacgattcgatgtgaaacgcattgaagaacggtgcggcaataaacgtctttaccgctatccggaaattcgacagctatgggataaatacttgcacgaaaagtatgttgaatactacaaggattatccgcgctacatccgcgctaaggaaaaaggcgattggagtctaattgaggggtgaaaaaatgaagtggctatatatgattcttggagctgtgaccagcctcgtactcgttacaggcaatcaagtcttaatcaattggctagcgttgttctggatcgcgtttggcgtcgtcaaagctggcaactatctatttgatcggaaggagcagaaacatgtttaaggacgcaaaaaaagacgctcaacagtggcaactgtcgaacgtctggataaactcatacaaaacaaatttatacacctatcataaatcgaaacgggggcttttgcaatggatgttaaacaacaaagacagccatcagattggccaacaccagtcgaacgctatctattagaagataaatactcactagaaacacgattaatctttccagatttcgacattacgcccgacgaacttcgtgatggtgcacttgataactacattgcattacgcacaccgcaggagcttagaaacatcttaagcatggtcattgaaaagtctggagattatgtagctgcccgtttaatgggtgcagaaagaaaggatgattcaaatgccatctaaaattccttatcactcaacggctggaatgggtcacattgaatggttaaaggctcggcgtaatggtattggtggttcggatgttgctgccatccttggactatcgccgtggcggtcgccttacacggtttggactgacaaaatgggctatttgccgattgacgaaaacggttcagagtttacagagtggggcaccatcatggaaccgatcattgctcacaagttcgctgaagaaactggtaaatatgtttatcgccagaataagatgttctatcgacctgagcacccatttttgactgcaaacatcgatcgagatattgctggagaacctggattcttagagatcaaaacagccacagagtacaaggccacggaatgggcggatggaaacatcccagtttactaccaaacacaaattcagcactacatgtatgtactgaatcgaccgtatgcgtattttgcatatctggtgggtggccatcactttggaattacaaaaattaaccgtgaccagaaagctattgacgagattgaggatgagcttatcagctggtggaatcagtacatgattggcaagaccccaccgccaactgatggaacagacagcacgaccgccactcttagagcactctacccacaggacgatggcgaattcattgatttaggaagtaagtttgacgttcaacttcgaaatcgtcatcaggcaaagcaaacgattgatgcgctaaacagcgatgtgaaaactgttgacaatgaaattcggcaggctctcggcgacgcatctggtggtgagacccagcatttcaatattacctaccatgcgaataaacgaggcacacgaacactcagaataaaggagaagcaatcatgatgaatagtttaagtggagcactaaattcaagaaatcaagcaggatcaccgacttcaatgattaaaaatctcatgcggtcagacagtatcaaaaatcgtttcgatgaggtaatgggagctaaggcgccgcagtttatggctagtattacgaatttggtcaatagcaatcaagatttgcaacacgtagatgcaatgtccgttgttgcatcggcaatggtagccgctactttagacttacctattgatccgaacttaggatacatgtacatcgtcccatatcggggccaagcgcaaccgcagatgggatataagggctatattcagttggcactacggacaggccaatataagcacatcaacgccttgcccgtttatgacgatgaggtgaagtcgtggaatccacttaccgaagaactggaatacgagtcgagtggcacctctcatgataatcagacaccggccggatatgttggctattttcagttgattaacggattcgaaaagactacctactggacatacgatcagattaacagccatcgccagaaattcagcaagatgtcctcgaaaactgatccaactggtgtgtggaaatcaaactttgatgcaatggcactcaagacggttctccgcaatctaatcagtaagtggggaattatgagtattgagatgcagcaggcttttgttaaggacgagagaccacaagaatttgatcatgaaaccggagagattcaagatgttcaagaagttgaagccgaagaagaaaatgttgctccagaaacacaagggtcaactgacaagaaggaagagtagcctatggctatttacagacaagttcataccactatatggcaagacaactgggtgagtgaactcgaaccaactgaaaagttgctatggatgtacctattaactaatgctaagaccactcaaagcggtgtttatgagttttcgcctcgttacacgtgctttgaaaccgggctaagccggaaagaagtaaatgaagccctacaacacttcatcaaggccggacgtgtccgttacgatcaatcaactaacgagatcatgattgagaactggttgaaatataattcagctcgttcgccaaaggttgcaaaagtgatcgacaaggaaattgaaagtataaaaagccatgaatttgaaaaccaagtcatcaggatggcactacattacgaatatcctattcgggcaaaggtcaatgatgaaaatactttatctggaaaagaaaatactgtatcgatagggtatccatacagtagcgatacgatatcgcaaccagaaccagaaccatcacagaaccataaccagaaccaacatcagaatgatagtgcgcaaggtacgcctgatgacgctgccgatccatatgcaatttatcaagaatgttttggagctttgaattcagtgaattctcaaaacattactgaatgggttaaagattttgggtcacctgagcttgtcattgaggctatgagacgtgctgcaactaacaacaagcagtacagctatgctgagggcatcatgaaaaattggattaaacacaatgtcaaaactatggcccaagttgatgtacaagatgctgagcatatgcgcaaacagtcttctcatccgtcttctaaggcacagtcacgtgagactttgcctgaatgggcaaaagacgggtatcagcacgagactaaaccagttgatgaagctacaaaggatgctctcaaagctcagatggcacggcttaaacaagaacaaacacaggaggcttagaacatgaacgaattaaaacaagttaagtacaacgatcaattgattttgactactgaacaattggcagagttctacgaagtgacaccgaaacagatcaagcagaacttctccaacaatcgtgacaagttcgaagatggcaaacattactatctgcttcagggaccacggctcaaggagttcaagaacagggtcgaaaatttcgaccttgttggaaagaatgccaatcaactgtttttatggacccgccgcggtgctggtcgccattcgaaaatgttgggaactgatcgagcttgggacatgtttgacgagctggaggagaactacttcgcaccgaaaccacagaaacgcccgcttacggccactgaacagctcaaactagctgcagaaggtgttgttgagctggacgatcgcgttaccaaactggaggaagacaaagcacttgatcctggtcagtacaactacctcagtcatgagatcggcaaggcagttaatacgtacatcatggtgcaccatttatcactcaacgccaaacaacgggccttgttgtacaaggacatcaatcacggtgttaacgaggtcacgggtattcggactcgttcacagcttcgtcagcgccattttgaaacggcgtgtgagttcgtggataactggactccatcagtcgcaactcagactgtgatccgtcagttggatgctgaggcaatcgcagacgatgcaatgcgggtggcgcagtgacccatacgcacacatttgagataccaggtgagttaccgagcctgaacgagtacaccggctctaatcggcaaaacaggtacgctgggggccggtccaagaagatagccactgaaacatgctgctacgccgtcatgggggccatgaacctgggactagacgtcaagccaccgttcaatctgcatatcacgtgggtgactaagaacaacaagaaggatccggacaatgtggcgtttgcagtcaagttcattctggacggtatgatggctgcggggttgatcgagaacgacggtcggaaacaggttcatgacatcgaacaccactttgaaacagacaaacagaatccacgggtgatcgtggaattggaggaagatcatgaatgatccagcaggtgtaattaaaaaaatcaatgaattcggagcttggattgctacggtgccaagcccgattgataatatcattttgaccgtgcaagacgatattctggaagaggaagctgaggcaagttacgggatggggttcagcaaagtgattgaacagagtaaagatcgtgccgttgctttaaccgttgtttcaatcgatagactggccgaaatgggcatcaagccgggtggcaatttaaaacagattcacgtggttgaagttggtgaaacgggacagatcaaaagtcagataaccgttgatgatccattcaaggaggcagaaagacgagcataactagttaaaatttcagcaaaataaaagccgctattaatttaaatagtgacttcaatgacatctatatttggataaatagaaactgaaaatggttaatttaatatggccacaccaatagacaagtatgtggcaaatagtatccaaataaaatacggaatgagtaaataggcggctaatttacttgatttataaaagttagttacacatagcagcacaataatatccaagataacgattattatgacgccaatccagtattgcaaattattaaaaaatacaatactccagatgaaatttaaaaatagttgaattccaaacagagaataattcatagttttatcatgtttagagtaactactacggtaaatcaaatatccagagatggcaattaaagcatacaaaactggccatacaatgccaaataaatagttaggtggcgataggggaggtacggatagatgattatagatgttttttatgtctcctgcaaaaagggcggaaagaccgccaattatctgaattgctacaatccaaataatgagatgtaaccagttgaatctagttttactatctttagtcatacggaacgcctccttatctgattaattaaagtctaacatgtttacttatataaactaaatgataacaactaaaattatcataataaaatttatgtattagaaatataaaaaatagccgtctcgggcatgagacgactatcggtaccacttttaaattatccacaaaacttattatagcgctattttaatgataatggaatattcaaaggagtggtacctgtgtcattttggccagaagtagatgaggaacaaacaattaaaaacgttgatggattgttaaagaattacccacattatcggatgcgggctaaacgagaagctgggttattacgatcaccatcaatggacggtatgccgaaagcggatagctatgataaccgcgtagaggaagaatatgttagccatgttgaggcacaacaagtcgaattgaattgccgctatgcgattgaatcaatcgaagataacgagttgcggactattctacacgataagtacttgcggggtgataccaacgaagcaatcatgattaagctcaataatatgccaaaggaaacctatcggagacggtggcacaatgcttgcttaacctttgccgaaatttatgggattcaggaattacaggtctttaaaacagctaaaacgtaaaaaagtgggtctattttgggtctaagttgggtctcacagcaccattttttgagttatgctagtagtgttgattggtggataggtaccgcgccaagcagttatccacactaactacttatttttctcctttagcaaataaatgaaacgtacattccagcaatacacacatcaatcaacgtgattcagtcgtttaattggtaagacggaaaatgtgggttcgatccccacctgaatcatagccacggcacacatggaggtgggaaagctcccttctgacccgtggcgtcaacgatgggtttcatatttggtcgccttagcaggggcgacttttttaatacaataggtgaataacatgaaacaaacagactatggcttagtcagctgccagtttgagcgtgatatgattgctcgtgctgacaaggccatcaaacaagacaagcgtcgtgctaaacagcatggcgcttttaatatgcataaaaaagtgcacaaaaaaggcggagtacccacacaaactccgtctacgttacattaattattcatctttattacttaatttttctttgacattttctgcggcacctttgaccgtatcttttgcatcgtcaagtttttccttagctttaccaagcacaccctgagattttccttcagcttccaattctttgtcaccagtaacttttccaccgacttccttagccttaccagctaattgatcctttttgttctcaaacttttcttcttgagtcataaatgaatctcccttcgttgaaaatgtaatatgtgtccgctgtcaggataacaaacatgtacttaaattatcaaaagatatgctcgaaaggataaagtaatgaaattataatgataattctcacaataaaacggaggtgtggtgatatgtaatggcacgtaaaagagacccggcacgtgatgaagcgaaacgaatgtggcttgaatctagtaagaaaataccattgaaagatatcgctgctaaattaggtaaaccgcctagtcaagttcgcaagtggaaatcattagatggttgggattctgatagcacaagacgagtaaataaaaaggaacgaagtaaagggaacgttaccaatgggcaaagggaacgttccttttcaaatatcacggaagaattagcaggtaatgatgaacttactgacaagcaaaagatgttctgtttgtactatttgcaacggttcaacgcgacttgggcttatatgcaagcgtatggtgtgaactatggaacggccaacaccaatgggccagccttactggtaaatactggtattcaaaaacagctgactgaactcaaaaagtcggttgcatatgatcttcatctaactgttgttgacattgcccacgagtatgccaagcaggcgtttgctgatatgggtgactacgttaattttgtgacgaccgacacgcctatctgggaacgcctctatcgtaaaaatgggccgttcattgataacaacggtcattacgattacgtagaggttactgatcccaatactggtgagcctgcgatgcacacgaagcacgaggtgcgattcaaggaccaaagtatggttgatacctcacttatttcaaaggttaagactgacaaaggtgagattgatcttgagttgtatgacaaacagaaagcacttgatgcactgactaaattagttagtgatcagcaggcaattaaagctgctaaaatccgtaagcttgaagcggaagcagaaattgctgaaattaaagctgaacaggctaaaaagaacggcactgagttaacacagccaattaacattgttgaccgttgggagagtgatggcaatgacaccgacgattgatatacagaaagaagttcagcctcacttcaaacgagtatggactactagaaagccgtataacgtgcttaagggcggtcgtaactctttcaagtcctctgtgatagctcttaagctagtttacatgatgatttggtacattatgcgtggcaagaaagcaaatgttgtagttatccgcaaagtgggtaatacaatacgtgattcaacttttttgaagatacagtgggcattgcgaaagtttggaataatgtgggcatttgacctgaaagttactccgttcagaattatccataaagcaactggatcagcgttttacttttatggccaagatgactttcaaaagttaaaatcgaatgacattaacgatattattgctgtttggtacgaagaggctgctgagtttgatagtgcagaagaatttgaccaaacaaatatcactttcatgcgtcaaaaacaccaattagctgataaggtgtattttttttggagttataacccgcctcgtaatccttattcatggataaacgagtgggttgaaacgcttgtcggaaatgaaaactacttagtcgattcatctagttaccttgacgatgaattaggaattattggtgggcaggtacttgatgaaattaatcgtattaagaagaacgattatgactattacaggtatctctatctaggcgaggcagttggactaggcacaaacatatacaacatgactttattccacccgatcaaagaaataccaggcgatgaatacttggttaacatttacactgggcaagatagtgggcaacaggtttcagcgactactgaattgtgtgtgggcttaacgaacaaagataatgttgtcttgctgaacacttactactattcgccagttggcaagtctaacaagaaagcacctagtgattttgctagagaactacatgacgttgagcagaaatggcaaaagaagtatgacatgtctttttggaaaatgtcggctgatagcgcgacgtctgattttgcgttagaccatgaaaaagaaaagatttacaacgaaagctaccatcatgtgaataagaatgttggtaaagagcaaatgatagataacgtccagaacttattagcgtctgggcgtttttattatattgatattcctgaaaacgaaatatttattaagcagcaccaacaatatcgctggaaagaagacacactggaaagtggcaagccacaagttatcaaagagttcgaccacacttgtgatgcgtttcagtatgtggtgctagataacttaagagacttcaaactcaaatggtaggtgattgaatgtttgaacgtattaaaaatctatttagaaaggcaggtgcaaatgtaggcatggttaaatcgttgactaatatcactgatgatgatcgaatcaatattccacaagacgaatatgagcgtattagagttgcttttaattattacaagaacgagttcccaaaagttgattataaggccattggcgatgaaaaagagggtgctgtaactaaaaaacgtgctccacgaacactcaacatgactaaaacgtctgctcgtaggatagcaagcatcgtatttaacgagaagtgcaagatatcttatgaagataaagcgctgaacgagttcatgaacagcgtgtttgagtcgaacgacttctttaatctgtttgagaccaatcttgaaaaaggtgtggcagcaggcggatttgttatccgaccttatgtggctgacaacaaaatcaagttggcttgggtaagagcagaccagttttatccgttgcgctctaacacaaatgatatttcagaatgtgcgattgctagtaagactcagcgaattgaaggacatcaaacagtttactatacgctacttgaatttcatcaatgggataaggacgaaaatggcaatgatatttacaacatcactaacgagctttatcggtcaacatctaaaaatgaagttggcattcaagtgccactgaatactatttatgatgatttacaggaaagtgtgactatgacaggcttaattgctcctatgtttgcatatttccgttgccctggtgctaataactgtaatcttgaaagcccgcttggtgttggcgttgttgataatgctaaagaccagctggacgacatcaacatggttaacgacatgacctattcagaaattaagttaggtaggaaacgtgtatctgtaccagcaaattatttgcgatatgacaatgatgttcataagccttactttgatacagatgagcaagtgtacgaaggattaggcggttccgattcagataagatacaagatttaactactaacttccgcattgttcagttaaaagatgcaatggatcatgcaatcaagaaatttgaaactcaaatcgggttgtctgctggcacattcagttatgcaaatgacggtgtgaagactgcaaccgaggttgtttctaataactcaatgacttatcagacgagatctagttatctgacacaagtggaaaaagttatcaaagcattgtcggttgctattattcaattagcgcaggcgagccaattctatgatgatggtaagccattgtttagttttgagatagaatctgctgatgatatgggaatgactattagttttgatgatggtgtgtttgttgataaagacaaacagctcgaagaagatttgaaagctttgaccgctagagcattgccaactaagcaattcttaatccgcaactatggtttgagtgatgttgaagctgacgaatggctagacgagattaaatctgagacaccagaaccatcaacacaagctgaattaggcacttttgggagtgaataacaatggttacgtcagatgatatgtacaacaaggcaaataagattgctgattattatgctgatttacaacagaacatattcaaattaatagttgatatatctaatgacactcgatctctactgactgacagcgatcatatacttgaatggcggcttaagatgttgtctaagatgggtggattgaccaacgatactataaaaatggtgtcaaaagcttcaaaggttagtcaaaaaaagatacgtgagcttattcaggctgacggattgaaagttgctgatgaaataaatggtgatttatcaagtatgctcaataaaaaagtcgaaattagcaaagatattcatagcttgattaatagctatgcacaccaaacgttcaaagatattgataacaacgtcaatcagactttattaaccactaattactcacaaaatggcgctgacaaggctttccaagagattgttaataagacagtgctagaagctcaaacaggacttaaaacacctgaaagagcattagccgacaacatctataaatggcgtgcaaatggtattaaatccaatttagttgataaaggtggtcatcaatggtcacttgagggatatactcgcacggttattacttcgacagctcatagaacgttcaatgacgtccgtattcagtccatgaaagactttaatagtccactagctgtaatgagtagtcacccagccgctaggcaagcgtgtgcttatatccaaggacatgtagtcaatattgttgcccctgaaagtcctgattataacgacaagtacgattcaatttacaatcatggctacggtactgctgcgggaactcaaggtgtgaattgccgacacgatttatacccgtatgttgagggcgtatctcataactttcaaaagcagtatgacccagaagaagcacaaaagaatgctgatattcaacaaaagcaacggtattatgagcgctcaatcagagctgctaaatataagctggaactagctaacgggttgaaagatgaacaaggccaacgtgcagctaagtcaactataagtagttatcaaggtaaactaagggatattgtcaagaacaacgacttcttagcacgacagtacgctagagaaagaatagtcaaataacaattcgccccagacacggcgttaaaaggtctattttttatgcaatcaactaggcgtgatcgtaatcacgtaaataaacgaaaggggattttgcatatgtcgcttacacgcgaagatttaaaacaattaggtatcgagggtgatgcagcagaaaaagttatgtcagagtacgggaaaacacgtacggaattgactgatgctaaggcaaagttggaagaggcaaacagtcagactgaatcgttacagtctcaaattgacgaacgagacggtcagttagctacgcttaagaagtccgctggtgacaatgaagagctgaaagagcaaattaagtcactgcaagatactaataagcagactaaagaagaatatcaaggcaaattggctgaacaaaataaagcgttcaagattgacacttacttgcgtgatgctaaagctaagaatcctaaggctgttaaggcgcttttagatgctgacaaggtatcagtcgacggagataacttgattgggctagaagatcaagtcaagagtattcaagaatcagatccgtacatgtttgaagtagaagaagataatcagaatcagaacacaaaggttaatgcttttgctggtggcaatccgagcggggacacgggaaaagacgatatttctaaaatgaattatcaacaaatgcttaattttaaacaatctaatcctaaagcttttgaagctgctaaggcagaagcagataaatagaaaggaaatgatactatatggctgatttaacacaattagcacaaatgattgacccggaagttatggctactatgcttcaggcacaattaccacaatcaatccggtttacttcgattgctcctattgatacaacacttgaggggcgtccaggcgatacggtaacagtaccacgttacaaatatattggagatgcgcaagatgtcgcagaaggtgctgcaattcagtacaaccagttgcttaccgctactcaaaaagtaaccattaagaaagctggtattggtgtaaagctgaccgatgaggctgttctttctggttatggtgacccagttggtgagggaactcgtcaattaggcttatccattgggtctaaacttgacaacgatattttggcgactgctaagacagctccacttgttgttcaacatgcaattgatttggacttgcctgatgctatctcaggccagatgatcgactcaacatctgatttcaataccgaaacagatgatacagccacgggcgtattattcttgaatcctaaagatgcaaatgctttacgtaagctcgcagccgcggattggactcgtgcaactgaattaggcgattccattttagttactggagcatttggtgagctgttcggttggcagattgtccgtacacgcaaattggcagttggctatggtattgctgcacttccaggggcaatgaaaacataccttaagcgtgggattgcattggaaacagcccgtgatattgattacaagcttacaaaagttaatgctgatgagcattatggcgtagctatcatgaacgacgcaaaaattgttcaaattaaaccagcatcaggcgcagcatcaggcggatcaagcaactaatattaaggaggcatataaatggcctacctaagttttgatgagtataaacagatgggttacacaaaaataagtgatgaggatgcttttaagaagattgaaagcaacactgagcctttgttcgatgttgtaactcatttttactacgtggataatgacattcaacaagatacagacagcactagagtgaagttcttcaagcgtgcattagctttacattgtgattttgcacaagagagtggagcaagtacaccgtatgaacttactcaacagcaaatcagcagcgttagtgttggacgtactcgtattgagcagtctggtacagtaagcaatgtcacatctggaaagtcgggtatttatactgttgcaatgcgttatctagctagaacaggtttgctatataagggagttggttggttatgatacctaaattccctaaaagtatggcaaatcagcagattacattgagaaagtcaacaggtcagactgatgattggggtaaacctgaatatgagcctgatcaaactataaataactgcgtgtttcaacctcaaacaatctattccggtaccaacgacaatcgccagctagtagctaacgcgattgtttttttgtatgccggagttagctcaccgatgccggtattgtctaaggacaactaccagtcggtgatcacgtttgagggtcacgattacgcattacagacgatcgtggacaatcgtgatccatttagtaatgagctgtggtcgtatgaactggaggtgctgtgatgcctgtacatgttgggtttgatctaggtggatttgagagtaagttcacgcagtccaatctgcgcatgggacgtttagcggcagccggtgatgcacaccaagccatggagcagtttgtgcccaagcagagtggcgatttgcgtgagtattccaatgtgaatactgatggtagtgacatcgtgtatgccatgccgtatgcacgaaggcaattctaccttcaagcgccagccagccattatcgtgaaccaggtacatctgggcgctgggacttacgtctcaaaggtgatcaacagctcatgaataaagtcacagaagcatttgtgaagggggccaactggaatggatcttgagcaacgtctgtttgatgccattaaggccaataccggagtggcaatcaagatgggctatctgatcccaaacgagggcattggattagttccggctcctggtagtgcagtgattgatgaggattacgctggcaatcaagactggcggtacaactactcaatcaccatacgtacgaatgaccaagaatcagcaggtgaaagcctgtttgctatccagaaatacttggatggcttaactgaacttaatagcaacgacaacagctttgtctttcaatcgttgactgtctctagtgctcccgcattaattatgcaggataccgaaggcaactcaacgtttgcactagacatggctgtttttgtcggatgcaacaaatatgaaaaggggtaaataactcatggcaattgtaaatgaagacgcggcaactactgggaaaattggtaagtttacgctgaactacaagaacaaattcgaaattgatatttcggggcagaccagcctaggcaatgttgacaaggctgaatggaagcccttggcggcaggtattaacaactcaacacctgctgctaacgacacaaccaccaacgacgaatattacgacggtgaagggtttggaacgtcagatgtgacgtctaagcgtctgcaactcacactggctggtaatcgtctggaaggtgatccggcccaagactacattgcggccaagcaactagcgatcggtgacgatctcaagacgttgttccgttggactcaaccatcaggagatacgatcactggtgtaatcacattgactagcattgtgagttctggtggtgctccaggagccaagcagacgttctcagttgttattgtgttcaacggcaagcctgactttgaaccagcttctacggaggacactccagacccaaaacaatagccgtcacgggtgtaacagttacacctacgacggccagcgtagaagtcggcaagacaactaaattatccgcaacggtagcaccagatgatgccacaaataagacgattgcttataagtcgagtgacgagaaaattgccacggttgcaagtgatgggacggtcactggtgtagcgactggatcagcaacgatcactgcaacagctgatggcaagtctggtacatcagcaattacggtaacagctgccgaataggcactgatggaagacagagacgagtaaaaaatgagacgtaaattaaaggggtaataaatcatggcaattaacttagacgaacggattcaaaaccgaaagagtttcattattgcgggtcaagaggtttctattccaatgaacgatgcttttgctaaacacgtggccgaggtgaatatggaaatcctcgacgtgcaagacgagattagtaagctcaagccagaagaggcaaatgagatgtcactcgatgaacagaaagcatatgtgtttgacaagtttgatcaaattagtaagaaagcacgcaagtttttcgacgatgtaatcggtgaaggcgagggtgatcgaatctacaagtattacagtgaggacacccaagcaatggcctttatcatcaatcagctggataaagagtcaaccaacatcctagtcaagaatcgtcagaagcggcgtcagaagtacaccaacaacaaacggcggtgatgatccttgttaagcctaactaaggagttagagcactcatttgagtacagggggcatcgctacgagcttgatctgagttttgacaacgtgctgcgttggtatgaacttctggaagatgacgggattgacgattatggcaaagtgtcaatggcatttgagatgttctacaatgcttgtgcgctggattctgatttgctagtgactggtgtggatgcgattgctgattacatccatcaagagccatacggccactacgaggacaatacaggtgtgggcaccagtgatccaattaggtactactcatatagtcaggatgccgacgccatttattcatcgtttgttgaacagtacggcatcgacttgattcagcaacagggcaaattgcactgggacaagttcaaggccttgatggccggacttaatgacaaaacgtatttcaggcgaatcctaagtattcggatgcgtgatactcagggtatggaaggccaagaggtcgctaatatgatggagctcaaacagtactacgaactcgatgataatcggtccgttgaagtccaagatactgccatgaatgatattttctctgcactaaaaaatgaagcaacacgttaattaaaaatcttgaggaaaggaggaaatataaatggcagcagatggaagaattacaattgatttcgacatggatcttcctagcattaaatctgatgctgatcgagctaatgaagttctgcatggtattggttcaaccgccggtgacaagatggacgaatccatcaagtcaaatactagtaaggccaaagaaacggtgtctgatttcaagaacgacatggaccgcaagttttcgaaagaaaccaaagtcaaacttgtggcggacgctgaaacagccggaatcaagaacttcgagacaatcctccataagttacctaagaaacagcaaactgaactgttagctaaggctgaacgtggcgaggtcatcaactatgaggagcttctccggaagattccagccaaggtagccacgcaggtcaagctaaatgacaacgcttcatctggtctaaagtcaattcagagggagactcagcagactgaaagtcgattcagtcggctcaaggacgttatgctaggcacttttgctggtggtttagcgttgagtggtattcatgcgattgttagcggcctgaaagaggccacacaagctggtatggaatacaacaaggaacaagataccatgaagaccgtatggacggccctcacaacggaagccccgaaggacggcaaggaattaatcaactacattaattcaatgtcacagcactccatttatgccgctgatacgattgacaagatggcccaatcgttttatcacgttcattcatcagtcagtgaaaccaaggactggacaaatgcgttcattcgtttaggttcaacactccatatgagcaatgatgcactggccgaatctggtgaacaattcgctaagatcgtggctggtggtaaggcgtcagccgaagacatgagcgtcatgattaatcgattcccaatgttcggggaagccttgcagaaggcaaccggtaagagcatgaaacaactgtatgccatgagtgcggctggtaagttatctgcaactcagttcaccgaagccctggactacctaagtaagaagtacaagtcaggcacagacgaagctatgacctcattccaaggtatgtcaatgtacatcagttcacgttggcaaaccctttggggcgacatcacgagcacgtcgttcaagatgagcaagaaatcccgacaagacattcgtgatttactatctgacgacatgatgaaggagtacgctcaaggtatttcagctgcacttggtagcgtgtttgtatgggtatctaaggtacttggctatattaatgatcacaagaagacgattgttgatattaccggcaatttaatcgagttactgggaatcattggtaaatccgcttgggatttatttgcagacacgatctatgatatcgccaagatgtttggattagttgatgacaatggcaagaagactgttgacccacttaaacagatcaatgacgtactacaagcccttgttgaccacaaggcgatggtacaggatttcacgaaagccttaattgctatgtttgcgattaagaagattactgacttcatcaagtacattggtgaagctaagacagcattagagagcttttcagtgattcaagccgctacttcatttttgggtggtggctcaggtgccaaaggtgccggtaccaaactagtcacgaatgctgcggaaggtacaactgtttcaggtggtgagaagattgctgctggatcaggattgattgccacagggacttcactaatcagtaagattgccaaggctagtccttatttagcagcaggggcaaacgttgctactgaattaactagcaaaaatgggactggtgcaaaaattggtggatcagccggttctatcggtggtgccgccgcaggtgctgcacttggtacggcagttttacctggtataggcacaatattaggagcctcagccggatcctgggtcggcaagaaatttggtgaaggatttggtaagagtttgcaggattctgtagacggcaaaaagctcaagccaaaaacaatcaaggccaacgttaaaatatctgcaagtgctaagtctgcgcagatcgacgctgataagcttagtaagcaacttgaaccatccatcaaaaaattggataaaaagctagtagtaagcactagttatgattcaaaaagtatggccagtacaaaggcggctactgaaaagctttattctgatatgtctaagtcaattgactcgtattacaaaaataaagaatctaaatcaaaaaaagatttggataatttggttaagcagggggtcatgactcaaaagcaagccaacgacgcattaaagaagcaaactactgccgatcagaaagaacgtactacaaaacagaatgcactcaaacaaatgcaaaaagatcaaactaattattatgcgcaggttcagaatattcaaaatggcggaacgaagaaacttcaacaaatcgcccaaaagtatggcgttaattccgaaaaatacgaaaaagaaaaaaacaaagagcttcaaaaagcccataaagatttcgtaaatacgtatgttaaagatgaaaacgggcttaacaccaaagttaaaaaagacgttagcaagggcgccaaggaacaaaaatcgatatatgatcagttaattaaagacaaaggcaagcttaatgctagtgatcttaaatctacgcagaagcacgctaatgatctgtacaagacgtctgtgacgtcagctcgaaaaactcgtgatgatgtaaaagatgcggcagatgatcagtatcacaaaaccgttgccacagcaagaaaagagtggaaagagaaaggtactattacgtatgcacagtataaagaggttaaacataatgctgaacagcaacgtactgatacaaaaaatgcggcagatgatcaatatcacggagtaacaaaaagcgcacatgatcagcacaccaaagttacatccgaaatcactcaacagaaaaaagatgtaaaaaagcaggccgacgaacaggccaccgaccacgtaaacgctgctcaaggtgaaatgactgaggttaatggtcaatatagtggcggttttgattccatgcgtggcatttggaacggaattgcctcaggtctaaatagcgtacttaacgcactccacaaaggttggggtaaaattccaaagattggtaaacatgcacgtggggcatcaggactatctactagcgaaattgcacttgttggtgaagaaggatttgaacttgctcataatcctaatcgtggaatatttgcgttaggaacaaatgggccagaaattcgtcatttggatgctggcacatccattttgccacatgcactgtctcaacagtttctgtctatgacacatggattgcctgcatacaaggacggtaaatctggaactatcacacaggcatatagctggttgaaggacaagctggatgatgttatgtcctttgtctctgacggtgcggacaaagcgtttgattttgttgccgataaattgggcttaagaggatttttatccaagtatgatgctgctcaacatgatctgatgcagggtgccagtgattcaactagaaaaggtttcattgactatttgaaagagaaatttgataagtattctgaagaaagtactgaaatgaatgctaatggtacgagtgcaaaggccactggaagtcatttaaattggttaaagcaagcgggtgtacctgattcgtggaccagtgcgatggcgtggctaattaatgccgaatctggatggaatccacatgctcgcaacggatcgtcaggtgcttatggtattccacaatctttacctgccagcaagctggctagtgctggtaaagactggcgagataatccaattacgcagattaaatggatggtcaattacattaagggccggtatggaaccgctatggctgccgaatcattccacaaacgggttggttggtacaacgacggtgggtggagcattcccggtaatttaaatattttcggtgaagacattactcagccagaattggcaattaaccctgcacggaacaccgcagatgaacatatcttgcaggcgatccaagcacgtgcggccaaagcaccgaacagcaccacagctcaactggctcaggtgatcgaaaatgctaaggactcaggccaagttgctccaatctggggccagcgggcatcacagaacatcaaagtggccactggtgacaactcacacgattacacaggccatctggacaacgtacttaataagctggatacgattgctaacaagtcgcttgaaatcaacggccacagcttttcaaagacgtacgaggcctacgggtctgcacgtcgggtacagcgcacacaacaagcacggagggggttagctattaatgtcaacatctaagaactatggattcacatttaacggccaccactctagtgagtttggtctgaaagttctcaacactaagtcgatggtgttgccagctaagactaagactactgtgcaggtgccgtatcagaatggactgctcgatctaagtgatctgtatggatctaacacatttggcgaacgtacgatcacgttcccttgtcggttagacattgggtacaacgatcgggaccgcttgtacaacacgtggactaagatcgtcaactggttgatgaatcccacgggcaagcgagaacttgacgatgacgtacaatcggacttcttctacaaggcagaagtgcagacggcgcccacaattagtgagatgtcgtctttttgttacctcacaatcgagtttcaagcttatccgtaccgcttccacgaacgagctgacgatctttgggatccgttcaactttgactgggatgtggctcaacgtacgacgattgacgtcagcggagtgtcgtacctcaacttgattaataacggcgaaactgctgtgacattaatgatagaggcggatggtgaacttacactcaccctcaacggggacacattctcagtggcacaaggttcaaccaataacgatgagatcatgctcaacccgggtgagaattcgcttatgataacgggtaacgctcacgtcacgtttgactggtttgaggaggtgatctgatggcaggacatggctatcgggttacgattcggcaaggttgggacggtgaagagcatgtgatccattctgagcgaactgacaaattcagattgctgatgtgtcaggtcacgaaagacgtgaccgcctatgattcgctagaaattcagatcacgccggatcagccacagtacgccaatttccatcagtttacgacgttcgttaaggtcacacgtccggacctccagaagactatcttcgaaggccgcgtcatcactcctgatgatgagatggacacagatgggtctatcttcaacgatgtgatctgtgagggactagaaggatttctacatgactccgttcagccgtttgctgagtttcacaacacgacgcctaaggattttctccaagctatgatcaccaatcacaacaatcaagtagacagttataaacagcttaagcttgggactgtgacagtgaccaatagtacagataatgtgtaccggttcctagaggacgataaggacacctatgacaacattactgacaagttgattgactcgttgggtggagagattcgagtacgtcatgaatctgatggcttgtatctggactatgagccccagatcggtgggcagtcagctcaaaagattgaactgggaaagaacctgttgtcattacaacgagcgatcgatgcatcgactttctataccgcactcaaacctttgggggcgactcaagaaccagacacgacagatgacagcacggactctacggacgtgtcctatcctcgattgacaatcggtggtgatggcttgatccgtaacgaagcgctgattgctaagtttggcctgatcattaaggctaatgactgggatgatgtaaccacgcaagcagatcttaagactaaaggtcaggccatgatggacgcccagaagaatcttaaaacacagatccagctcacgtatgtggatttgagtcacatcaacaaggatttggactcatttaacaacggggatactgttcagtttattagtcagatccaaggaatcgatctaatcgaacggattactggcatggtgatcgactgtgtggatattgcttcgtcaaccatgacgattggtgaagacgatatgaatcaatcatcgtatgaggctatgaaccttgctcaggctaacgcggccaacaagacactggctaagatgattgacgctcaagctcaacagctggccgagattaagtccaacagcaacacccaatatgaggagttagttaagaagaatgctgagttacaagcagctattgaacagcttgaaggtaagaccagtgcagacggttcaatcatcgatattagcgagttccagtacacgattgactgggatgccttggtgaacgcaggtgtggcattggctgcaatcagaatccagcacggtacaagccatgaggatctgacgtacaagactaacgtgcccgctgctatccagcgagacatcaattacgcggtctatgcctacaattcggccatttcaacggatgatgcggccaccgaggccacgaacttctacaatcggtcccaggccgtgattggttctggcaaacagccacgattctggatgatcgacgttgaagagaagactatgagcgacatgcgagcctgcatcacgtcgtatatggacacgctcaactcactgggtgtccctgatgacaagattgtgctctacatcgccaatcaactgtatgactcattcaacctcgacgtgtcgcgcgccggggctatttggattccgtcatacggtcagaatgatgggacagtcgcaggaagtgacaagcctgatcatccatatgacttgtggcaatacacaagtaagggacacattgcagggattacacaaaacacagtggatttgagcaccgatcctagtgcccgatttaaagaaaactatcttgattgagaggaggtagaaaatggcaacagttagtgggtcagttaactatgaagattcaacgccgattcctgagcaacaggagtacacaccaagcaacatccagccgattgcgattgagttagctaagttcattcggaccaagatgtatggtgctgatgtacgcgagtcgttagctcgatggattgagatcatgctggcagtgcagacgtacatcaatgaggacgagacggcgttcaaggttaagatccagaatcggcaagagggcgtggaagatcgtcaaactcaagtcgagcagaagatgagtgacgttcttgaccaattcaaggctgtcattgcaaacagcactaaagacagtgaagtaattctggctcgtgattcggtgcgatatggagatttttcaactcttgatgatcgacttgaatggattgaaggggaaatggcgcattacgtgccaactggttttaacgtcacaatcaagcacggccagaaccgacagcctaaagttgtcgtgcactattatgagtatgcgattggaaccgagacggacggctttggcacaggaccttatggactgggtgagtcagctgtacagacgattacttgcaaagtggattatccagatgacgacacgtgtattgtacatctgccaattgcatttgcacttacaggtgttgtcacctacaaggacggttactggtatctgatcgatgggtgcaagacgcttagatttgatctgggcgatgatattgacgatgccaaagcaacatccggcaacggcagcaatcaaacgtcaacagactcaagcggcgccggtgataattctggcacaggaacagataccgatgatacagcaattccggaagttagaaatttaaaagtgacatcagttgatgacacaacagatcaattagattgggaaacggagtaaataattaatggcaatttcatacaatatctatcaaaaagaaggagacgcgaccgactggactaagttaggcacggcaacggaaaagacctataccgttaacaacttaaagcctaagacggaatatacttttgccgtcacggccacaaacggattgcgcgaaggcgacaagacggcggttgttactgttacaaccactaacattgcaacgactgccgtaactcttgcagttgatactaagtcgctagaagtcggcgggacagctaaggccagcgttacgatcacgccagccgacgaaaccgatgggtcagcgtcctatacgtcagatacaccagcagttgcaacggttgacgcaagcactggtgcaatcaaggcggttgcagaaggcaaagcaaatattacggctaaggttgggactattacgtccgcagctatttcggtcacggtatacgcggcactggttactgtaactaaattagcggcgtctgggactaccccaacaggtaccacactaacgtggtcataaagaggtgacaaccgatggctattagttacaagatttataacggcacaacactattggcaacaatagccaccaagtcgtacacggttacggggttaagcccggcaacatcgtacacacttgatgttgtaccaaacaacggtttgcgagacggtacaaaagccagcgttacgtttaaaacgcgcggcgtgcagcttattattcccgaaacgttaacagctggcgcgaccgtaagtttgcgttaccaagaatattcgttgggactggttgcaattggatcggagccgtcgggtatgtttggtggcggtaaccaaaaaacattagcggccacggttattagttcaagcggtggcagttcagttgttgaattaactaccagtgataccagtttcgcagatcaaaccgcactaacaatgcaagcagatggcacatatgccgcatttaacggctatcacgccatctattttggtggtgggggggtaacaccaacctgatcaatcatgatggtgagttggcccacaccgtgctcaatgtgtatggagatcaaattacttatgaagatggtagtttaatggccaataaaattaaagtggtcgaaggtgaagtattgcattttcatgctgaaaactacagttcttcaaggttgttccggttcaacacttatgacagcgacggaaattatattagtcatttatattttagcagcgaccaagattggatggttccagatggaacttattatatttgggtcagctatcctaacgtcggtgacgtcagcttaacaattaaagcagactattaaaaaaggagatttttaaatggcattaacatctattacgacgggcatggaaaaaggcccggaagcgattgacgcaaattttaaaacactaggacaagtgggggatttaaagtgtgttgcaatgtcaacagtttcaacggtgctcaacgggcttacccaatctggtgacggtccttgctcgttcgaaattgttgacccgattaatcgcattgcgaagatttcttttgaaatgtcggttaattggcctaaagatcaacagaaagcgggaggggtggccgcatatggtactcaagatgttttccaatttagcagttcgttttttaagtcagtcgtaccacacacaccattaacaggaaaatacaactttaatgggtggggaaattgtaacattctgacttatatccacgatcatactgttggtttttcggcaaataacgggcaaggcttagataccggtggtggtgctggtgttgcgggctcgttcttagcgtactactaattagaaagggaataaataaatgcaaattgaagttaacgaaaaaaatgaaattcagttttacgcattaagtggaaaacttaacaacggaattgaaattgatcagtcaatcgtacccactggatttactgtcggaaattttaagcctggttactatttgtactcaaatggtgcaattgtagttaatccaaactatgttgcaccagttttgccaaccggccctggattatctgatgttgataaggcagtcgcaacactaacattgcaacttgcacagaataaggccaatcaagataaagttaacgcacaactattactagcaacggcacagcaaacagcaaaggagacagcataaaatgaaagatttagtagaaaagtattacaaacaaggtcaatatacagccgacgatatgaaagtatttgtaagagcaacgtatattactgcagatgattttaaaacacttacaggaacggactacgcggcctagtcctttttattttggagaaaagaagtgatgaaatttgggcccacattattttttcggtcttgcttggtctgaagttgggacaattattggcattattgtagtgctgattggtttatttatgtggcttagtcggattgcaatcacacaaccgatggaagtctctattcgttcattgatggacaccattgaccggctcacgaaaaacattgagcgtcttggaacacgttatgacgaattagataaacgcctcgatgctcaagatattcaattgaccaagcacagtaaagatattaaagaactatatgatcggactgaaaggaagtaactggaatggatttaaacagtttaaatttgggaacgtcgggtgaagtagcagccattgtggctgttgttggcctgatcacccaagtactcaaaaaatggacaagcctagatagtaagtatctgccgtggttgtctgccatcctgggcgctattggtggcttagccgtcttcggttactttggtgacaccaactatcttaatggcgcactactaggcttgttggcaggtggcgcaaccagtgggctgtttgacgggctacagccagccgttaaggcagtggccacaacactacaagccagtaaagatgccaaaacagttcaagcgcaaaccgcacaggagcagggtgtgagtcaggcggtgactgaatacctcaaagaacatccagaagctttgcttgcggcggccgcaagcattacaaagaaagcaggtgaaacagcagatgacggatcacagactcaagaagcaacacaaactactcaatcacaagctaactaagacagctgtcgcaaccgcggcggcttttttagtgggcccaattctggcgccggttactgcacacgcctatacgattgaccaaacgtatgcactaggggccaacggcggcaaacatgttcggacggccaacaactatattgtggcgcatgatgttggcaccgattcaagtgcgatcaacaacgcacagtttgagcaccgtacctggtcatccaatcaggcatatgtcacgtatatcgtcggtgacggcggccacgtttaccaaattgggacacctggtcaagtagcctggggtgccggttcgtatgcgaacgcaaattcaccggtgcaggttgagctggcccacacgtccaacgccgtccaattcaagacggactatgcgacgtacgtagccttactgcgtaacagtgccaaggcgtatggtctgccggttcgactggaccaaggacgtgggatcatcactcatctttatgttactcagcactggtggggcgatcatcaagacccatacggttatcttgcacgctggggtatcagcaagactcaatttgcgcatgatattgcctatggtgtgactacaagtggggtcaactcgactcagcaagccgtcacaggcaccacacagaccacgacgactcaatcgagttcacggatcagtgtggacggctactgggggccagcaaccactcgcaagctccaggcaatgtatggcacccctcaagacgggatcattagcggacagtatcggaatgcggtaactaatcgcatgactggcgtccactatgggtcacagggatcgatggtggtacgtaccatgcaacggcgactcggtgtgcgtgttgatggctatcttggaccgcagacaatccgggctatgcagagacgtcttgggacacctcaagacggtgcccttagcaatccgtccatggtcatcaaggctatgcaagccaagctaaatgcaggcgtacggccattttaatgagcttaaacgagcctgcattgtttattgtaaaattgccaatattacaataaagagcactggaaacacaattgaatatgttaaaaagcccaattcttgtgttttaactggtaaattctaccggttagttgcatgaattgggcttttttattttacataaattgattcaatttcgtctaactgatgctaaattctaatttattccatagagaattgtatctacatcttagtttatacaggtacaattcttataccataggaatcctaactattactattttttactaagcttcgcttatcacttaaatagcaccatcctccgaatactagggtccaaatgattgctccaatagcacctacactatcacctgggacgaagaataaactaataaagatggctaagaagaataatattgttaatggacttgtgatactgtaaccaggcattttaaatccattatctaaaaagtcgtttgatacccgatattttctgtgagctagcatagtcattgtataaaccactaaatacatatcactggaaatagcagttacaatattaaatgaagcgacaagaccatgagacaagcttaaaataggagtaataaaaactaatccagctgaaaatagaattgctatagctggaacgccatttttagaaataacacctagttttttcttaatcatagatgttgccgaagcttcctcagctatttggtatagatgccgtcctgccgaaaaaatgacactgtttaaagcagatgaagcagaggttaacactacaaaattaattaccgcagcggcagcaggcaatccggctaatttaaagacttcaacaaaaggactctgatcaggtgtaattgatttccaaggaatgatactcataattacaataagagctccaaggtaaaagatcagaattcggagtaaggtctcattaacggcctttttaataataacttgtggggatttggcttcaccaattgtgatactgacaaattcaataccctggaaggcgaagaaaaccattggaaaggcagaaataaaattaatagaaccttttggaaacatttgaaaattatgtgaaagatttccaaatgaagaagttcccataggtgttttgaaagcgactagagccatgtaaactccaacaattatcatcgaaattatggctacgattttaatcatggcgaaccaaaattctgcttcgccaaaaagtctggcagcaattagatttacggatgtaagaactactaaaaaaataacttcaattaaccatgcagggacaccaggtagccagtactggacatatgtagcaatggcggttagttcggccattccaacaaacacaagccctacccagtaggttatacccgcaaacttaccagctccgttaccaagatatttagagatgaaagaaacgaatgtatgctgcgatggatcagaaaaaaacatttcaccaattgcacgcatcatgaaaaagaaaaataggcctaaaacacaatagactactaaaatagatggaccagtcttgctaatagtgctcccagaacctaaaaataaccctgtaccaatggtaccaccaattgcaataagttgaacgtggcggttacttaatgcacgcatcgtaccatctggattttttactatgcctttgctctctttgataagaaaaaccccctcttgaaaaagcaattatgaagatgtatttaattatcaggtataaagtcaaaaaacagtataggcactatgaacaataatatttaattaattgtgcacaatatgttagtgtagaaatcaaatactatttaaagcaaaaaagaataattggtttctctaaaaaagtggttcatccgagcaacttactaaaatatacacattaccaagagtgtatgcttaatatatgtggatatgttctgttcatacaggaaaatcatgtgttttttacaatagaaagtaatagaaacgcacattcatttaacctcgtctaattgatgttgagaatgctacaaaccataaataggcatttctcaaactgtcatatttgtcgctccgaaacttatattcttcaaaccagtgttctaccgtaaaatctttctggataatgcggtgggtgccttctggtttttttatgattgttagtcggtaaacgtacatagaatcatctcccaattaatacatacgcaattttgtgggcatgcccacgaaatgcccacaaaaaataaatacaataaagtacgatatacatagttggctatataatagaagaaaccgaatcctgatttaataataattcgtttatgaaagaaaatatggtatgaaatgtagagcagaaaaccacctacccagaaatctaaacgaaaaggagctcgttgaaaagacgagttccttttttcgtgttgatcaagctaagtgccgtatttaactaataggaagttagaaacggagtgaacaagatcaatgcagaaatatcgaatttgtagtgttgtattaggcataatcctgatgagtcagtggtgggaaccggtagcagtgttagccagtcaaccaagcatgccaattaaagaagaggtcatttggtcggccgatgaacaggaccgagaacagcaacgggcgcaaaaagatgccgatcaggcggtactagatggtattaccgaactcacatcagttcagatgagtgagaaatcggttcagtatcagacggtatttgaacgtacctttaaccaggactgggtggattaccaagcttattttacgctcggccagacatttgactgggcagtgatgactttacccgaagcattgaccaagttgtcccatgaatcggtgtgttatcaagcgttaatgcgcggcaaagcgcaacgcgaacgccaacccgtcatttcagcttcgacttcggagaaacaagcgagttcgagaacaaagccagaaattaaaaataattccaccaaattagtgcaacaaccggtgcagccgccggttgagaggccggtacaatccacatgtcccaagtttagtcgggagagacagcaaactgaacccagaaaatctgggccaacagagtcgatcacgccaaagtctcaggtatcgaacaatccgtccagtacagagaaggctgtacaggtaattttgccggagaagctgccaataattggtagccaacaatcatttattaaacatattgctcagtcagctcagataattgcagctaataatgatttgtatgcctcggtgatgattgctcaggcggcgcttgaaagctcgtggggaacgagtgacctcagtggccgacaccataatttgtttggtattaagggtggttacaggggccaatctatccaaatgtggacgaaagaagtcactaacgcgggcgtacaaaagcatattttggcagattttcggagttatccaagcgtcgctgcatcgttaagggattatgctgtagtgatgcaacaaccaatttttagaaatgcaaaaaaatcacaaacgaatagttatcaagaagccacggcgtttttgacacagcggtatgccactgatcctacgtacggacaaaagttaaatcagattattaaaacctatgatttaacgcgttatgatcacgcggaagttccatcatcggccatcccccaaaaacatcatcaagggccttcatcgaagtcagccgtgctgaaacaccaccagcagaaccactcttcaaaggggatgagtgcgacgattaaaaaggtgtgttttagtagcgcaggcttaattgtatgtttgctacttaaaaaaggacttaaactgtaatcaaaaacctcgtcaaagttgacgaggttgattaattaaagtgcttttagttttggttcacgaatatctgtcagagcttgatcaatttgatcgagcactaattgaacgttttgtgggttttccaggtcgtacttttggagatccactttgattttaggactcacatcgtattcatcaaaccatttacgataagcagtccacattttgtagtaataactttctagttcagggttattatcaaattgttcatagtcacggccacgttttttaattcgatacaaaattgtattgaagtcagtttcggcatatacgagcaagtctggtgctttcttaggtagttgtttcaaatcgttcatcatgttgtcaagcagtgttaaataaacacctaattctgtatcgctgatatttccctcggcattgttttccttagtaaatagggcgtcttcatagattgaacgatccaaaacgttattatcatcagaaagtgcttttttgatcatggagaaacgcttatttaaaaagtagatttgtaataggaatccgtactgcttgggatccttataatacaatggtagcactgggttttcaccgactggctcgaaaaaggcttgagttcctaaatgatcggcaatcttgccagttaaagttgttttaccaacaccaatcattcctgctgtaattatcaccatagtggcccctctttacacaaatttttacgcaatgcatacatgttactacaattctgattaaatttatatactactattggttattaaaaaagaaaatggagcatcgatccctatggtgacgcatttttatatcgaattaagcattatataaaattattattttttatcatcttgagattgttccgataggaggtcacgaatttcttttaggtaggtttcctcattagatggcacaaccggttcttcttccttcttttccgtgtggaaaaaacgattaataagcttgaccatgagaaaaatcacaaatgcgacgatgagaaagttgataatggaattgaggaaaaggccaactttaaattgagcacttccaatagtccagaccacgttcgaaaagtcgattttgccaagaaacagtcccaataacggactaatcaagttgtcagtcagtgatttaacgatggccgtgaaggcagatccaataataaccccaacggccagatccattacgttaccccgaagaataaattctttgaattctttaagcatagattaattccctccaaaattgtttatctaaaatataacataatccgattgatgaaagttagtcatagaccgttttatatagtagtatgggaggtaatatattgagtgataaggactggcggtaatggaaaacgtagatgaaattaagcaagaactggtgttggcgcagcagaagcaagaattaattacaatttacaactttgatggtgatggcacattttctgttggttacgtcgtggggatagatggcgtttttgtattgacgattggcattgatatggaaggcaaaattaatgggctcaccgccattcgattaagtagtattcaccgggtggcccgtgatacagactatttaacgacggtgcaaattaaacaagacgtggcccgtcaaaatggcttttatgatctgtggcatgtgacggattatttgcagcaaacggattttaaaactgatggcattttggccaccattttgcaagaatgcgtcgagacaaaggaacccctcgtgattggcacacgacagtataaggatcgcgatgactttgaagggtatattcatgaactgacaccaattaaactaatcatgcattatctcaaatttgaagatctcagctcattgtgggaatatgaaattttatgggcggaagttgactatattcgaattaaaggatcgcaagcacatatgtgtcaggcgattttagatcgtgtctttcggtgaaataaaaaggattgaaactcaaattaactgagtttcaatcctttttgacgaaaattagtcgatttcaattgaaccattctgggtagagatgatgactttgttggtggctgattcattttgatttaactgattcgttgcgtcatggtcaaagagttctatatgaccattttgggttgttagctggtagccttgcgtcgttggtgattcaagctcgactttgccattttgattatgaatatttaccgactggttgaaagttgtgttatcaaattcttgattaccgtttttggcggagtagtttccaccagttaacgtgctgctttcaacatctagtttgccattctgctgtgaaacggtcgcgttattgaaggtgacgccgtataaattgagatggccgttattcagtgaaagccggccggaattggtaacggtcattccatggatatctgcgtttccattggcaagttgaagatcaagggtctgcagtgtgaagccagcttgggtgtccaagttaccatcatcgatggtaccgctaagggaatcaagttttgtgttagctggtaaggtaataataatgagggcatcttgagtgcctgacaaccacattccaggggcatctagggttttactgtcgattgtcacggtcccatttttttgagttactttggggttaacgagattagagcctgtaactttaacgctggcggtagtaccagttttaaattcaacgttatatccggaagtatcaaaattgaaatgtttcacttggctaagatgtttgatgtggtacgtttgacttgattggcgtgcgattttcacaccgttatgccaaactaagttggttgaagcgcccattgaaaagccaacaaacgcagcaattgcaccaataatggttaaaacgacaccggtgattaatagttttttggtcatcattagtcctcctttggttgctgacgtggcttactgaatcgttggtataaccaccgggtaaagttggcggccatttcaagaagtactttgataatcaagtatcctaatggtgcgacgaccagcataatcccaatggctgacagtccgatgccaatgaagaatacacaggttgcgatagaggttggtgaaatcagcagaccaccaataatgcaggcaattccagcaaccgcaatggcaatcaccccaacgatggttccaataatgacacctgcaatggccaccataaaggcgaagagaacggcgattaatgctaataacagtgggattgcaattggactggccattaaagccaggatgacgagccaaatcatacgaatgttacgttttgatcgcggctcagatttatggttcggcgtttgctggtcttctgcatcaatggcgcgaatcgagtaatcagcaaggattttacgagccagttgttttggtgtaccgagcttttgcacaatttcgtcttcggttgttaagttagcgtccatgatgtattcactgtagaagtcaatgacatcatcacgttcgctgtcgcttaattgagacaattgacgtgttaatttatgaatgtatgagttattttccatcatcagttcctcccaagatacgattaatggtggactggtagttctgccagtctaattgaatttcttgtaatcgctgtcggccagtagcggtaatttgatagtaacgacgattgcgtccttgaaagggttgatcgtaagtgattacccaattttcctttttcaaccggcgaagaacaggatacatggtcgattccgaaacaggagtaaattcctgaacctgttgtgtgagtgcatatccgtagtaatcttcgtgagtgaggagagcaagcacgcatccatcaagcagttctgttgtgattgaaattgccataattatttcccctgtcatattatattcaatatagtattggatgcaatgtaaatataccaagttaaacaaacgatgtcaattatttaataaaattaaaaaaataaaccacaaccgctgaattttagcgattgtggtatactgcttaggtagaatttaagaaggagaacacaatgaataaatcattaattgcccttgtattgatggtgccgattttgacgtttgccattattgtatggctaacgatggcaaaaattgttacgggtggcgcattgattgcaatttggattattggctttgtattggcgacgttagccaccacagcaatcatgacgattgtacaattaaataaatataaaaataaggaagacgaggattaacaatggggcaaccgacagacgactgggatttatatcgccaacatccaacggtcggacactttttaggatggttactaagtctgattaaacgcatgggcatgattgcgttgttatttattctaattcagctaccaccggaagcaatggtcattttaaaacatcagccgcgattgaatggaaccgcaattgtgacaattggttgctttatcctcattttcgtcggtattatcctgtgggctaaaaaaatatggcagcaaaataatcggacagttaagcaatcactgagtaccggaaagtcgattggttatgtaatctgggggtatgtcgcaatttatgcggggcagatagtgttaggaaccctgaacatcatgctttatcaccagacacaaacggccaacaataatgaagtctcaaaaataatggctaataatatgatggtgatggtcgtgtttggtctgtcaacagtccttttgacgccaatcgcagaggaattaatctttcgtggtgttttaacgaatttgttttttaagcccaaccaattttggccgaaactaattttatcaggttttgtcttttcaattggccacatgagcaccaccgttattagctttttaatttatttttatatgggcatggtgctggctttcttgtatcagaagacgggacagttgaaactgtcgattgcgttgcatggtttgaataacttaattgcaattagtcagatgattatgattttaatgcgttaaaaagcggtggcggcagccatcgcttttagatttcactcaggatttgatctaatcgttgtgaaatatcattaatttcgtgtagtcgttgaagatattcagactttttcatgtttaagtgattgagataggaattaactttgtttaaaataatcccctgactttgttcggcctttggggtaagtgcaaccaaaacgtgacgttcatcgtcaggatctttatgacgcgtcacccatccgcgttgttcaaggcgtcggagaaggggggtcagcgtgccactgtctaacgccagttggcgtccgaggtcgcgcatagtgatttcacaattggcttcccagagatttaatagcacaagatattgtggataggtgaggttgaacggatctaggatttcggcgtagaagcgattaaacttcttgttagcctcatacagagcaaaacacatctgttgatttaatctagtaggttcattcaaatttagggtcattagtacttcctcctccaacttatactgcaattctaacctaaatttgtttgtttaacaaacaaattgattgagatgcagaagcagccaccttgtgaatttcacaatgtgcaggaattatttttttacagagacttgatcgcgattatagtagcaatcgttggtaagccggcaattgtgattttgaatttatttcacaagtgcaaatatgcgtttgaaatttagtttgaacattgcgtataatggaaatattgatttatgggaatggagataatgatagtgaaggacttaaccacagtatatcaacatggcacattagcaatgctcgtggcgggcttattcgaagggacaatgccgctttcagagttattgacgcatggcgatagcgggataggaacggcggatagtcttgatggtgaactcgtgatcgtcgacggtaaggcgtaccaagtgagggagtctggtgaagttgttgaaatgacaccagacactaaaattccgtttgcatcagtgcactatgacgatgttgatgcggagcaaacacacattgaaaatatgaacgatcgtcaattgcaagaacggctgattaaggatcacaatatgtttaatgttttttacgccatcaaaattactggaacgttctctcatatgcatacgcgggtagtgccacggcaagaaaaaccatatcctaaactaaccgttgccactaaagtgcaacctgagttcgaacaggatcaagtgcatggaacgattgtgggctattttatgccatatcttttcttaggcgccgcagttggtgggattcattggcattttattaatgatgcgcgcgattttgggggacatattctggacttccaattagcatctggagacgtgagtgtgcaggtattggaaaacttgaatcagcatttaccggttaataacacaccatttcgggatgcccaaatgaatctgcagcaggttggcgatgagattaacgaagcagaacattaagtcaaataaaaacgttgtaaccgtttacattatgtgctaatataataggcgaggaagaacaatttaagttcttggacgccgtgaaaaaagatcagtcatcgaggattgatactttgtccgagacccgtttctggacgttgaatcagagtaggcgagaagcagcgtaagtgtgactcttaatatcgaataaataatggatgatgtagttaccagcgtgcgctagaaatgatcaatagtaactttgtgggagagtaccagttagtgatgcaaagtcgctcagttcttccgtaaaaggccaccagtgttaaagactggtggcctttttgggtgccaataaatacaccccttcaattcacaaagaaaagtgaacgaggggatgtttgatgttacacaaaacctggatttcatgtatgttgtcgtcacataatcgttaccggggatatctaaacggctagagacaggaactcgtggcgttgagaagcgttgtattggtggctactacatcttggtaagtcaaggtatccgggttacgaaaccagtagatataactgttcacaacggtatcagccgttgagtgtaggatgagttgctggggaccggtaggtgtaccagcaaccagctgatcgctgaacgtttcaaataacatgtttttgaggtcggttaccaattgtggctctggtgtttgtaaacagaggtaacggaatgctgcaaaattgaccattaggatttggtcaaaagtggtaagtagtcggtcagcgttcatggtgccacgctccagtgccgcttgaacagccattgctgtatcttcttgaaaatcctcgaacacatcaaccacggtatcgtagtgggtgtagaaggttttgcgtgttacgtgagctgtccgacaaagagcagagacgctgatatgttccatgctggttgtttctaacaagagaaacagggcagaacgaagtgcgcgttttgtacgaatgacgcgtgaattcatttaatgacaccttttttcgtttaactaaacagtttgaatgtgaaatggctatttttcttattacaaaaggatattctagtatacagtctaacaaataaggagatgctcaacaatgtggtcattaattcatggtttatttggtacgtttaatgggactggatacacagcgcatgagttcgttgtggcactgagccctagctcaccgcattacgtccaatctttatcggtggcagcgctcacgtttgccatcggttttatcgagtatatttatagttttgcgttggttcgccgagagggaagagcgccatacaatcttttgatgcattcgttttactttgcgattgattccatgggaatttttgtatttgcactcgccgcccaccaaaatggagggttttggttgtttattgcagcgtcggtggccgaggtagtttggacactgtttgaaatttataatcttgtgatgtgtatctacgttgaacgagttgaaatttggggaccgactgtttccgtatcctcagcgtggatccgtgttggtgggtggctcgtggtgatgattgtggtggtgaacttattccgagtcttcatgaacgatccggtgatgctgaaatggtacatctttaccaatgttttgatggggattatgcctagtctgtattgggaaaagcggggaactcgtgttggtgcaagttgggggctcacaattgtaattgccatcgggacgatcaactcgtttacaccgtttaatatgtggtcaagtattagcccatacttcaatatgcacaataatccgtggttttatgttgtcggcgtggtatcaatctttttctccttacgggcctttattgtgttatcaaggttaccggctaaaccgcgtctgatcaacggtaagcgtacaatctggtagtgcccgttatggtgggctgacaaattactagattcattgaactaactggatttactgatctaataaaataattagcactagatacaaatatcacttcgattcacacggaatagtgaatcgaagtgatatttgttattgcatacgattgaatttcgtcattcatttaatagatataaaagtggcgtcggagcttgttggacgccatttttgctaaagcgttattttttgcgacaaggataatgcatattgcctagattcttaaatatagacctcagactgtcgaccaatcgtaaatttcccaagatttaacaaatgacgaatcaaaattgatcgtaatattttttcaatataaaaaccgaaaaaaatttctctttccggttttaaaatattaatctttttggttgtaagaagtaaaccgttcgccatctgcatcaactgttaaagtagaaatactaccattttcagggtaattattaagtgtttcgatgcccagatgatcggcaaacatgcgtaaagatgttccgtgagtcacaatgagcaccttggcgccgttggggtaggcctgttgcaattggtcgataccagcttgccatctattaatgacttcgtcatatgtttcggccatatggcttggatcttcttttttcattaactctctggcgtatcggagaccgccagcctcaataatggcttcttgcgtatgataaccgtagggggttccaatttcattccaaatttgatctgaatctaagccttcgtaataaccgaacaaaacttctcgaaattcaggcatggcccctacttttgagggacgttgttgtaactgactgaccaccaaatcgcgggtagcttctgcacgacccgtgtttgaggaataagcgcaatcgaaattgatagcggctagccgcttgccagccttgattgcatcttcttttccatcctcagtgagatctgaatcaacccaaccttgcattcgattgaacaggttaaatagtgttttgccatgacgaacgaagtaaatagttagttctgacataaagtcctccttgaaattaagtgcaacgctgactaccaacaaacagtatagcaaattttacaaataaaactgtaactacgcctcgtgattttgctgttgctgatgatatttataaatagctgaacgcaattgtaaaattaagcggtcgatagaagcctgcttgagatggcgatcttttttctttaaagcatagagtttaagtgccggtggctcttctaatagctgtaacacgcggtagggctgctcaagatgtgccatgatttgaacgcaggactcaggaatgatggtccaagcctttggaaaacgtaagtatccgggaacttggacggcaccatccgcttgaagaagcggcttaatgctatcatcccagcacattaaatgccagttaacataatcctcattccaggggacaaagagttcatcggaccgagataacatcgttgtggttacgaaatctggatagtcactgtccgctccagtaatcagaaaaagacgttcctcaccaattttgcgactatctacttggtagcggctaattttattgaaggagattcctaaatctgcagtaccattttcaatagaggtatagattttctcagtattaccagtgttgatggtgtatcgaagaagcggattatcttccataaagtccggcaagagaagcgataaaagtgacgtgttaatatcgacagaactgatcacggttaagttgtcatagttagcgagttctttcaaattggcagtttcttggacgagttccatccattcgtttgcgatggggaccaaacgacggccatatttagtcagggtaacgttagcttggcccttcacacgattgattagtttaactcccaattgactttctagtcgactgagtcggttactaacggcagcttgggtaatatataacgaatcggccgcttgtgagatttgtttatatttaacgatctttagaaaagtttgtaataattcgggattcatcaattcacctccctacgaaacgttgatttaccggtgtttaagagcatgataagacgaacgtagtatttataacaacattttatattaaaaaaatattatattcaagcttgtaatgaaagcgaattcatatataatgtgtttagacacaaaaatcaatttgtcgttgttgtttagttgctatcattttattcatttattttagggaggtactatataatgcatgtgacgttaacagtatggcaagcacttttgattgccatttgggtggcgcttgttgaatctcgtattctggggtttgcgactttgacgatgcgctttagtccattaatgacagggatgatggtcggacttatcatgggggatcttaaacaagccatgattgtaaccgctgccattcaattagtttacatgggattcgttgcaccaggtggggcattgccagctgaaccaagtatcggaacagcgattgccgtaccagttgctattctaggacatatgagtccacaaggagccattgccattgcggtgccggttgccttgctcggaagctacctgtatcaattcagattcttcctcaacactttcgctttgaaatcgatggacaaatttgccgccgagggtaatgcacgaggcttgaagttctcaattatggctattccagcatgtatttcgttcttactgtttatcccattgatcttcatcgccctatactttggtgctccggtaatttcatcagttgtggccaatatcgaacacggaacgattattcatgtccttaacagtgtcggtggtgggttagcagccttagggatcgcaattatcatgcaagttattggtaagaagacgttattaccattcttcttcttggcttatttcatgagtgtggcctttgcaaaactagaaatcaacatgactatctatgccgtatttggtgccatctttgccatcatctacgtcatgttgacatcacgtaacacggaaaataattaaaggagggactatcgatgagtgaaactgctgatatccaagcaacggctaatgaagccgtgcaagataatacggaacacagattgccacaaccagacaaaattaccaataaggatttaatgaagtcatggttcggctggtggtgggctaacgaagtcccacatacctttgaccggatgctggcaccatcattttgttttggtctgattccaacattacaaaagttgtataaggaccatgatgaattggcaaaagcctttcaacggcatttacttttcttcaacactcaagcaacttggggtggtggaacgttaactggggtgacgatttcacttgaagaagcgcgtgccaaagcgatggcgaatggtgaagaggccatctctgaagacatgattaacaacactaaggttggtttaatgggacctttagccggaattggtgattcaattgattctgggactgttcaatatatctttatcgcgatcttcttaccatttgctcaaaaagggaacttcttaggtgccctgttaccattcttactgttcagtattgcaacctttacttatggttattacctgactaagatgggctacacactggggcggaatgcagctaaggaaatcatgactggtggccggatggccggaattattgatggactgggggttatgggtctctatatgatggggattctagctggacagtatatcaaggttcaaagttacattaagttctcaatcaacggtaagaaattcaatatccaagaaattttggatacaatcatgccaggtatgttgccattgcttgttgttctaggtctctacttctacttccagaagcaaggcttgaagattactcgtgggttactttacttgactgggattctgattgttttgagtattttctacatcatttaactaaacaaattatgaggtggcaaaccaatgaaaagagcatttttagtaattacacatggtgacatgggaattgaaactgttaagagtttggaactcctaatgggaccacaggaaaacgttacaggactaggtctacatcctggtgagtcagttgattcgttacgcgaacagacctacaaggttttagaagataatgcagcatcatatgatgaaacaattattattgttgatttacttggtggtagcccttctaacgtggcactatcaacgcttgctaagtatcgtgaattgaaaattgtgacgggcttaagtttgccactgttaattaatttgcaaaacttctcagaagcaactgatgatactgacaagttgattaacgattccatcgaagttgcaaaagatggtgttaaattgattgataaaaatttcttaaagcacgataattaaactagaacttaaaaagacttttttggaggcacaaactatggggaaaattaatattgcacgtattgacgatcgtttaattcatgggcaggtcatgcaaaagctgacgaagggtctcgggaccaatgcggtttacgtcattgataatgcaaccgctgccgacgactttatgaaggatatttacgtcagcaccaattctacgggtggcttaaagatccgtgtttacagcgctaaagaagcgggtgaacaatggcaaaaggatcaatttggtaacgataaggttgtcttggtcttcaagtatattaaggaagccaaagaagccgttgaaaatggccttgaacttgaatcgttgatggtggcaggggtatctaaaaagcccaatacaacggctgtgattccaactgcatctgttagtgaagaagaagttggcattttacatgaattaaaagacaagggtattgatgtttatttccaaaccttaccagatacaaagcgtgttgaactttaattcattgataaatcaggtttgctgagagggagattgcaatctcccttttggcatttaaaaagggagcaaccagttatggaagatgtttatgaagtatatcctgataaggtacgtgtttataccacaggtctaatttttacggtgtttgcgatcgcctttttcgctgtcctgtttgctaaaacttggctgattttaaaactgtttgcattactgtttgcagtactatttggctatcttgtatttcgaacaatgagtaaagcatttcaacggcacccagagtatgtcattgatcagcaagggattacagacaatacgcgtgaggatgtcattacccttccatggtcggatattatgaaaatcgaaatggttcccaataatgccgttatgcaaattggtatcttggctaaggatgctttggtgaaagacaaccaaggtgaaaacttgaaggaaaatataaaaaataacggtaacgttgctttttataccgtaatgattgatggatttaattatcgacaaaagcaatttacgggtattttcaaggaacttgagcgccaagggatggtatataatccacagattttaattagtgaatatattgatcctgagactaagcgtaaaatggctgataaacgtgatgaaattcggcgggcacaacgacgtcaaagaaaaatggacgcacgtcagctcgcgggcaagccagttcatcgatggaaattctggtaaattcgcatcttttaaatagaagctatgattaatgcaatattagtcgtagcttttatttttttacgtaaaattttgtggaagtacattgaagatcagctcttgcatgatccaataaattttagtataactaaattgtacctatgtgaaagcgtttactttgatttgatcaaggagtggtggatatgaagattaaagcagcagtggttgataaaaaaggtgaccaatttgcaattcgtgatgatattgaactagctgaaatgcagccagatgatattcaggtaaagatggttgcgagtggaatttgccattctgatgaggcattacgtaaaggggatgccgtcattgactatccaatcattctgggtcatgaagggtctgggattgttgagaaggttggttcccacgttcaaaattttgaaccaggtgaccacgtagttttatcattttattcctgtcgtaactgcgaaaattgtttaaagggtaagccgacgcaatgcttacattatggtgagaacaatttatccggggtccgtccagataaaactgtgcattttactgaaaatggagaaaaggtggctgacatgtttgatcagtcatcatttacgacaacaaccgtggttcgggaaagcaacgcggttaaagttccaaaggaattagatttgcgtaaattggggccgttaggatgcggctatgttactggaagcggtacggtattaaatacattaaaaccacgtccgggacaaacgattgcagtatttggtactggcgctgttggactggccgcaatgatggctgggaagattgccggttgtacgaaagtgatcgcagttgatattgtggatcatcgtctagctctcgctaaagagttgggtgcgacgaatgcaattaatagtaaggaagaagatcctgtagaagcaattaaggcgctgactaatggtcatggcgtggattttgctgtcgatactacgggtgtcacgggtgtgatggaggcttcgattaaggccttggcacaaggtggcgtcagtgcttgcattgccgttactccaaaccatattgatgtggatacgtggaatgatttatgcgtggatgataaatctgtcattggtgttaatatgggagattcaattccacaaattgacattccgcggttgattgagttttatcaggccggtatgtttgattttgataaaactgagaaattttacaaatttgatcaaattaatgaagccaatgctgattccatcagtggtaaaaccattaagccaattctggtgattgacgaagcgtaccaacctggtgaataaccgttgacaacctaaatagcgacctccccaaaccggggaggtcgctatttacggcttactgaaaaataaggggattaattccagcatagtttaagtaatataagaatagaactaacgcattaacgagcatggataaaaaaatgatcgcataacgaatcgagaagaaacgatagaagatcagttgatatctggtaaatcgaggacccttgtactggaaagtgaaaataagcaaaactagggtaattaaggcttgaccaatcagtccaatcagcaaaatacttgatgttaagttgatcgcctgaatatggtaaagaccgacggcaataaagtcgacaataatcgtaagaaaaggcattgatgtaaaactccttagttgaatgataaggttattataccaacattatgattaaacaaactagttacggtcagttaaattatttttaagggtaattctaaaaaatgccttttcaaactaatcaagatagtgtaaaataatattgttgcttgcccgagtggcggaactggcagacgcgcagcgttcaggtcgctgtatgggtaaccatgtacaggttcgaatcctgcctcgggcatcacaagtagctatttaccattaacgaaaaaagcagtgagatttttaatctcgctgcttttttgtaatctttattatttttttatgctttcttcaaaccaaaatctgggattcctgctatactcgtgttgttaacgagttatagaaaattggcaactagggactgataccacacgaagctacgcgcgatatctgaagtagaacaatctgcaatctctgaaacaggttcaattcctgttaactcgattccagcgttattcgataaatttaatcattgttccatagccagtgacgactaaaaatttaggagcaacctgcagttgaacgacctgtgtattaaacttgacgtccgtaatgccgtcggcaccattttcggccgcccgttgccgcattttttcctcgacgtctgaaaatagttgatccattgactcaaaagcgtcgattgtttcagatgccaacattaggtgactggtggcgttgacaattcctttgatggcatgtgattggttgatacttccagttgttaaaaacatgatcgtgttcctccagcataagtttatttaatcataccgagcccactcggaattaacaagttcaaattcttgcaaattcatggtgtggacgggtaccatgaccccatgttggaagggagcaccaaatttaatgaaaattgtatttcatatcgacgatccaattaaagcaccgcaacttaaggctaacattgaaaatgcattgaatattttacccgaagttcagttaaccgttgtcgccatcggagacggtaccgagatctattcgcaggaacgatttcaacagttcatgcagacacatgccatggtagaatttgaagcatgtcgtaattctcttcgtactcggcaaattaaagaacagtcaattaagccagcaaccgtggttcctgccggaagcttacgattagctgagctgcagcaaaatggctattcatatattaaattataactaaaaacggatgaccctgattacaggatcatccgttttttatgagttacttgtttcgatgcttttgatcttctttttcttctgcatcttggaagccagatttaactggataggttaatcgaattgtacttggaatgattactggaatgataaataccaggataaccaagccaatgataacggccattgcgacttcaatcaacgttggaacgcctgaaggaatcagtgcggcaaaggtaccgctcaggatgatcgctgcagaaatgacaaccgttccgataatgcttgcagatttaaccatacgcttagatggcatcatattatctcgcccaaattcgcggtacttcatcatcaggaagatactgtaatcaaccccaagtgcgattaacatgatgaacgagaagaatggtgtattccaagccaacatatccttacccatgactagtttaacgagccaatgagtgatacttaatgaagtcatgtaggcgagcattaaggtaccaataatataaagtggttgaagaagagaacgagtgacaaagatcagcgctaatgtaattccgatcagcatgatggctgccgtccggataaagtcttggctagcgatcgattttgtatcagcaagggttgatgattgaccacccattgcaacagtcgtattctttaaatcggttcccttcaagtttttacgagctaggttggcaagtgaacgagctttattcgtggcaaccgaatcacttggattagtattcagtacaacggtaatcttggcggacttcttatcttcagagagataggtcttaactgccggtttatatgatttgccgtgaagaatactctttggtacgtagtaggtatcagaagcagctgaatttgacagtcctttcaggtaactgccaccttcaccaagaccagagttgaccttattaatcccagtcgtcatttgtggcgattctgaagccaatttgttgattccagtgttgatttgagtcaaaccagtctggctggatccgagtgctgattgcacttgtgttaagccatttgtgagttgcttcaaagcggtagcagcaccaggaagtgcagtattagatgcagttgcgagctcactgacttgtgatttcaaagtggttagttgactcagcattgactgcaatgaggaggctgaaccactaacgctttgcatggaactagccaaactttgatcggcactgccggcagctttgatgttattagcaacagatgtcaatttgctttctagtgtctgggactgttgtgtcatggcggcactaattacctgtgagaggatggcttgttgctgtgccgttaaattagccccattgctgttggcggtcgaaataatttgtgaagcagcaccagacgtgtccgttgaacttaatccgctcaaaatgttaccagcctgagtcaggttattaccaattactttagcctgtgacccaacgttagtgagttctgaggtcagggcacttgtatcaacagaagttcccgaattttgaagtgcagtgtttagctgttggataccactattaatttgtggtaggccagattccagctgtgcaatttggctagcgttactacctgataattgactattgagctcacttgtcagttgcgagacgccgtttactaactgttggctaccagcagacagctggtttaatccagtggtcatttgtgaactaccagttgataatttaccaagaccagtctgagccgattttagaccgctattaacggtgcctagttgattggtgacataaagctttttaaccttagtaccaccaggttgcgtgaccgaagccacggttttaacacttggatcttgttgaagtttacgagtaatttcatcgatcgctttgagatctttttcgttatctaaccggtggttcgatttgatatagatggttgatggttcagcggtcccttttgaaaaatgatcttgaacaacgagaaaaccttgtttagaggcaaccgagttactaatttcatcagtatcatcataatttagtttactgttaaacatgaagtaaaacggcattagcaagattaaaacgattgctaatgagatgattggatgaatggtcgcgttacttgaaagacggtgccagagtttgctttgaccttcgccatcgaaatttttagatggccagaacatctttttgcccatcgtggccatgaaaaatggattaagtgttaggagcacgataagtaagacggctaccccaacagcgactccaatggcagattgataaatggagaatttagctaaaccaagggctgaaaaaccaattaagacggaagaacctgaatacaaaatggttttcccagcttcttttcgggcgcgtcgggttgcttcccaattggagagcccccgactaagctcgtccttgaattgattgtataggaggatattatagtcggtcccgatcccgaagagcacaattaccatgaatacctgagtaaagtttgagaacggaaaattaaacttttccacgaggttggttacgatgcttaaggaggtcaagaatgataccccaacggacaatagagaaactaggggaacgattggtgaccggaaaactaatactaaaacgatgaaaataaagatgatggaaatgacttctgttttcttgatgccttcttgaatggcggcagaaaaatcatcattcagaatatccgagcccgtgatgtaggatttaaccccgtgagctttaactgcattagttagttcatggttgattttcttaactgtgccatgctttttactgaccatgatttgcacgagttgagttgttttatctttcgaaatcaattgcgctttcgtggcagagttgtcattaggggctgtaatactcttgatgccatatttttgcttattatttttaagcttgttgacgacatcttgaacattttgcttgtccgaggcactcattttatggttaccgttattaaaaacggcgacaacttggtatgtatttccctgaccatagccccattttttctgaatgctatttgcaatttgactttgagaatccttaggtaatgtaatggttgcgtgttcccgggttaacgtgttgatattaggcatcataaacaatgcaatgacaacaatcgcaatccacgcaattagtgaaccaacgtgatttttaacgaattttcccatactttctctcctttaatatgcttaaatcgattggtttggtgtaatgatccgcttgagcatttgacagtagcttttttcaacatcgtcttcgcttgctagatcatagaagttggaggtttcaatgaaaacaaatcccagtacggcactgatgagcgtctgtgacacggcaaactgttcttcttgtttaagtgttgaggaggccagcacctgattgagaaggtccactaattttttagcttcgattgaaaactgagagttagtggggaacgaatgcaggtcataaataacaagggctaaattacctttacttaataggtagcgccgcgcaatcgatgcgaactggatcaaggcgacattgtctgagagcccaatgatgccatctttaatttcctgacacatctcccgaatgagtcgtgcaccgattaatgagacgagttcatcgagattggcgatgtagttgtacaacgactgagtccggatatcgagttctttggccaatcgaggcaatgtcaatgccttaatgccgtcggcttgaataatttcgatggcctggttcacaactttgtcgagatccaagtttcttcttttggtcatattttcacctccaaatcttcataaaaaataacaattgataatataacacgacaaactgtcatttgtaaactacaatgtgtagaatatttatttttatctgtagatcaataaattacccttttggatcaaaattgcgcaattgaaagataaaaaatgctatgatattactgaaaatatcgaagggcgtgagtgggatcggaaaaatcagaattaacaacatgagttttcatacctataacggagtatttgctgaagaaaagaaattaggccagaaattagaagtcgatgctgaattgacgtatccgattgaattaaaagtggtccatgatgatttaaatgagacggtgagctatgcggacgtttatcaaactgtggccgattttattttaaataataattatgatttaatcgaaagtgtggctaatcagctgctacagcgattattagaagcgtatccaacgatcgaagccatcacgctccgagttcgaaagtatagcgtaccgattgctggaattttcgacaatattgaaattgaagtatcagggagtcggtaaagatgtcagtggcttatttgagtatggggtccaacattggtgatcgggctgcacagttacaccaagcagtggcgttattgaaggcaatgcatgacattcaggtggagcaggtgtcgagtttatatgagactgagccggtgggtggcgtcgttcaagatgattttttaaatattgcggttaaagttaaaactagtttgacaccacgagcactactagcgcaattacatcagattgagcagcaattacatcggaagcggctagttcactggggaccacggacgattgacttggatattatcttttttgataatctccacagtgctgatcccgttgtgacattgcctcatccagaggtacagcatcgcttatttgtgctagttccaattgaggagatttcccggggggatacacagattcatgcgatcgttaatcaaatgattgcaacgacggatgatagtaattgggtcagaaaatatagaaacagtggagaaaaggcataaatggataagaagagaattgagaatgcggtcagtgaaattctggccggagtgggtgacgatccaacgcgtgagggggtcgttgaaacaccagcacgggtagctaaaatgtatgaagaaattttttcatcagttggtaagtcccactttgaagactacaagttatttcacgttgacgatgacccagagatggtattagtgcaacagattccgttttattcgatgtgtgagcatcacttattaccatttttcggggtggcgaatgtggcctatgtgccccaagacggtgtggttattggtctaagtaaggtaccacgtctggttgactttgcggcaaagaaaccggggatgcaagaacgaatcacggtcgatatcttaaacgaaatggaacggatgcttcacccagcgggggtggctgtttcactgagtgcccggcatatgtgtatggagatgcgtgggattaataagtctaatttatacacctacacgtctaaatttagtggtgcttttaaggaagatcgggatttaaaaaaggaatttttacggcaaacggagagaaagtaattgttaagttatgatgctttgattcagcaactcaatacagccatgcttgcgggaaatgatgatcgcgtgggactcctaaaacaggtgttagcccgtcttggtcatccggatcaggattttaaaattgttcatatcgcgggaaccaatggtaagggatcaactggaacgttagtggcgcacttactacaaaatcaaggctatcgtgtgggccactttgcgagccccgctttagttgaccagcgtgagcagattcaaatcaatgatcagctaatttcacgatcagtttttgtggcaacctatgaaaaaattgtgccgcaattaccgcaggatgtgcagccgagcgatctgaccatttttgagtggtttacactcattatgattcaggcttttgctgatgcacaggttgactgggcagttattgaagcgggactgggcggcttgacggatgccaccaatgccattgaaccaccattgctgacgatttttacgcatattgatttggatcataccaaaattttgggagatacaattgctaaaattgcaacgaacaaagctcagatcataaagccacgaacgaccgtgtttatggcgcctcatcagcatgatgaagcaattgatattattcgacacactgcgcaagcacatcatgcgaaggcatgtgtcgacgatacacaaattaaaattcagattattagtgaacaattgacgggatttgatctggtattaaattctcagtatttggtacagcagaaagctcacttatcattaattggtgattttcaaattgataatttaacaacggtactcatggtttatgattggcttgttgagcggcactatgttgacaatgtgcagacgctattgcagacgttggcaacaaccaaaattgccggacggatgcagcaattattgtcagaaccaccggtgattatcgatggtgcacataatcctgatagtacgcagcaactcatgcgtagtttgggacatctgtttccagatcgtaaatggatttttgtcatcggctttttgaaggataagaactatgctgagatggtagaaatgtatcgcaagttcggtgcacagatttttatcacaacgccagcaaatcccaaacgagcactcaatcagaatcaattaaagcagttattaccggaagcacagattgttgctgatgctcgtgagggactccgccaggcgttaattgcgagtgatgaaaaatcagttgttgtgattacaggttcattttatctaatcaaggagttggagtaactggatgaaaactaagcgacgatttgtgattgcatcaaacaaccaagcaaagacggctgaattagtgacgtgctttgcttatctcggctaccaagcaatttcgtatcaacaattaattggccgccatgaatttcccagtgaaggtacccaaagttatcaaaaaaatgctcagggaaaagcgaattttattgcgcggttgcttccggatgagtggatcgtagctgatgattccggaatgcttttggctgccgatcctgccgggttgggcgtccaaacggcccgccaattgaagatgtatacagatactgagcatcatttgaatcaacgtattttagcaattgtggccaataaaagtcgtgaagtcaccatgacaacgacattggtgctgagaacgccgattaaatcggtgatcgggcatggtgagttccatggcaccatcgcaactgaagaacgtggccaaaatggggccagtttcgatttgattctggttccggacggcatgcatcagacattagctgaattatctgatgctgtaaaattaccgttgttgcatcgtacaaaggccattgctgatttgatgactcacatggaggagacgacccatgcaaattaatgaaattgtagttaatgatacaaatagctttgaaagtcgtgtgttgcaaggattagtgcaacgacgagcgcagctaatgcttgaattcaaccttgtgaccgatactcagcatgcggcgttgattgagctattggcacagtttgatgctgactttgtcgatcaagagacgagtgttcaggccacgataccatttgcggcgtgggcaacctttgctgaccggtgtgcagcaaaatttgtgaatgatccggaatgtgttcgatcgctaaccgcgattacgcgcaagtatgaagttcattggcaaacaacgcggtttgactttaatatcagtcaaaagccgattatctatggtattttgaatattacgccagattcgttttacgatggcggacgcttccaagatccagctgccattgctgatcaaatcgagcgcatgattgctgctggcgtaaccgttattgaggttggtgggcaaacgactcgaccaggcggcttcgttgaggtaaccccggtcgaagagcttcgccgaattagtagcaccgtcactttaattcagcaacattacccacaggtggctgtggccgtggacacctacaaactaccagttatgcaggaaatggtgagagcaggggttgatattattaatgatgtcaacgcgttcactgatgtgcctgataaattagcattgtttgctaattcgaagaccggattgctaacgatgcacagtagtcgggatactgaatacgataatttaactcgagaaatgaaacgattttttgagactaatttatcggtgttgacggcagttggcattgatcgtgaacgaattgcacttgatcaaggcattggctattcgaaggtggcagatggttatcaagattacgccatgatgcgcaatatcgatcaatttaactaccttggtcgaccgatgatggttgccatttctcgtaagggatttggggctaaattgtttggactaaaaaaagatgaccggttaccggtcaccttgattgctgaagcttacatgtatttacatggtggtcgtattttacgcgtccatgatgttgaagaaacggttcagctgactaaaatgttagatacaattaacgctggctattggcaacgttaaaaataatagttaagtgttaaattagcgatgaagagcaatgcagttgcggttccgagtggaacggtaatgtgttgctcttgtttttgtgtaaaaccagcttcaatgaaaaatacccaaacaattgtcaggagtagtttgataatcgccatggcaggggtagccgtcactaaatagaagaaacgagtgccagcgatgatgagcaggagcaaataaagtgtgcgactaatgactagccaggtttttacttttttttgtgtctgtgcactaaatcccagacaagtagtgagcatgagaatcgtacatacggccagataaatgataattagcattcaatgcattccaatctaagtgttattaataccatcattttagcatgcttctcataatgaaaagggtttttataagaaattataagaaatgttaccttttagcttgtttttttgcagggatggtcgtaaaatgcaaagcattgtgcttatttcataacaaccgaagggagtgccaagatgcgagatcttacacagggaaatccacttaaactaattctacgtttcactttgccactttttattgggaacctctttcaacaattatataactttactgatgttttaattgttggtcagacattgggtgttaatgccttagccgcagttggatcgacaggaagtctcaactttctgattatcggatttgcgaccggattaacgtctggattttctattgtcactgctcaacgattgggatcacgcgactaccgcggtgttcgcaagagttttgcaacaagtatcgtgatgagtataattgtcaccattatgttaactgcaattagtttaattttccttgatccgatcatgcatttgatgagcacaccgacagatatctatgttaatgccaaaaaatttatttctattatcttcatgggaatttttgcatcaatggcttttaacatgctttcgaacgaaatcagagcgttaggtgattccaagacccccttatggttcctgattattggaacggtggtcaacgttattttggaacttttatttatcgtaggatttcattggggcgttgccggggcaggctgggcaacggtcatttcacaagttatttccagcattttatgtgtgatctatatttcaaaacgaattccactgttacaggttcatgcggctgattttaagggcgtcttcaaagaaattggcacccatgcacgaattggtctgccaatggccttccagtcctcgattattgcagttgggagcattttcatgcagtcggctttaaacgggcttggaacgacttcagtggcggctacaacgtcggccactaagatcgaccaattagcgagcctaccaatgatgtcatttggaattacaatggccaccttcacggcgcaaaatattggtgctgggatgtatgcgcgtattattaagggcgtacgccaatcattaatggcctcagtgacgttcagtattattgttggcgggttgatcattttatttggtcaaaacttagttatgctgtttattggtaatcaatcgccagcagttttaaaactaacgcagatttactttaatatcgttggtagttcgtactggattttggcgatcctattcattattcgttataccttacagggcttgggacaaagtgtggtaccaaccattgctggaaccgccgagttagtaatgcgctcgtttgcagccctggtgttagcagctaactttgggtatgcgggggcttgctttgccaatccattggcttgggtggggtctgtcttagtattaacgggctcttatatggcagcaatcaagcatttgaagaagttggaacggatgaagtcaattgttgaaggcagtgccaacagtgatgagaaggaacatatcagccaaattatgaatggtgaattacgagcggtttctggtcaacgtaaaaaagtatttgcataatacttaagttgattgcatattgtgacattatttgttaatataacatgattaattctatgaggtgaattgaatgactgaatttgagattggcgacaaagttaaatgcaaaaagtttggctcactcgagcatgattttgctggagaagttgaaaaggtttatgagaattctgttctggtagcaatcaaagaattcgataagcaggattcattaacagtgactgaactcaatcaacgtgcaatcgtgcgtaaatcagaagctaaaaaaacagcttaatataaatcaagcagaagcatcgtcagaaactatgatgatgtttttttgtgggaataaattggaaaaactggcttatgaatgggctttcgcggtatactgaaggtagtaattatcgagggagttgatccgttttatggaaaacaattatgcgctagtaagtagtaattatcgttacggaattaacctaaatcagattttgactaatcatcttcaagaacatggtcaggtaaatgaccaaggaaaacttattatagatcgtcaaaccttcaccgatgatgtccaaactgatttaacctttgcactttttggggaaccagaaaaagttaaggataccttgatgaaatttgcggaagatggatcgttagctaatagcagtgtgattggcgtaacgagtctgaaaacgatgaatttaaacagtgatgataaaacagaccttgaaaacattttggacgatcgtgaaaacgatattgcgagacggcggcggttgcatcaaattattactcgtgacagtgatgatcaagcagtatacgaagctttagtatttaacgaacagcagtttgaacaacccgtcgatcagcagagcctagcgttggcaatgaccaagattcaagcgtacatccaaaccgctttgacgcatggagatcagggaatgattgataagtatcgccgggacgcgcaaccatttttgagtgatctggatgagtacacgaaaaaggattatcagaatcaggctaagcgatataaggccattattagtttagatgccgtggaacgtacgcgattaaatagtttggaacaaaaattatatgatcaacatgaatttcgctcacaattatcaaatgagcgtaatccacaggcttttgaactgctgcacttttaaaggggatgacgctcatgaaatttgtgagcgttttttcgagaactattagtaatgaaagactagatcaatgaagaaatgagatttgaaaatgacaatgacaccgcaaaccggtaaattattaatgcttttcgtgaacctcgtatttttaatctgggcgtaccgtattttaatgagccagtataaggatgaatcacagtatcagggatcaatgggaatgctatataagtattttagagaaatgcaagatgctgtgaatcgaacaggtgaaggcaatcgccagttaatgaaaatggggttgaattttattggtgttccgttagcgtacacattattttcaaattggattgagcagcgctcattgacatcaagcttgtggagtatttttggtaatctcctgattttgattctatttgggttgctgtttattttttcgtatcgaatgattcgattgaacgagttttatccggatcggtggggacaaaagcgaagctggttcaaaaagttaggacgcaacgctggtgagttggtggcctctaaaaacatgtttagtgactgggagcaaactgtcgcaacgttggccaacgaggcagatgaacatccttatggaactagtcatgactggaagattaaacaacagattcagcaattaacgagtgctggtttgacgcaacgtacggaaattgcgcaagtgattgacttgcaacagcacttgagttcgccagttgagtattcacaagaggaacgcatgatgttagcgttgtatttcaaccaagccgatgaaatgatcgacgtgatggctgaaatgtatgacgctaaatcggatgaggaaaagcaccaagagtatttatcgagcaaacacacgcagcaggtgacgtttattttaattgcagtgtgtgtgttactaccatcatttttgtaaaacgtgttatgctaccgttgttaggagattaataatggcgagcggagattaattttttaacaaaaagaaaccgttttagttgcttatttttagtaagtgatataaagtagaccatgttaaatgattgtatttctagaggaggacgttaaaatgtcaaaaattaatgcagcagatgcaatgattaaggtattagaagactggcatgtcgatcatctatttggattgccaggaggttcctttgattcgaccatgaatgcacttcacaatcggaagagtacgatgaaatatattcaggttcgccatgaagaaacaggggccattgcggcggccggtgaagctaaattaactggtaaaattggggtaacatttggatccgcaggccctggtgcggttcatcttctgaatggtctttacgatgctaaacatgaccatgcgccagtgctagctttggtagcacaggtaccaacaagtgctatgaacactgacttttttcaagaattaaatgaaaatccaatttttgcggatgtttcagtttacaatcgaacggtaatgactgccgaacaattgccagcggtagttgaccaagcaattcgacaagcttacgagcattcaggtgtggcagttgtcacgattcccaaagaccttggttgggctgaaattgaagataactatgtttcaactgcagataattatgtagtgactgataattatccccttccagatcaaacaactgttgataaggcggttgaaattttaacgaacgctaaacgtccactcatttactttggattaggtgccaaaaaagccgccaaagagttgaaacaactatctgatcagttgaaaattccgttgatgtcatctgctctcgcaaagggtgtcatcaccgatgctgatgaagcttacatggggagtgccggtcgtgtagcaactaagccgggggttgatgcagcaagtaacgctgacgccattctatttgtgggtagtaatttcccatttgcctcgtttttctttaatccagccgcaaaatttatccaagtggatgtcaaaccaactaatattggtaaacggcatcatgtcgatgttggtcttttggcagatgccaaaacagctctgcaggcatttattgatcgttcaagtgcagtggaaagtcgcgcgtattacgatgctttggtggcagacaagaagaattggttggagtggcttaaaaagtttgtgaacgaggatcagacgccattgcgggtggatacggtctttgaacaaattaatcaaattgccaaagatgatgcggtattcgcactagatgttggtaatgtcacaatcgatggtgtgcgtcttcttaaaatgaagccaacgcaaaagattacgacatcgggctggtacgcaacgatgggatatgcattgccaacggcgattgcggcccaagcatcttatccagaccgtcaagtattttcaatcagtggtgacggtggttttacgatggtcatgcacgatattttaacgcaggttaagtatcgtcagccgattattaacgtcgttttgacaaatgaatcacttggatttattgaggcagaacaagatgatacaggtcagcctcattctggcgttgacttaattgatgcgaacttcggtgatgcggctacagctttaggggccaaaggatatgaagttaagacattggctgaattaaaggccgcctttaaggatgctcaaaccgtgaatggaccgaccgtcattgatgtaaaaatttcagatgatcgtccattaccggttgaacaacttgtattggaagctgatggaaatcatactcaagcggatgttgatgcatttgtgaagcagtatcacgcagatggattgattccatttagtcagttacttaaccaatttaatgcgtaattatttgagaagatgggtactattatccatcttctttttttaggtgatgatatttcttgcaatcgctttcaattggcggtaatctcatattaagaagaaaacttaagggcatacgataaggcatacgataattggaggaatgaatatgaaattaccaatgaaaaaagtttggcatccaggaaagtatgaagtcgatgttgaattgcggcggccaaccaaaaaagaaattattatttcctgtattggctgggcgggaatgattgccgccataacgggtgttattgtgcataaaaaatattgtcaaaaatagataaaacaaaaagtgctcacggaagagcactttttttatttgggcgtattcattggtggacggacacagatcgtattacgcccgcgatgttttgattggtacaatcgttcatccgcgcgactataaatgtccatataattacgatcatctggtaatacgtgatcctgaccaagtgaaatcgtgatattaaatttttgatccggtggcaccgtgaatttcaactggctcagttcatcgcggactaagttcgcaatttgggtggggtgttcagttacttgagcggtgtcgaataaaataaaactaaattcctcaccgccagttcggtaggttttaaagtggtagggaagctgtgccaaaatatcatttagacgggccgaaacctgttcgagcacttgattaccaacgagatgaccatactggtcgttgatttgtttaaagtgatcaatatcaaatgtatataaagaataattaagcggatcggttaggtgactgtaggcggataaaaggtcttcgttgaaaactcgaaaattatttaggtgtgttaatttatcggttcgcgcttcacgaaggaggactgcttgccgaatgtgctgtcgtttaaccaagtaatggatctcccacagtaaccaacagatcaataacgtggttatgagctcccatggccaaccaacatcgatgccacgaagtgaaataaaatttgcccataaaaatggagtcgcgaaaagtaggcaaaatggatagtaaagtgttcggtaagtgccaattatgatgccgaatcgctgggctaaccacatcataatgagcgtaacgacatagaatagggctgaattggagacatttggtagccaccagtaccaacttaaggttacaaccgataaggaatagaaaagcgcctgtttacgtgatgacagtagggcgtatagcacggttgcaatttgaaaattaatataggtccatccaaaaccggtattattatggttttgaatgatgctgagttcagaggcggagtgaaacaaaatcaaaaatgcaatggtgatgctgacaaggtaagatgtgcgtaacttttgatgaatgctattggtaaactttgtgttttgaagccaattgtagaggagtgcatagcctaccagtaagagtagattcgtaataaaagtaacaatcctaatttcccacagaagcatttagttcctcccttctagctagtttttgaattccaaaattaaggactatgtatcaacagtaagtagcattactgtactgttggcgatatcaaaatatgacagggatgattgtgatctgttcgctttattgcgagagtccctcggcagctgatggtttatcaaagtagtagccttgaacgtatggcgttgaaagagcctgcgccatctttaaatcttcggtggtttcaacgccttctaaaatgaatgaaagttgattttcttttgcaatttggcgccaaaattgaacacgttcacgcagtgcagaatcgctagttgttttgcgcagattttgcatcgcaaatttaaatccattaatataagccattgatggtcgaaccatttcgaaactattatcggaaccaacatcgtcgatcaaaattttgattccggcggcccgatagcgggcactaattcgacgagtggtttgggagtcggtcaatgcagtaatttcaaccgtcaaattggtgggtccttctggactttccgaaaattgggccagtgcttcggcgatatcaatatcttggaattgatcagcagtaaggttgatgttgaaattgtgtagctgagtatgacgcataaactcttgcagcaatgcgatctgcatccaagcgggaatttcaaatgtgtcggggagtacccagcgcttttgaaggctatcatacgttcggagcagcagctcatggtagtacttgggatggtcatcttgtgttatatcgtagatgccctgtgagaagtagcaataatcggcgagacttttttcagatttgtcggcacctgaaatgatttgagtatcaaacgtaacggtatctcgaccgcttcgtttacttttagaaagcgcatcatcggcacgtttataaatgtcattaatactcgtgtcatcactttggagtgctgtgcacccgattgaaacggtgacggcaatatttcgctgcttgtagggaaattcctgtttgcgaattgcttgccaacatccttttataattggtaaaactgattcagcggattgattgggaaaaacaatattatattcttccccagtggttaaataaagttgatgttcaacgttagcatttgtgagtaattgtttcagtgtttcaccaacagcaatcaaaacagcatttccagctaaacgaccaaagcgatcattaatttgtttaaagtggtcaagatcaagtgttgcaaaggtaagcgtgtcgttttgcgtttgggttttagtgaaaagctgctgcagttcagcttgatgattggcatagccagtatcataagtgcctttttcgtactcagctaatcgctctaattcatgagttcgtttgtcatcacgatactgacgtaaccaatatccaagaacgaaggcgatcattagtgtgtacattaacacagcttcccatttaagctcggtcgtcatgactaggtgcattgagacatggggaaccgtaaaccaaaacaagctagccagcattccagcaagtaaaacgccaacccaccagtgctgcataatgtactgatggtaacgtttgagtagaactgccagtgcaataaaaccagcgagcgctagcaatgttgtggggtgccaaaaatttggagcatggtgcatgtaccaaatcattaagagggttagtgattggagcgagacctccaacccattaaagccaccgtaaagaagtggcaaaactaaaacaaaaagggcccaattatggtataaaagagccgaatcatttgtgatataggccatggcgccaaaatggatgaagcaccctagaccaacggttaagaagagcaaaattaggcgtcggccaaatcggtagcgggtacttgtcccttcacgctcaaatgcgtctgaccagattcgctgaaaatactgaataaaaccgatactaaaaaagctgataacagcaatccgcatcgcgaataacggtaaatcttgcaaaagttgattagttgacataatacttcctcgtaagataagttatggtgattcaaataaacattattgaagtgcattgtaccacaagaaatctttgtgtggcgcggttgccaaaagataatctccggataacggcaacgtgtggcaaaaaatacagaccgccaaaaagatgggctacttggaagcagttccagtttgatagttaatggtcaatcctgactggacattggggacaaacacgttaaattccaatgtgccatcggtggacttggcctcaatgtgggcaccgctaggaattaaattatttccgtcgtagagatcactaactcggtaccgaacggttttattttgatcgagagcttttcgaacgagactttcataatagttttggccggtagactgggtgttcattgcttcgttggcccaggctgtttgagtagcaatatttttcggattcgattcagaagcgtcaaaaccattgatgccaccaacaagggcgtatcccaagaggtgtccgcgatcatatgcgtgactgtaactaccggacaaattagtgagttggcgaaagccagcgggtttccaatccgaagcgccatttcctgtttcagaacggtttttatactggcgggtggttcgattgaggagtgcgttgccgatcgtgggacgattttgggcatctgtttgattggttgcatagggggcactggcaacattggcgtttaaggtggtttaattattattaatgataaacgcgccagcctgattaaactgaatcttatcactgcctccgagttgtgttttgattgaatcggttagtacagatttagcgagtgcttcactcggtgcttttgcagcagcactggtagtggcatgctgactggcaagatgggaaatacctagaaagataaacaaattacgtaggtagtggccctgcgcgtaatatgttttaccgtgactggttttgtatccggtcgcataggacgcttgaattgaggaagccttgggtgcatggtacgtgctggttgttttacgcgcagcagtgtgcgtgacgcgggtgctgtaacttgtgtgactcgcctgaactgccggaactccggctggcccagccataaaaaagaaagtgttaaccaagagtaccgcgattaattttgtaaaccatttattagtcatgtgacgttaaatcccctatatcagaataattacttttttattataccgaagtctgataatttgggcaacgtacgttcggtaaactaaacaactagatttaaattaaaaaaagatgagattacgtcaaggtattgaaccatacgtgtagatggttcagaattaatacgtatgtttcgtgatcattaatggagtgatcgataactaagaacgagcaaggagctagtcaatggggtttaatatttttggattacatttcagtatgggcatgaatttacatgttcagccaagcctggtctggttcacgcaagttattattgcagttttctttatggcgggttttttaggtttttatcaatcgttatatcagtatgcgttcatgcagaagcattcttatcgccatcaagggatcgcacgattaagcctattattgatgtcagttgggacagcaacattgctgcatttaatgggcttctttgcgaccaacacggcgatcttattacacaatatggctttgttcctatttattttaccgtttttaaacggtgcactgcaccagttagaagatgcggtcagactaattgcgatcattattttttggtgcgttagccattggggtgtgtacggacagccacagttttggatatcattaattttattggcaatcggtattatagtgacgcaaaagtataatcatcagattcgtgatagtatgtggaaaagcttgactacgttttctgccattgcggtggtttattggttgagtttgccactccgtgcaacggggtatgagatgactattcttttggtgcatgcaatcgggatgtttttggcaatgtctacggtggccttttggttctggcgtcatgaatcgattgaagctggtcgaaataaagaactaacgcgcatggtcaactatgatgaactgactaattcacagccttacgaggtttaccaacgtgaagttacgaatatgtttgcgcaagctcaagctcagcatgttgcgttaacgttggtggcatttgatattgatcattttaaacaggtcaatgatcattatggtcgcttggctggtaacgccgtgttaaatgcggctgccgataagttgactgagattttaaaaatgtatgatttggaccatcgattttatcgaattggtggtgaagagttcaacgcggtcttttttgagcaaacaccaaaagaggtggcaccggttgtcacaaaatgttgggatatcattcggaagacgcggtttaaagcccagaaatttgaggtgccaatcacagtttctgtgggaatcaccaatgtgaaagcgtctgatctaacaatcgatgcaatgtacaaacgggcagatgataatgtctatctgagtaaacatgctggtggtgatacgattactattgatggtgaaaccatgcatcatgataatcaggatttgagttcgacatatgccttttttgcgcaaggaattatgcatccagatagttctggaacaattcagtcgtcttcgcggtggtgtaatgaacttcttttgcgcatgtatgatcacgaacatgatcgttggattttaccagagatgtttgaactgtcaccgaaaacgcaaattgaactgattaagaaggtcctggcacaatctaatactaaacaggttgcggtcaaccttacacaaacacaattttgtagtgaacttgtcgccaaaaccttaactaaatttcgtaatagtcctgatggccctgatgatttaacggttgaaatcgtagatgtaccggacatgaaaatcacgcgaaacatcaccgctatttatcgggctggcggggtgcatatcaacattgacgatgttggtagtgataatagttatgaattagttcaaaatctattgccgtacgttgacggtgtaaagtttgctttgcaaaacttacgtaagaataacaccgccgaggcgttacaggaacgggtaaaattctgggttgatgtagcaaaacgtaataatttaaattttattcttgaaggtgtcgagactcttgaagaggttcagcttgcgtacgatcaactcggcattcagtttttccaagggtattattttaataaaccaagtttaccaaccaaataaaaacatcttaactaggcgttaggcttagctaagatgttttttttgaacgcttcaaagttattggtcatcaatcgagatagtttatctatgccttaagggttccaacgactggaagtttggggagaacactctttaaatgtggtgactttaaaattgcctgtgagagatcttgtccagcaacattaccgtgatggtgaccgccttcccaagggccgacgttgctcatatcatacacggtgccatcgatggccacataggcaggatgtccattttgcccatcaaattgactcagttcctcaactgtaaattcttttgccatgatcgttactcctttcaaagggaatgtaacttaactatatccgttatcgatggttatcagcaacgaattagctcataatagggtgctaatttaatctaggtgccgcgggtgagctttcaggagagccgtgtagaatccgatttctgaaaaggtttctgccagccgttgcgcaaagtacgtgctattgggggcgtcggcaattaattttccggtggcatcaaagttatcgttagcattccagagaagggtgggtgttggtaagacaatcatcttgagcatttgcaagacttgaacaaccgattgtgctgccagcatcccaccgtcactgtacgaagaataggcaataagttgcacaggtttatgatctacttcgggaccaatatagtcgagtgcatttttgagagcgccagtaattgaatgatcgtactcgggtgttaaaataacatagccatcttgggctttaatttgggtgagccatgctgattcaacgtttgtcagatcagtgattggttgagaaagtggcgtttcgctgtgttcataaaaatcaagtggataatctgcaaggcggatccaattgtactcgtactcgtcattgttgacgaaagttgtttgcaggtatttaaaaatatgttcgcctagtgatccaagccgtgcagatcctaaaataattccaatttgagcttttgccatttcaagacttcctttttatataaaattattatatgactattcttaaagtatatatttcgggaaatttgaagtcaattttcatgtttgtaaaagcattactgaaatttagtaatttaatcacgatattatcatcggtctgtgttaaagtagatcactgtattgaattaaggaaagtggttaattgatgaaaaaactattagtagtaattagtagcatcgtgcttgccatcacaggcactttttggttgacagcgactgggacggttcatgcggccagtaactggaagttgaaagtcgtgaacgtgaaccaccatctttcggcgacctatgtccctgatctaaaaactgttgataataaccaacagttggatacacgcgttattaaaagttatgagcagctaactgcggcagcccaaaaagctggggccacgttggttgctggctccgggtatcgatcgtatgagcatcaaaaagaagtattggcacgtaatattcagcaacgtgaggccaaggggatgacatatgctcaggcgaaaaaggatgcactgaagactgtcaacagtccagggtcaagtgaacaccaaacgggattagcgatggactttttgacgcccagtgaagctcaagcaggcagtgatgtgacgcaagcctttgcgaagacgaagcagggaaagtggctggctaaaaattcatggaagtacggttggattttacgttatccgaaggggaaaaagagttccacccatattagctatgaatcgtggcatttccgctatgttggcaaacgcgccgcaagctatatttatcatcatcacctaacattggaacaatatgtagcgcaacagaagtaacttattggtggcatcacaattgtggtgccttttttgatgccggttaaactggtaaagaataaacaattcatgaattattaataaataatttctaaataaaggacggtttgcttgattttagtaggtaaacttctttaaatagagtcgtagcaagggttaaccactatttaatgaagtaaggattataacaatgacagaaaaaaaacaaacacgcgttgcaagaaatgaagataaaaatacagatagcccacggatgctatggctcaagcaacagttacacttgaagagcgttgaaaataccgagcccgttaagtttaatcaaaagacagtaagcggttcacgagtaaagtcggcaccggatagtggcgccagacggggtaagacagcatcacctaaaaatgaaagcccgcagtcgtttcaatcatcatcgttggtgacacggcattccatggaccagccgacggccccattgacgaacaagactaagaagggccagggcggttaccggccccattttaaggcggcaactagtgcaggcagaccgcatattaattggcgaacatggtttcagattcggacctttaaaaagcacccactgccgtttattctggcaggctgtgtcgtcattgccgtctttgtgattggattggcacttaatgcggatacatcggttactaaaacaacaagtgcttcaaccagtacggacacaagtgtatcaagtacatcttcatcgaaaaaaaagcataaaacgaccaaaaagagccatcgtagttcccaacaagcgacgaagacaacagagatagccaccagtcatgcgacacaagctgctaattcagccacttctggtgtaagccacacaaccgcacagtcatcaagtacgactaaaacggccgggacacagtcaagtgccacccaaaatcgggcaagtactgcctcaagtagtcatgcgacatcaacggctagtcatagtgcgagtgccaaaacagcaagtagtaccaccactagcaaggctagttcatcttcaaccgctgatagcagtagtgcggccgaccaagccaatactacttcatcatcagctgcaacgagcggcagtgctagttcgttatcaaattagatcgatcaaaaccaattgtaaaaacttatttcgctaaaaatgaagagtagaggtgcccaaatcgagctaaatcccatataatgggttagcatagtagcagatgacggagataatttgggtgccgccacacggtgacggtgaagtgaggttagaattgtggaaagtacgttttttattttaattattttgattgcattagtcgcggatgttattttacatcggcatttaaaatggctcccattgccgttttgctttattgtgactggaattttgctctcttttttaccgcaatatcaccactatatttttgattcggatttctttttattttttgtggtgacaccgctgctctatatcgaatcacagagtgcgtcacgttactggatcgggcggggcgccattaatattttttcactggcgattgcccttgtagtggtcacagtggttgcggttggcttttcattgcacgtgttgtttccgatattaccgttgtcactcgccattgcgctgtgcgcaattgtgacaccgactgatgcctcagccgtgagtgccttcatgcagccaaatcagaaattcaaaattcccacgattattttacaaaatgaatcgctgtttaatgatgcgtctgggtttgtggcctttgatattgcattagcagcgtttgcaacgggaacaatttcactatctcacgcaactggaactttcttcgttgaattcgtgggtggattagttttggggacagttattggcatgggattccactggctgcgcagtaaaatgattcggtggaacgacgatatcccatttatcatgatttcgttggagctaattgtgccatttgtcgtatatgtttgcgccgaaaagatccatttttcggggattttggcagtggttgcggctggactagtacagggaatggagaccgataagttgcgtcttgtttcgagtcaggtgcagttggtccgtaatcatatctgggaactggtttcgcaagttttaaacggctttattttcatgttactgggaatttcattaccagcaattatggcgcgaattgtgtctttgcggccgggattattggtgtttttcacattaattggggtaactttgtatggcttaaagtttttattgcgcctagtgtggacccgctattttgtttggatgcatctttccagtaatcatcgctggttagatagttgtttgatggcggtaagcggggccagcgggacaatttcgctttccttagcatttttgttaccacagtttaaacggttaccgggtgggattgatcgaaacgcattgctctatattgcgacggtggtcattttaatcagtttggcagtcgctgcaattatcgtcccgaagatgacgaaggaaacggccgctggcagcggaaaagcagaaatcgattggaatgctaaaatgatccatcgagcattaaaaacggtgcgagctaaccgccaacatccggcggaagttgatattgtgattagtgcgctaacgcaacaactgcaccaccacgatgctaaaaaccaacgactagctaagaaaacttttgatgtggcccatggggtagaacgaacggctgtaaaaaacttattggataccggtgagattacgactgatcagtatcatatgtatcttgaatttattgaactggcttataatacggtgcacagtaattttcttcagcgactatggttgcgcctacgctttgggtcacacacgttgaaagtctatcgtgattttcaaacgtggcaagatgcacttttgacgagcccggtagtgactgagcaattatattggaaaaaccagttcgaggaacacggctgggaaattaaacaaatcgaatcggttggatttaaagcggccatcaaggcgttggaagattaccagcgaacaacgggacgccatcttaacggcttacatccggtgattcgtttttatcaagaacggcaccggcggatgagtttgccaacaccagattcgaagctggtttatcagctctttttgcaggcgtttcatgccgagtatgaatttgttcagcaattagtggcagatgaaacagtcagtgttagcaaagccgagacgttacaacaacaaattatttatgatgaaatggcctacttgaatggtggggaagggttcattaaacggtagctaaaaaggcgttgtcagagggtgaagttgtctctctggcgacgcctttttaattacggaatatccaacgagcaatttggggctcgtgatggttaagccactgaaatgcgcgtgtgtggagcagccagtggcgaaagtgttgagaaattttaccgacacaaatgagggccaagatcaagaagggaataccggggaggattggtaaaataattcctgcaataccgcccgctaaactcgtgatggctaacagtccccaacagactttaacgatgatgtgaatgtgatcaccccacttctagttttattgtaaaggggtgtcaccaagatataaagtaaaacgctttcatataaacaaaaagacccacgcaatggaccgttgatcggttaattgcgtggatctttaaaattacgcttcgtagtagttttgtgtgccagtttcaattaggtggctcgctgattcgccagcgattcgaccggagttccaagcaaaggcacagctaattccttcagttgttgggtaagaggtgtcgtacatcccactagcgttattaccagcaacgaatgcccccttaatcgggtgtgcattcggtttgagtgcttcaagcttttcgttagtttcaatgccgccaatggtcccaagggaggtggagcgtgctttgattgcatagaatggtccctgttgaaccggatagttcatgaaattatcggttttgtagaagtcctcgtcatgaccacgttgaaccaaatcattgtaccgtgcgacggtcgcggtgagctgctcggcggaaacgtgtagttgagcgctgagttcggctaacgtgtcgcctttaaaagccgcgcctttttccacggcctgtgccagatcggcatcaatttctgtgaacggcccgacgtgatgagtaacctcttgatgggcaagggtggtaaatgtgcgctcaaacgaatgtgtcagcggaagggcactggttttaagctgatcaattaagtgttggtcgatcacaaagtagtagtacccgcctgcttgatatgtggcatttccccagagtgcgaaatcgtaaacgatgccctcatcaacaaagcgtttccctgcggcattaacccaaagcagcggtaaattcgtgagggtgaagatggtatcgttatgccatttgggatcggaatctgacacaacggatgctgcgtgattttcgaaggtcccgagtgattttgtatcggcgcctaagtcggcaagcatcgaaatgccatccccagtggccttccgttcacccatgctaaataagttcttagcgtcaatgtctaagtactgtttgaccatctcgggattgccgatatagccaccatcagccacaatgacagcttgacagttgatcagagtctcatgcccatcgtgttcaacaacgacgccggtaacttgttggccgtcatattttaaggatttagcggcggtttcagttttcaaaatgccaccgtgatctaaaaagtgctgcataagacgttcgaatcccgcaaatttatcgatatactggtggtaaactcgtgggcgatcctggtgaacttcttgcgtattgttcacaagttcagtagcgagaccatgatctgccagccagtcaattgtatcggctgacttacttaggatggccttagtgaggggggcgtttgaacgataatgcgtgtaagtcatcatttcctgataggcctgtgctagggttagggaacttttggtagcctgttgttgctgactattaacggcaaaaagaccttgtgcgccgaacatgccagcacccccgtagcggtttcctttctcaagtaaaatgacattttttgaagcttcggcaagtgtgatggcggccccaatgccagccgcgcctgcgccaattacaacaacgtcggtttttgtcatgattcatcctccaatatgcaaactatgattagtttacagcaaatttataaagatcctactttttaattaaaaaaagcgtaaattagtggtaccgattacaacgtgacggttatcatgattatccggttagatgccgttactaaggcatttgtcggttctttttttgaagcaaaacgcttgataaaaactcaattcgtgttatattactctatggaactgagcgggcgctcagttagataattgttaacttagatggctaatcaaaagactgcgttaatatggtgttaatcgggtgtatcaactgattaaatttatattaatccaaatgctttgaattagttctgataggttgccgaatttctaagccaatagaaaagaggaacttaaaaatgattaaaaacgaccaaccaaaggataaaattattgatgtggctcgcaaactgtttgctagtcgcggttttgaggcaacgacgacacgaatgattaataaagcggctggaatttcggaaggcgcactttactaccactttccgcatggtaaacaggaaattttggatacaattgttcagcagggaattgaaagtcgggttagtttactaacggtatcactaacaaattcgacaactgtcactgatatcgaaactcaaatgatgacattattcgatcagctatggcaagcattccaaagtgaaaccagctatcaatcgttcattattacaattcgtgaacgaatgttgttgtctgatgagcagtctcactggttgattgacgcgattcaacaaattcaggcgcgattatctcaagcctttcaaaatatcgagaaactggcgcttaatgacagccaagctgctgataaccttgcgatgatcgtgatgtcgatttttcagaaggtactgtatgatgaattgttgatcaaaaatcagcggcgattgagtgctgatgttcgggaacgggttcgccaacagattcactttttgctagcgccgattcaaacaactacaaattaaaaaacgtccttcctcgatttgattcggggagggatgttttgattagaaagcggataagaattagaaatcgtagtcgctgttatccatggcttcggcattacccatcaaatagccagcaccaacttgggagaagaaatcgtggttcgccgtttcggttgagatgccgttcatcacaatcgggttgatatcttcaatttcggcatgggggaagcgggattcaaagcccatgttttgaagggctttgttggcgttgtagtgaacaaattgtttcacgtcttcggctaaaccaattggcgcgtaaacttcttcggtgaatgcaaattcgttttcaaggagatcatcgagtaaatcatccatccattttttgaatgttttttgttcagcttctggcagctcgttatagcctagttggaacttgtagccgaggtaggtgccatgaacagattcgtcacggatcaccagcttgatgacttcggaaaggttggcgagcttattgttaccgcggtaccaaagtggggtaaagaagttggtgtagtacaaaattccttcgagaaagacacttgcgacctttttttcaaggttgtttcctgtttggtaaatgtcattgatccgtttggctttgtactgcattcggggattattgttcatccaattgaagacttcgtcaacggtggcttgatcgttcaaagaggtcaaaatagtgccgtaactcttggcatgaattgactccatcatcaaaaagtcattgatgactgccgcttccttccgtgtccgaacgtcgggccgcatgacgtcgacgccttcttcggattggagtgtgtccagcaaggctaatcccccgacaacccggttgatgactgacttttcggtgtcagaaagtgtccgccagtcgcgtaaatcattagaaacgggcacccgtgtatctaaccagtattgtgccgttgctttatcccatacatattcgtcaaattcgtcttcaatgatgtcccagttaattgttttatagctcattagttaaatgctccttagaaatcgtagtcgtcatcggtcatttcttcagtgtccgattcgttgtttgctgccgtcacctgttgcaagaattgatcttggtcgatcatcaatttcttgagttgcgctactagtggagatggctgaacttcgtagctagcatcgaaaccaagtgatgttagtgcatgattggcaccatagtaggccaaattgatggcttcggtggcatcttcaaggttagcttccaggaaatctttttcggtttgcatgagttgatcaaactgggtgttaatccaatgctgcagttcggcttggtcacttgacgcgaggtcttcaaacccaaggtgaaatttgtagccgacataggcactaaagatggcacttccacgaagaatattggccaacatttggtaggtattgacgagagaatgggtttgaagggttgtccaatatttaccaaatgaaaggccagtttcagtcaaaatgaaaagggcttttttttgtaaagccgtaccattggtgctcgtttgagcgagttggtcgatttcagcttgcagatcggtattattgtctgcccaagtgaaatttgcgccaccattgcctggaatcagggcccggaaaatggtcgtgtaactcttggcatggactgatttcatgaaggtaatggtatttaatacggattcttcttgttgggttcgccgatcatgacgaatggcaggagtaccgacctctgattgatagacggctaacatcgatgcacctgccaacatgcgggtaatggcctgttgttgagtggctgatagctgttgccaagctggttgatcattcgtgacgggaatccgaatgtccaaccaaaagttagtggtgagttgttcccacgtgtatttatcgaaattatctttaatgtcatcccagttaattgctttgtagtataaatagtccatcgttatttgttcgtctccttagttaggattcacaggtgtacgggcaccgtgatccagtaacgtgttgtcggtgggttaaacgggcgctaaccctgaatacatcccctagatcatgcatgactcgcattcatttgcggttttgatttcgtcgtcttctgtgaatgttcggatgtaataaagtgacttgatacccttggtccaggcgtaattccgtaaccggttaaggtcccgggtcgtcatcttcaagttgtcattgtccttccactcgtaaaggtcgggtttcaaaactgaacgcatgaacagtgtcaaactcatgccttgatcaatgtgtttttgcgctacggcataggtatcgatgattttgcgttggtcgatatcatatgcgggtgtgtagtagggcaaagtttcgttagacaggtagggtgctgggtagaagattgatcccactttattttcctgccgttgttctactaattgtgtgattgggtgaagtgacgcacttgtttcattgacgtacgaaatggaaccattcggtgccacggcaagtcggttacgatggtaaagaccatccgccatgacggcctgtttgagggcctcccagtcggcaacagatggtaatttaatgtttttgaaaacttctgcaactttagtgctcttaaattcaaagtcggcgttcaggtattgatcaaagtaactaccgtcggcgtattttgattgctcaaatttggcgaaggtttcgtgacgttcgcgtgcaatttggttactcgtgacgagtgaatagtagtttaaggctaggaagtaagcatccgtaaattcaagggcttctggtgagccatattcaatttggtggcgtgcaagggcggtatgcagacccatggcacccaatccgatcgtatggtaaagttcgttaccatgtttaacggttgggacttccttgacgttggttgtatcggtcacgagggtgagcgcgcgaacggcgaccgcaaccgagcgaccaaagtctggcgaatcaatcatattcataatattagttgatccgaggttacatgaaatatcggtaccaatggtcttatacgatagatcatcatcaagttctgagggttcctggggctggagaatttcactacagagattactcataataattttgccatcgacggggttcgtgcggttcgccgtatcaatgttcaagatgtaaggatacccagattcttgttggagttgagaaatcttttgttctagcttccgggcgttaaagaccgattttttgatattcgggttggcaaccatgttgtcatattccttcgtgatatcaatgtaggcaaatggcgtgtggtattcgcgttcgacgtcatagggactaaaaagatacatcggttcgttagtcttgagcaattcatagtatttatcgggaacgatcagtccgagggacagggtcttcacccgaattttttcatccgcgttttcttttttggtatccagaaaatgtaaaatatcgggatggaaaacgttgagatagacaaccccagcaccattacgttgaccaagctggttactgtaactaaatgagtcctcaagtaacttcatcactggtacaactccggacgaggcgttggcaatttttttgataggatcgcctgaggcacggagatttgacaggttaacaccgacgccaccgccaatccgtgatagttgaagggcggaattaacgccacggccaatggagagcatggaatcggccatatcaattaggaagcacgacaccatttctccacggcgctttttccccgcgttgaggaaagtgggagtggcgggctgataacgctgtgaaattaattcatcggcaacgtcattagcaagttgctcatcaccgtttgcaaggtagagggcattgaagacaacacggtcgataaagccttccaagaattgttgtccgtcgttggttttcatggcgtactgtgtgtaaaacttgtacgcgccgagaaagctgcggaaatggaagtgatgctctttcattcggtcgaacaaggaccgcacaaattcgtgggaatactgattcaagatatctggatcaatgtaatcttcgtcgactaagtagtttaatttggcatccaatgaatcaaattgtttagtctttggttcgaccgtctcttcaaaataggccttgagggcttcttgatcgtaatatagcggaatttctccgtcgacggggatgtttacgaggttatttaagtaaaaataggtgttttccatttctggggtactagttgccattagggactactcctttgttgtttgagaactgaattgatcgcgataggttaggatggcatcggcgatgcggggaaaatcgtgtgctgtgccacgtaattcaaaatcggtaatgtagggaaaaccgaagcgctcagcgtactgtttagccgtgagtgcaaactgcttattaaaattacgattgccgctaccgataatcccgtaacaacggcgataattatcttcgtgttctaggtaatcccccaaaatggtggtcaagatttcggtgtagccgttgttaactccgttaccgcccttaagaaaggccggcaggaaggcaacaaacggttggtcgagagtggtgaattcggggtgttctttaacgttaattgaattaacttgaatgtggcgttcttcttcaaagtattttgtcagtttgccaataaaatatttggtattaccgctcaaactgatgtagagaatatttacaggttccgtagcgaatcatcgtcctttgtctatatatagtgtgacgcaaattattgtagcacaatatatagtattggaataccgactttcccaaaatgaatctattgaattgctaaaatatgaattaacattatcatttgataatgacgattaaacggctggtaccggggatgattaaattacggtggtgaccaaaaaagacaataaaaaatcgatttgaaataatgagatttcaaatcgacaattttttaatcaagttttatgagtttagttgggtcaatgacgcatcaaaacgtgccagatgacgcttgcgaattgaacgccagataaattaagcgtgtcgtcgttaatcaatcagccacttggctaacttcggttcgcgccgttgaagccacttggcaagacgtgttgtgagcagccaccgatggaatcggggtgatattttacgcagactataaaccattagaattaagaatggaatgccagggattatgggtagaacaaaaccaacaattgaccccagaaaacctgtgagcgtcaatgttgaccagagtagtttagtaaagaaaatttgcatagtggcccccctcatcattaagttgtgttcaatatacggaaaatatcagaaaatagcaaacagaatgattgctgtttagatagtcttaaacttttgttagatgatgatatatataatttgaatataaaaaaacaactatatcgtaatcgatagagttgttaggacattaattttaaacttttcatgagcattcgattttcgcgaccaaagcggtcctgacggtggtcgaatagttcgtaaccgaggcgctcgtaaagaccaacgtggcgggtcacaatgtacgtggtatcaaatcctagctgctgggcgagtgtttcggctcgactaacaagctgctcactgagtccttgaccccgataactgttgttgacaaagacgtatccaacaaaagggctctgaacggcagggacaatatcgtgttcaagcagggcgcagaagccgaccagttggccatggtcactaaaaacgatgacgcgttcccagtctaaaaaagcgtgattgtacatgaggtatgctaggtgacggccagcggtccaagtgaccgattggatttgttgggcaaaggcatcccagtgttgatcgtgttgtttcatcacgatgatcttcattgattggtttcctccgattcgattcacgattctgcaactagtagttcggggcgaccggtatagtagccctggattagatcgacttgatagtgattggtgacatattggagttcggcggcagtttctagaccctcaacagcaaacactttatcgtgtgctttagcaacactataccagaatttgagaaagtgctccacagtttggatgtccttaaatggacgtaagttttgaaaagcaaacttgaattcatccacgtaaggattcatttcttgaactagctggggggtgttgcgctcggttcccacatcgtcgatgcaaactaggaggcgatcttggtgaaactgttgtgctgccgtaacgagttgttcatgactgatactagcatcaaagcgttcggtcaattctgtaatcagatgaatttgggtttgctgttgaatccgagtcaccatttcaataaagaccggttgaacaaattgactgggttccaagttgaacgacagaatttgtgtggtggatggaacttgagtgagtacttggcgaagaagattttcaatttgactggcatgaattgcggtgaaactgactggtaggacccagtgattatctcgcttttcccgaataaataattcatatccgacgggtgaagcagatgtggtactgaatttaggctgaccgtaaaatgcaagcgtcaagttaaaaatccctccttgagaattaagtgaaacaccaattaatataagctgatatatgtattaccaaagagtgattctaaacgcgtttgggagaagatgcaaggaataagtgcaactaaaaattgtgaagattatcatgagccacgtttgggtggggatggtaacgctcacgaaaaaatattacagtttagtgactatcatcgggtgaattgggattgacaggttattttagaatttgatatactcctcaacgcgattttgaagggagaaaatatgacaacatatcaattgatgcaactgagtccagcaacattgcgccaaaaaatgcgagatagtaacggtcacgagcgacgtcaaacaacatgggccctcttactgcgggatatttgtttattatgttttgcaattgtgtatattgccggatttagctattgttttgggcaactcaatggctacgtgggactggctagcttttgcatgttgcttagtattcgatttgtgaattatgggtatcgggtggccgatagtctgggggcgctggcgattgtgctcttgttgatgggcgggctaagtttctggttaccactactaccgattatgtggcgattagtcttaaatgtattggcgttgctcattattttacggctgacaacgatgaacccactgctgggcaatggcggtgtttatgcatttagttatattattgtaacaagcatgtcagtgcatggtgccgacgttgcaccgcgggggtgggcattgttgctctcctttgtgatatgtggcgttgtattatggcgtcagcatcgtaataacaatcgccaggtccgagtatggacggttctgcggtttaccggatggcacgatgccgtgtttcgatggcaatttaggttagcaatgggaattagtattgcgcttttcgtaggccagtggttgcatcatggtcgagcgatgtggctgggatttgcggggatgtccgcattactcccgcagcaggggccactgacccaacgagcggtgaaacggttattgggtgttgtgcttggttctgtagcttttgccggttgcgtggtattattacccagtcagctaatttttattttggcacctgtgaccggatttttactcggattgactcctagttatttttgggcaagcgtttttaattgttttggggcactcacaattgctcaaggattattcggtacggttccagcgacagaacttcgaatttttaataatgcggtgggattgattacggcactattaattgctgggcttctcgaattagtttggcaaaaacgacaacataaacaagcaacttcaccgatgtgtgaagctgatgatgggggcgaccaacttggataaagtagcgtttcggaaacaacaaattcaaaaaatgacgcagatgcaggcacaaacacaggcagagtccgcgcaactcacgcaacagttgtttcaaactagtgcttggcaaaaagcacgatcgattgcgacaacgattagcagcccgattgaggtgaatacgcgtcaattaattacgcaggcgctgaaggacggcaaacaagtcttgttgccgaagacgatgccgcaccggcagatggcctttttgccatttgatgaccagtatgatcgactagtggttagcaagtttggtattccagagcccgcgtatgatgcggcattggttaatcaaacaccggagttagtgattgtaccggcgatcgcgtttgactgtcaaacccgtaatcggattggatttggtgccggatattacgacggctttttagcgggatatcacggcgcaacagttgcgctcgtgccgacagtaatgcagtatgatgcggcacagtggccgctagaagaacatgatattaaaattaatcagttaattttgtgccactaaaaggtacttttagggatcatcatggttgtgatgatgcctttttctttgctaataacagataaaaacatttatacttataataagtaaacgattaacgaggtaacctattcattcaagggcgcatgactgggggcggtgagatgaaaaaacaaataagtgtcaaaaagatctccttcgcgggagcgttgttattaggaatcaatggcattatcgggtccggcatttttctattgcctggccatttgtttcaagaagcggggagttacagtatcctggccattctttttgcgggacttgccacgttgatgattgcattgaactatgccgtgatggcctctaaaatggatgatgatgggggtgcgtggacgtatgccgatcgggcatttggatcattggccggttttcaaacgggctggtttggctggtttctgggcgtgatcacaattagtgcggaaattgctgcatttttaacgacgttggcgggatttatgcctctcgctagccagtcactgacctataaattaattgctttaagtattattaccatgattggcattattaatctgtttgggccgtctttcgtgacctatttagacgacttgtcgagtgcactgaaagtggttatcctatgtatttttattattgctggtgcggtcgcattaagtcattttaaggtgacattcggtcatcacgcgacgactggccacggctttactggtgcgtttgtgacggcattctacatgtttacgggtttttcatttttacctaatgttgctgggcaaatgaaaaatgctgctaaggcgctaccgagggtgattataatcacgatgattgccgtttccttaatctatgttgcgacgcagactgtaacgattgagtttcttggaaattcattggccggtgaaaagttaccagttgctgctgcttttggtattattggtggtcaaatggggcagagtttaattttgagcgggatgttagtatcaattttgggagtcgcaattgcagtatcatttgatacccccgtggaattagcttcgatggcgcgcgagcaccaattaatgccagattggttggcacgccaaaatcgatacggtgccccgtactgggcgattattttaacaaccgcgttagctggtgggttggtagtgagtggtgaatatatctttttagtgaaattgattgttttcagttcatttattcaatacattgcgaccattgcctcacttattaaattgagaaacgaccaaactctaggagtgggaatgcgactaccggggggactactcctccccatcgcgtcgttactgctcattacctacctgttaacgagttttgccatggttacggttttgattggcctcggatttgcggcggttgggctagttattcatgaagtcgaacgcgcgatcaaacaaaaaaataagtagaaacgcttgacttactttttgtaagtgaatagaatgggaaccgttaaatgaaattcattgaacgggaggaaccatattatgacaattacaaatggctatgagcaaaatgaaaacgaaaaggaactcgatattttaaacttaccagcgttagagcaggaagcgcagaagattattccaactggtggttttggctatattgcgggcggttcggaagatgaatggacgttacatgcgaaccggacagcatttcagcataagcaaattgtgcctaaggcgctcagtgatattgaagatccacaaactgacacgcgggtattcaacttagatttaaaaacaccaattatgatggcaccagccgctgcacaagggcttgcccatgtaaaaggtgaaattgataccgcagccggtgtggctgctgcaggtgggttgatggcacaaagtacgtattcttcgacgtcaattgcggataccgctgaagccggaaatggggccccacaattcttccaactttacatgagtaaggattggaatttcaatgaatcactactagatgaagccaagaaggccggtgtcaagggaattattttgactgttgacgccacggttgatggctatcgtgaagctgacattatcaatcattttcaatttccaattccaatggctaacctaacgaagtttagcgaaggcgatggtaaaggaaagggaattggcgagatttacgcgtcagccgctcaaaaaatcgggcctaaagatgtggcacgaattattcaatatactgacttaccagtaattgtcaagggaattgaatcagctgaagatgcactatatgcgatcggagccggtgctgctggaatttatgtttccaaccacggtgggcgccaattaaatggtggtccagctagttttgatgttttggctgacgttgcgtcggcggtcaaccatcgtgtaccgattatttttgattctggcgttcgtcgtggatcggatgtattcaaagccttagcagctggtgccgacttggttgcaattggtcgtccagcaatttatggtttggcactgggaggcgcgcaaggcgtggcctctgtcttcaatcatttgaatgatgagttaaaaatcattatgcaattagcaggtactaaaacgattgaggatgttaagcatgcaccgttattagatattaaatactaattctttttaagggggtgtccatcaaggacactctttttttgtaaaagaataattgaaaaagtgagtaaatcgtgttaaattccaagaagattaattgattgaaaactgtagttgaaatcgagctgataactatgaaaaatgcgaccatagacgaaaaaaataaattaaaaagatatcgtggcttattgttaagtgaatgcgtggatgtgattgatgagcatgagcatctcaaaagtcagcaacatcaaattggtgatttaaaggcgacttgtggattgtgcaagcgctacattgaattacagagcacaattgctaacgtcgccgaaatgattggtcatattgaagttgccgaggagcgagttagcgcctcccagtctgcaacgttaaactactttcaatgccagcatttagatcggtcagtgtatattgttcggacgacttctgctcaaaaagtggctactattattggtaaaacgttagatccgtcggagtggattacaattcaaattaccgccaaacgagcgtttcggctgatcgaattattggatggtagccatggtacccagaaaattagttttcttaaaggcaaccagaaattcgagggtattatttcttcactcgaatcctagttaccggtgtcggtggtagttgcatgaatgacccgttaaactacaaattagtacgctcaatttaagaaccatgacgtaaaaaccgagtttgagacgaaacaggatgtttcgttcaaacccggttttatctttttttaataactgttcatagaaaattcggaaaagcacgtatttccgacaaaagattattcaaattattttgccatcatagaatctacagtgttaaaaggaaggtgaagtgatctgaataatcaaattagacgctctaaaacgattaaaacatatctatatgaagttgattttatgcggttgttttttatattgggcgtgatttttaatcatacagttaatacagtattagctgcgatgaatgggcaagacactgccagtgaaacgttaaaaagtattcgattaatgtttcattacagtcgtaacggctttttatttatgagtggcttagtgctgacgctcaattattttcatcggcacgactggggccgcttttatcggaaacgtttcagtgggagtttgtggccgtacctgctatggaacttattctttttagtcctatttacagagattgatgacgggtttacaacgatgaaccttttttcaacacagtacttagctattattatccacggtaatcgtttttatatgtattacatgttgttggtgatgcagctttatcttatttttcctggcattgtttggctgttcaaaagatggcccgagcagcatcgccgcatcttaggtattagcctttttatccagcttacgttggatgcgttaattaaatattggctgcaaaatttagatttatctgcttatccctactggtttaaagcatttagcattaatattttttcataccaattctactttatttctggtgcgtttgtctgtttacactatcaagcagtaacggattttattcatcgacatattaagtggattgcttcgctggcctgttgtttgtcggttggaaccattttttatatgcattggaatatgaccgttcttggtttgagctatgatcgggccacatcgccgcatcaaccttacatgcaggtttttgatatcttaatgattatgacgatcttttggattggacaacgatacgcaacctggcggcaggccgggatgccaacatcaattgaatggttggtaaaaaatggggccaagattagttttggcatgtatttgaatcaatcgctgggactcctggtgcttaagctgattttgaaaaatcagagctggcaagattggcaatatctattaatgttgccactcggctacattggtgttattggcggttcctttgcgatcgcgtggttctgttataaggtgccaccatttggtgttttgattggtcgaccgcagtggcattttcggtgggcaccgcttgcgacgaagagtgattgacgatggtgacgaaatggacaatggtcatgcgttgattactgaagagagaaaatgagtttttgctaagaaaaaaggcaataaactcccctcaagtactcgttttccggggttgaatattgtatcctgttaatattaattagcagggatagagaaatctttgggggccatttatggagttatttggcaatacatttttttggttgttctttttcatgattggatttgtagcaaccctggaactaattgaggacctaggtgcagcgtatgcaactaagataattcatcggacggttcaaacagcatggctcgttgttggctatgtgttgatcatcattttatttattcgaatgttgcggttgttcgggaccacatacacgtggacggccaatgcgttacgagatgggacgcttatttatattagtaccaagttcaaaaatcggcacgcatttttaacgttgatggccttggtattggtgtcgttttacccgtattggcatggtaattggtgggcgttaactgcattcattggcactttagggcttttggtgctgatcaattattttcgcgaatggattcgagctaagcggtggcgcctttttatcgtgaccagtggcgttagcctgattttctggctgttcaatatgtacgcttaccagtacaagttagcggaaacattgtcgattactgcgtgctttattgtggtgatggaaattgcctacttgtacgatcggctgttaatctaccgcaaaaaaagaacacgagagctcttatatgatactcaacatgatgcactgacaggggttcatagcgtcaaaaaatttagtagtgattttacaaggtatcggcaacttttactgaccggtcaatcatcggcggtacacttagtgatgattgatattgatcattttaaacagatcaatgatactcatggtcacttggtgggggatgaagtgctccgagcatttgcccagcattgtgatgcctatttggatcaagccttgtttccatgcaatttatatcgaaccggtggcgaagaattcagtatcattgtgaccgacggtgccagtgatgtgcaagttaaggagattgttgagaattattgccaggcgttaaagaatttttccgtacaatctggaaagcagcagattcaaattacgatttcggccggtatcacacagattcagggcgacgacattcataataacgcggttattgaacgcgccgatactcatttatacgaagcgaaacgggcggggcgaaatcgagtttttgctgatgaatgagaaaaaacgcaattatccgaataggaaaaattgcgttttttgtatccgatacggctagttcgcggttcgatgagtgacccgtagtgcgactaaacagcctaattccatcatcagtgtgaggatgaaaatactgcgaaaaccgtaaacacttgccaaaacaccgcctaaaacaggaccgatgacgttgccaaatgcctgaaaagattgactatagctaaatatttggccaaattcatttttatttgttaactgcgtcatcagagtttggtaagcaggaatgatggcagcgtccgttagtccaaaacagaatctcccgatcactaactgggatgtattggtgagccatagcatgggaatcaggatgatggcggcaccggcgagaccccaatagatcacacgaatggcaccgattcgatctacgagcttaccaagtcgtggtgcagctaacagggttgcaaggccaggcgccgccgttaccaatccacttaaaagagccaaattgcgagaatgtggcgatagttgatgtacgaataggctcacgattggctggatggttgttgaagctgcctgaactgtgagaacaatgaaaaaaatcacgagcaaaagtgatgaaattggtgttcgtgaccgttgaaaacttttagttggttgtggaacaaagtcttctgtcacaaacaaagctgtgctgataaacacgacgagcatgccaattgcggccacgatgaaggtcgcacggtagcctacttggtccgcaatcagaccaccaattaggggaccaagtagtgtgccagtcacaccaccggtggcgagggttccgagtgcatggccctcgtgtgcggcgggtgtcgcatctgcaatcagggcttgcgcgttattgatgtagcccgaaaaggcaccttgcaaagctcgaaatatgattaaccaccaaacatttggtacccaagcattggcaaaaatggttagtgtcatcaccccactggctcgtaaacacatcaatttacgaccgtggcgatctgccaagcgtccccagatgggtgaaacaatcgtttttgcaagataagttacggcgaatgcgatactactcaaaatattgagagtccacccatgatagtttccgagcgtggcaatgtatagtggtagaaaaggtaatgtgagtgcattaccgagctctgtaataaatgaacccaaccaaagaatggataggttgagttgccagtgtttttgcaaaataatcctccgataaccagtattagtgaaagtataggacctttattttcaatattcaattaaaaaaatcttccagagctattaatgtaagctctggaagaggtgtaatcgtctagttaaaatcagaatgacgaaacgcacgaataagttgcaatttactaaaccaatgcaggtagatatattcgaaaagttggattccaacatagccacataatatactgatcccaacattgatgagtgccacggtgtgtaattggattccagcaagtgttcgcaagctaaacagaatcaatagtaagataatggttagataaccgacaaaccggctagtgttaggtaacacacagatataaatacaggccattaaaacgaccagtttgagaaatgtcaggtcgatcggggccgtggaattatcagtaacgatgagcaatagttgattaatgagtaaccctagcaggctggtaccaaaataggttaccaaggcccacaaagcaattagcttatgtttgaatccccacagaataaaccagagaagcgctgcgtaaagattcagtagtaggtgggcgaggatgaaggtgattgtgtgattcagccagggatgattaaacggaaggtgagagatcacgccttgtgaaaaggaattaattgaactaagtagcgaagaatccttgatgacaaggtagatgagggttccagccacaaatgttgctataaacatgttaacccaccgctctttggcatccacaatgtagatgagaaacacctccataattagtactttcatgaatattttaccaaaattccggtgacaaaaagcataatattgtattaaaaacacaaataattggaccaattgattgaatggtaaaaaatcatcgaggaacgagttggtttatgcgatcgagtttgataaaatcgatcggattaataattgaaagtgagcatttatcatgatcccaacgacaaaattagagttgagtaaaacggcaattgttgtcattgacttacaagaagacattctggcagcgaagcccttatttccaatttctgcgcaagaagtagttactcgcaataccgcgttaattcatacatttaaggatactgatgttttaacggtgttggtgacggttgatcgaacgacttttcaagggttgtttccgtttccggatggcacaatgcatccgggtgaatcgccacgttcggtattgaccattcccacattaggtggtcaagctaatgttattcaaattactaagcataatcccggtgccttttttggaacagatttagacttacaattgcggagacggggaattcaaacgattattttgacgggcgtttccacttcgaatggtgtttatgcaacggcattagatgcgtatcaaagtgcctaccacgtgctaattgtggaggatgcatgtgcggatcgagatcttgagaaccatcaattcttcttccgcaaactattcccacgaattgggcaagtgactacccaaaaagaattagccgagatgctaactaaatagtaggtaaaaaaggcgtccaaaaagcctcgattaatttgaggttaggacgtctttttttacgaaatttaggcaacaactaggcgcttaatgggttgcttgaaccaaattgattttcaacgtactcgcggtaaaggtcatgattagcaactaattcttggtgagtaccatgcccactaacttgaccattttcgatgaaataaatttcatttgcatcgacgatggtgcttaatcgatgggcgataactagtgtggttcgattcttcatgagtttttctaacgctttttggaccatcatttcagactcagaatccagactagcggtggcttcatccagcattaagatttgtggattccgtaggaaggcacgcgcaattgccaatcgttgacgttgcccaccagaaattttaacgcctcgttcaccaacttcagtatcgagaccgttaggcatcttgctcacgaagtccttggcgtaggccatttctaaaacatcccagagttgatcgtcgctatagctttcttgggcgccataggttaaattgtagcgaatcgtgccggccataattgcggcatcttggctgacaaggccaatttgttgacgccaattcgtgagattaagggctgctagatctgttgtgccaatagtaatcgtgccagaattaggttggtaaaagcgctccagcaaactgaaaatggtcgatttaccaccaccggaaggtccagcaaaggcaatcacggtgtttggctttgcggtaaaggaaacatccgttaggacttgtttctcatcgtagccaaaattgacatggttcattgcgagcgtttgtccgtgagtatcggtagtgagctgcgtttcgtgagattcttctggttgattgaggagttcttgaatccgaaccgttgagccacttgccttggccatatcagatgaaaattggccaagtgtgccaaaggggccaatcatttggacaaggtacattaaaaatgagaacagggtccccattgtgagcgttccttgtgcaactcgactagcaccataagccaacattccgacaacaacgcccatcatcaccatggtaaccaaaggtcctgagatggagtcgtagatggcttctttcagaccgattcgatacagtttgtgaatgcgtttgtgtcccgtgatttgctcattagtttcggcatttgaggacttaacgaggcgcatttcactcagaacttcaccagcttcgccgttaaagcccgccaatgcatcttgacgattacgggcaattttcatggcttgacgagtgacaggtagaatacaaaaaacaagtaatggaacggcgacaaacatcataatggtcattttccaatccatggcgatcatcaaaacgagagccccaactaattggaggatggaagtgaccattctcggcatcgatgttgcgataaaatctttaacctgagtcgaatcattgactaaatgggatgaaatttcaccggatttagtggtgtcaaaatagctaactggtagtcgtaaaagcttgttccaaagtaggtctcgaagcttataaacgacgtcttcaccgaaaaagcccaaaattgttccggaagctgcgctaattaaagcactcacgataaaaagtacaatgacggcgatgaccatcccagaattaaggtgcttaccaagaccgttaatgagtgattctgcgaatttaggaactgctaactgcattccagtggagaagagccctaagattagtcccacgatgagttgccaataatgtggtttggattgcgtgattagatggataaaatcgcgaagtttaaattttgaacgtgtaaattcatttgaattgaagtttgttggccgttgcatgaccggtacctcctagatagttgttattaatttagttaggattgatatatttctaactaacgatatggattatagttatttagttagtacaagtcaacataaaactaactaaaaaataaaaaagatcccgttcacggtgtgaacaggatcgacaagtgtaagttggttcaatgatattgctatgaaggttcgttatcgtttccgaagtttatcgataacgaagtctattatataatttatccggataaatacaaccgtattaaacagaaattggatcaaaaaaagccatccggtaagcgtttcggatggctttcattgcaacgaaatacggttaatatatagttgttagtaccattatataatttatccgtataaatgcaagcgttttcgataaatttattgaataacatttaatatcacacagatgtaaatcgaaggggttaattaaatggacatatacgtgtaaaggtatatctttccttatgggttattgttatgatgacattaattaatacgaataaagtgggtgaagccaaatggatcataccagacaatatgaagaaggagagaccgttgctgctggcgagggtgttcaggacgggttttatttaattgtgctggggaatagcgatattccaacttatttcagtatcgcagatgatgaggtatgcccgggcgattatgtaaaaatattggatggctacacggagaatgtggcgctctttttacgcgatgcagattggattatgtacggttcggttcacgccggcagaatgcggctagtttgcgtgattaattttttggcacaagactcagtatatccatgcttatatgtgacgccgggagactactatcctgatggtcaatatttggggatgattgatagcgaccatcaaaaaatcgaatattttgaaattgatcaacaaccaccattacaaaacgaattcgatttactcaagttattgtcactatatgttgatgatgtgcgcaagacgctcatgaattgcgatgcatttatgctgggaaatgtgcgcgatcattattttcatgttgaccagcggattgaaattaatgatttttaatgcctcaaaaagcactctgttttccgccagggtgcttttaaaagagttgaaccaactccgcgatattctggatagctagatgtaattcacaagggtaaattacatcatggcagtactataacgaagtgagtcaaagaaatcaaagaaaaacggttatttcgattaaattttttcttatataatacgtaaaaatctggaaatagggtagtgaaattaaaaagaactcccagccaagtaaattggttagaagttcttttttagccggatcttttttaccgaatcgagcgtttcttcttcggaaataactcattagcggcatgtaaaaattcattcagttgtgtttgcatcacttgatcatcctttttgtgaagatcatcaatgtattcatcgaaaaattcgaatacaagggcagcaaataggcgagatacgaactgtggttgtgaaagtggtaggttatcccggagaattcgttgctcaaaaatttcagcaatgcttgtcttaacctgcttttcaaagtccaactctgaggtatgaattttccgtaaaattcgtaattcggccagttgttcttccatttctggggtgattttggttaataaaatattatggcgccaactcgtattcaattgatgtttgagtacggtgtttaaagatttgatgcgtgaatcaatgagttgacgggccagatcgtatttatctaaataatgattataaaatgtccccttactaattcttgcttgtctggccagccctgtgaccgtaatttgatcaaatgatttgctggcaagttctgtaaaaaatgtggtttcaataatttgaatcgtttttacgattcttaaatccggcgtattatccatatcttcctctcctaaatattagacgatttagcattaaaagcttattaatgaacgcttctttgatttagtgccttcacactaacttttttgtcctttatactcactggtagtttctagcttaggcaaggacctaatcgagaattatttagaaaaaaattatgataaacaaaccgaaatgaacgatggatctgattcataatcagctgatcagtattgcagtactggtcaaatatccttgtagagcatacaccgacagggattatgagtcaacatttgaaatggtggattatatttttttaataatttcagtaagggccttttaggcgaaattatagtgataaatcgggtgataatgaacaaacgtaatagttgatttcattgatcattgagtcaaaaatatattgtttagcacagccttaatttgaacgaaacgctgatgtagtgcaacaacaagaatgaggattaaagtagtcatataactcagagaagggtttgatagtaatataattttaccaatattttctaatgatgacaattaatttgattttatattgcttgttcaacctacagaaagattcttttaaaggtcaatgtgatggtctaattaattaggagtgacgaacaatgaaaaagatgaatttaatcggacaaagatttacacggttactagtaattggggaagaacccagcgacgcgcgtggaaattcacggtggttgtgtgagtgcaactgtggtaaccatgtgatcgtaacgggtgttcgactgcgccatggggtgacgaaaagttgtggttgcctaaggcgtgacttgatgaaagagcgttcgcggactaatccggtatttcgccggtatactggggatgtaagtaatttttcagatgaacatggtattttgtattcatctctgaagaagtctgtccggaataaaaccggacatttaggggtatcgtacgataaacattctgacacttggtttgctcgactaatgcgacataatcgttatgtgttattgaaatcatttccaacgatggaagaagcaattgctgctcgcgaggaagctgaacggacctatttgggacggacaaccgcgcaatcttcacatgaatctgataatcgcaagaccgattaattggagtaaatagtcaaaaagcgaagatgtgatcgatatacgcgtcacacatcttcgcttttttgtgattaaaatcttaatccaggtgaagctgatcgacaaccggtgcataagcttttgaaagttgctcattggaagtgctgctgtctgctgtagaaagttggttagggctgacctttagatttgttacccatggaatggtggggagcaaaacaatgcgggagtcatttttgtaattgtttctgagcaacccgtagagatttttggctgtgtcggagccttgactttcgattttgcgcggcagaataaaaatgctggcattggcgatttgctgtttaaactcgctgattttggcaatggtttgttcaatttcattgatggaataagcggtcaaaaatacgggaatgacaaataattgggagtgttgaatggcagtttgatcttgctgagtatctagtgtcgctgtgcaatctagaaggttaaattgctgttgatcaggattgtttgacagaataacgctgtcgtcttgatcgacgcgctgaatcgtaacattgcgattcaatttgagtagatttgcggcaataaaataggccgtcgtggtttttccaactttttccgataaggcgagaaccgaaatagtcacgggtggttgattaaacttggtcatgagaaagactccatttctattttgatactttcagtataaaacaaaatgacaacggttacggaattttagttgttttttaattcttggaaagcgcaagtgcacgttaaaaggtggaaatcacacgttaaaaaaagattgcgcctctcggcaaaaacgttcagtacaatatgaggcgtggtgttgaatgggataatagggaggaaatattttgaagcatttttggcgatcaaaacgtgtcattatttttgcagtactggtggttctcatcattggtgggggattaattcgggcgcatagcgcaaagaaacaggcggccctacgtgatcgttatcatattatgacggtcaccaaaacaccggatttggttgaaacggggaccgttatgccgattcggcaggagactttgaaattaccagatggaaaagttacggtgcttgtaaaaaataatatggcggtcgagaagggcgaaactttggtaacgactaatgatgttgcccagattaataaactaaaagcactgcaaaacactttaagtagtgatcaagctaaccttgccttgaaacaacgacagctaacagcccttaagggacagttggcacagttaccatcgacagcggataactatgcagatcttaatgaccaggttcagtcgctgcaagcagatatcaattctgcacaggcaaccgttaataacgatcagttagaggtaacgactgctagtagtaataatgactcccaggtgacggcacctttcagtggaacagtaagtgttaaaaatggcgccagcggtcaaccagttgttaaggtcagttcaaatgggcaccaaattcagggatatgtctctgaatatgactatcataagatcaagcagggagaatctgtcgcgctcacggcacttgcggggcagcagaaatttaagggaacgattagtaacgtcgatcaacttccggatacaagtagtaaaacaaacacggcactttatcaatttagtgttaagtgtcgaaagcagctactggacggacagcacgtcagcgtcgcagtggcacagacttacctaagaattccccgttccgcagttttgcatcgtaacgggcagacggttgttatgcttgtaaaaaatggtcgggcacatcaaacaaaggttaacctcaaagtgaatggtgattttgctgtcattaagcagggccttcatgtgggagaaaagtttatcagcaatcctcaaaaggtgaaagacggacagcaggtgaaccaatgattgaactaacgaatgtgaataaagtttatcggcaaggcaaccaacagtatcatgtcttgaaagatatttcgctcaaagtgacggcgggcgaatttttggcgattgttggcccatctggttctggtaaatcgacgctcattaatattattgggttcttggataatcattttgatggtcactatcagtttaataagcaggaaattgggcgtctgaatcagcgtcaatttgccagtttacgtaaccagaaggtcggatttgtgtttcagaactttaagctaattacgaacttaaacgttggtgaaaatattgcgttgccattattatatgccggaaaacgacgagatgaaattaacgaacgaattgaagcggctcttgataaggtgggattgacgggatttagtagtaagatgcctaaaaatatgtccggtgggcagcaacaacgggtggcgattgcacgagcaattgtggctaatcctaacttcttgattgcggatgaaccgaccggagcgttagactcccataattcagctgacatcatgcagttgttcacggatcttaatcgtgaattagggacaacaattatcatggttacccatgacgatcacttagcgcaaatgtgtgatcgaattgttaaaatcacggatggtcgaatttcaagcgacaaggggatgagatcatgttagtcaaagaactgattatctctgccttgcgatcgttgcgttctcatccgaaacgaagctttttaaccatgattgggatcattattggcattgcctcggtgattacgattatgtcacttggaaatggtgtgaagcaagatacgctaaagcagtttcatgccacaaaaacgggcaagcagacagcaattattaattattattcggatggcacctctagtgcaaatgggttcgatcagtccgatttaagcctcttgaaatcggataataagcttaaaattgatagtatcaagattatggcgaaggacaatagctttggcatgccatcgagcgttcaggcgcagctcaatgatcgtaatcatttggttgaattaaaaccagttaaaaagacgaccaagacgatgattgcaggtcagcgcattactactaacgataatgtgatggaaaacaatgtggctaatatttcccgtggtttggcgaaaaagatttttcatggcagtcagaatgtattgggacgaaacatagcgatcaacgggcagagctatcaaattattggtgtatatgtggatcattctgaaaatccaagtaatgtcttggttcctcagcgggcatactaccggtttcagtcgacaacttctggaaatgaaatcaaattaacctttttgagtggggcgaaagtcaaacatttaggcaagcatgcacaacgcttactgaacaaaaatggtagtcatgctgcctatggtagttatgagtatgaagatagtgatgcactgaatgaagtcgggcatatgattgatacattgacatactttgtttcggccattgccgcaatttctctattcattgcgggaatcggagttatgaatatgatgtatatctcggtttctgaacggacacaagaaattggaattcgattggcggttggggcgacccagcgagcgattatggcacaatttctaattgaagcgatcatcctgaccgttattggtggtgtgatcggctttggtttgggagtgggaattgccgcaattatttcggcctttattccatataaagcagtggtttcactgtcgtcagttattctggcactcggtgtgtcaacaacggttggattagtctttggtattttacccgccaaacaggctgccaacaagaatttaattgatatcttacgatgaataagaaacggtcaacctggacaagtgggttgaccgtttttaacgattatttagttgcaatggtgtgtgcctgtggggcatgatccccgtcattaaaggcacgggcaaacttttgtgcaaaatcggctaacttaacgtgaccatcatgaaccgggtgttgtgtaagatcagcgtacatctcagatggttggcgttgcagctggctacttttaacaaacgggccgataatactttctggaataccattttggcggagtgcatcggcatattgttgatcagaaatttcaactagtcgaacatcaaaaccgagtgtggtactaaatgcggcaatcatttcagtccctgtgaaggtatcgcttacgacgtagcgaattgtcttgccggtcggtgtttgactaaccagagcgtacacaacgtcggcaatgtctgcagggtcaacatattttcgttggacggttgcggaaatattagcatagatcgcgtgatctgaatgaacactcgcaaggttggcatataaattattgtagaaaccagtaggacggacaaaggcaacatcaacgtcggataagttggtgagcgcatcttcaataaagtggtaagcgtacaagctgccagaacgcgcatcttgagcgccaatactgctgagattgaccactttttggacgtgagatgcacggattgcagcttggaaaatagcagcttgctgctgggcgctggcaaataaatcgggtgaggttccggaaatcatgagataaatgacgtcgcgaccagtaaactgggtcgtcaaaaaagctaaatcagtcattgttccgacagctggtatggcccccaaggccgtaatggctgtggcacgttcttgccgagaagtaacaacggtgacttcatgaccgtcagcgatcaagcggggaatgacaagccgattaatgttaccgagtgaacctagtaaagtaattttcatttgaaacacctcattgtagttatttttataaaagatagagttatcttttaaattatttttaatcataaaagatagttctatctttgtcaaggttgtactgcgattaaaatttcgctaaactaataaaaaaggtaaattcagttggggatttaatgatgagaaaaaaagatgaaacgaaaaaagtgaaaattcaggatgcgactgcggcaatcattttaaaatatggtgcggcggcagtatcgacgattaaagtcgcaaagaaagttggtatttcacaatctaatgtttatttatattttaaaaataaagatgatctactaatgagtgtctaccagcgggaattagctaaaattattgcaacaggggatttaacccgaattagtgatgcgacaattcccattacagaacgactacgactatacatgaagtcgatctatgattttgctttaaaaaatccagaaagcttgacgcttattgaacaaatcaagtttctgatgggccagtccgaaaccaacccgttggctgatcaactaaataataatgtcgttgtgtcgttattagaggaggcgatggccgccaatgtaattcgatcagtccccgttaatctcgtgatggcgatggtgtttgcagtggtgcgagctgatgcaatgaatccacagtcagccggatttgatgacttttatcatctaatttggaatggtattcgggcgaccgattagggacttcgagctgattgtatggtcaagcagccattttctgctcctaatgtggcatacttagttatgagacagatttgggaggagttttgatgagtacaaagaaaaagattattggtgctgcggggattatgctgattatcgttattatagtgatcacgggattgacgattcatcagtctagcagttcgaccactaattccgatcgtgctacggcatctagtcagtcggcacgctactcggcaagccgatcaacgagtgccgcaagtatgaagaaaagtaatgaagaaagttcatcgttagttgcagcaagttcaagtagcaggacgattgatgtcaaaaatctgactaacgcgcaggctgtagcatggatgaaagctaatatgggcgcagtcctgtcacaaaattataatacgagcgataacgctgccagtaacaatggggttacgtttgacgctgatgattttgattacatatacaatggtcattccggcggctggtcgggtgactcggatgacggtgtctactacgaagttcgtgaagatcatagtacggcaaatatgaaggctgctggcgccgatcccgaaacatctagcctagcatgctggttcagaattaccggggatggtgtgttacaggttcagacgagtgccgatgattctggtaattttacctggcaaacggtcagcacatcatatgatggatagttaaaaggccgatatttcagttggactgaagtatcggtcttttttatttggtgtaggcaagagccagttgtttatagaacataatggattggagataggtatcaatgtcaacgtattcatcgacctgatgaccagttggcgatccggggccacagataatgatggtcggttggcctgcagcctgaatgaattccgaaccatcacttgcttcagaactaccagtcaagataacgtcgtggttgaaaactgttcggtatgttttaagcgcagtttgaacgagttcagattcaggtgttcccataatgggtgcttccggataactgtaatggatcgttaattcataattgggaagggcatttaattctgttagtagggtatttaactcattaaaaataagttgatttggatagttaggaattgttcgaatattaccggaatattgtgcgctggatggaatcatgttggtttgttcaccaccagtgatttgtgtgatttcatgtgtcattcggccaagtacggggtccgaatcactaagttttgctaaacgctgctgagctaactgataaaaattcaataagtttcgaatggcgtttactcctagatctgggtgggcactgtgggcatttttaccactggaagtgacttcgtaatcaatcacaccacgggaggtatagacgagattagtcatgttgtttgtgggctcagcaataataataccagttagatgatcggcatatcctagttcagtgagttgtgctgccccgtattcgccagtttcttcaccgacagtagcaagcaaccgtatttggccgttgagttgcggctgagactctagaatttctagcatggcgatgatttcagcagccagaccgcttttcatatcagaagcaccacggccgaatagtttaccatttgtgagagtagccgaaaaaggatcgttggtccaattactcaaagtacctggagcgacgacgtccatatgaccagaaaggccgatgatcggtccagtgttttcgtgtccgattgtaataacaagattatctcgattaggagcgtaggggattttttttatttgtacggtgggatagggcttaaatagcgagataataaaatcaacaacagttgtttcattgttattaatggttggtaattgaattaattttcgaagaatctggattttggtttcttttttcatgaatagttaccttcgtatgaatgatatggtgtgaaaagataatgaatttatacggatcaattaattgagctgattaataaatggtgtaataagcaaaattttgatcaaatcaatgatttgaaactggaaattcgattatcatccgacgttaacttttataaaattataaaggtgccaattatcagtaaggtgcggattacgccttgcacgactgggtgaagctccaacaaatttttcaaattcgcgggttaaatgtgactgatccgaaaagtttaaaattgatgcaatttctgctagtgataaattagtactttgtaatatttgaatggctcgattaatttttactaaaattcgaaaacgagcaatggttataccaacttcttttttaaataaagatgataaatagtggggtgaaatccctaattgattgcttaattctgtggcattaatttttgtttcaggtgtgttcataatgatttgataggttcttctaactggagcggataaatgaacaaattttaattgtgctactctttgtgccatatctttaagcatttcctcgatggcagtcataacatctgagtaagaattgaaactttctaaagatcgaacgtagtgatcgttgagggagtacgcttgatcataatccattcctgcagcaatcgccgctcgaagagttacagatatgcaaatgatgccccaatttttgacattacgaacatcaccttcatcagacaaaatgccaattcttcctgagttaacaagtcccacgaaggcgtcgtgtaccattgagggttggcccatttcgacagcggctttgagtgccttttcataaacgtaactgacatgggcaccttgatcattaaagtttactaaaacaagcttatcattaaattgttccgaggtaattgaattagtaaaagcagcgttaatttctgattcgtcaagatcaatatcaagaaggttggcaaaaacaagaagttgcttataacattgctttgtcttgagcgaaattgtgctcattagtcttggtaaataaatcgttttttgatttggatcaagacgttgatcagataaaacatctgtaagaatttcggggcctaataaatatccgacatcatttttcatcatacaaaaactaaataaattttgcgtatgtcgtaaaacagttactttgctatcaagtgatagttcattaaacattgacaaataggcacttgtaaggattcgaccatgtttaaaggtaatttttggctgtttttcaaataatttaaattcaataccagggacgtttaaagcctcgatatatagctgttctatactcatgtaggtcatcaactttctattaaaagttcaaaaaagtggtatttttttcaaaatttattgatagcgctttcatataatgatcttgtaattacataagcgcttatcaatacattgcaatttttcattctctaattatattacggaggttttaaaatgctaggaaaagaatatcggagtcaatatacgaaacaagctcaagaaatggtatctcagatgagtttggaagaaaaagttcatttaatgagtggacgcgatgatacgctgttatctggaaaagagcgttacaatcaaaagccctaccagtctgctggtaatgaaagattaggtttaccaaacgttaaatttattgatggtccacgtggtgtggttgctggtaatgccacagcttttcctgtctcgatggctcgtggtgcgacctttgacccagacttagaggaacaagttggtgaagcaattggcgccgaggtacgagcaagtggtggaaatctatttgccggtgtttgtatgaatatgccatataatccgggatggggacgtagccaagaggtttatggtgaagataattttgcgttaggtaaaatggcgtcctcacttattactggggtccaaaagcaacatgtcatggcatgtgttaagcattttgcatttaacagtatggaaaatgcacgatttaaagtgaatgtaactgcaagtaaacgtactgagcgagaacaatatttatcgcattttaaagatgcggtggatgcgggtgcagcctcaatcatgagttcttataatcattataatggcaagtatgcgggacacagcgattatttgttaaataaagtacttaaagaagaatggggctttgatggctttgtaatgagcgactttatctggggcgttaatgataccgtagaggcggctaatggcggccaagatatggaaatgatgcggacaaaatattttggccctgcgcttgtggctgcagttaaacgtggtgatgttgcagaagacacaattgataaagcggctcttagaattgttagaaccgttcttgcttttgaagatggtgcaccaactttcagtaaagaagttattgcaggccctgaacacgtcaaactagcacgtcgggttgcacaagaagcaattacgttaatgaaaaataaaaatagtgtgttaccgttggtcgctaaaaaggcgcagaagattctagttgtgggtaaactagcgcaaagtgataatattggtgatcatggttccagtcgtgtttatccaacgaccactgttagtccattagaaggcattacggaagcttttgagaactccaaggttagttatgatgatggaacggatattgaagcaactaaattggctgctaaaacagcagatgtggtgatatttgttgttgggtacaattttgatgatgaaggagagtatgtatcaaatgatcaaagtgatgaagcactcctgaatggtaatgaaggatcagctggatcaagcactggatttgcaaaaggtggcgatcggcagacactaaatcttcatcaggccgatatcgatctcattaatgcggttggcccagtgaatacaaattcagttgtcgtgttgattggtggaaatacgattttaacacatgcatggcaagacagtgtgagtgcaattcttgacgcgtactatcctggaatggagggtggccatgcactggcagacgttctcagtggtgatgttaatccatcaggtaagttaccatttgcaattccagttgatgagaaatacttgccaacgattgattgggaaagtacggaaattgaatatggttatttacatggttataacaaactggaaacagaaggccatgaaacagattttgcttttgggagtggccttagctataccacttttgaaattaaaaatgtgaagtttaagcgtgatggtgatcagttaattgccactgcaagtgttaagaataccggacaccgtgatggtgctgaagtagttcaattatatgttggatatgatcaatcaacattggatcatccccataaggaattgaaagggttccagcggattgaattaaaggccggtgaaatgaagacagttgaaattacagtaccgttagaaaaattagcctattttgatgaatcccagaatacctttgtcgttgaaaaaatggattatgattgctatctcggtaatagttcagcagacgctgaaagtaatcacgaaacagtcacaattcgttaaagataggagtgagaaaatatggctcaatccgtagaatctttaccaggtagtggaagactaccaatgcgtgaaaagtttggctgggcaactggtgactttgcacaaaacttaatttataactgtgtgtcaacttatctactgtttttctacacgaacgtttttggattgtcaccagctttcgcggcaacgatgttcctagtggttcggatgattgatgcgattaatgatccgataattgggactatcgtagataagcacacgacacgttggggtaagtaccgtggttggcttgtcattacatcgattccatttgcaattatggcaattctctgtttttatacaccatcatttggtagtatgggcaagatggcatatgcgtacgtgacctatatcggaatgtcactggtttacacgacggttaatattccttatggatcaatgaacgctgctatgaccagaaatgatcatgaactgatttctatgaattcaattcggatgttcttggcacaacttggtggtttggttgttagtttcggtattcccatttttgttaagctgttttctggtggctattatagtggggttaatgctcgtactggatggttcctaacaatgtcaatgtacggtatcgtaggtgctttaatcttgctgttctgtttttcgcaaactaaagagcacattcatatgccggcttcgcaacaggcagaagttaaagtttcagacctgtttcaccaactagtgattaatgtgccacttcgagttttagcgatcttcttcattatcattttcggattaatgtcagttgttaattcgattggtgcgtactacatgacttataatgctggagatgcaggtctaatgcagtggtacaatttgatcggaacgttaccagtatttgtcgtaattcctttgacaccatggctaaataaaaaaatgggcccacaaaaattaatgcaaatggcattattggttgccgtaattggttcagttctgatgttcatgattccagcaaaaaatattgctttgacttttcttggacgtgcgattcaaacagccggaatctttttagctggaacgtttgaatggggacttgtaccacagacaattacctacggagaatggaaaactggtaaacgtgaaaatggtattatcaatgccgtcattggattcttctttaaagccggtatggcaatgggcggcgtggtccctggatatgcattagctgcatttggatttgttgctaaccaaaatcaaaccgctaatagtttattagggattaaattaacggcaacgcttattcctgcagtattctgtgtcattgcgatgattgtcttttctttctataagttgaataatgaaaagattgaaaaaatgaatgatgaaattattgcacgtaaagcaactgaaaaataaaaatatttgctagaggtgttaatcgaaactcactttgcaaccaacttacacatgcaatgtcgatttacttgctagcataaaaatagggccgattcggaaattgcagaatcgaccctatttattttatgaaaattaaaaagcgaggagtatgacaaaaaattaataaatgctaaaggttgtattcaaatacgttcataagtggtacgatcgagtcgttcaattttgaacaatataagttatatcgccagtattagtgcgcgcgcactagtacataggatcacactgtgatcctttttttatgcaaaaagcctgcaatccttgggattacaggcttttgagaaaaattagtggagagcatcgatcagcgcttcaccaacgccttttgccgattgtggattttgacccgtaattaagcgaccatctacaataacgtgcttcgtatatggatcactcttagtatggtgagcaccagcagctttcagtgcatcttcagcaagaaatgggacatcattggtgagttggttgatatcttcttcttcattggtgaaaccagttaaatttttgccattgataaatttagttccatctgcattttcaatagaaagaagaccaactactccgtggcaaacggcagaaatgatgccgccattatcataaatctgtttggcgattgtgccgagttcttgattgttgggaaaatcccaaacggttccatggccgccagcgaagtaaattgcatcataatcactagctgtgatgtcagctggtttaagtgagtggcctagcgcctgattacgaaattcagcatcactataaaattcattgttgatgtcgtctaattgatcaggagccaaactacctggatcgacgggaacatagcccccttgtggactgacataatccactgcgatgttgtgatctttcatcactttattaaaatgagtggcttcgctcaaccacagaccagcggcccggttgattgtttcaaacttttcatggttggttaatacaattagtactttagtcataattaaaaatccttctttctaacttactttttaaaagcatggacttaatttagcaccttagagtgggtctaagtcaactaagaaaattaaaattcttgttaaattgaatcagagtcagtatcaacagaatttaaaaactgaataaaatgctgagaaagcctttacttcaagtgcacttcaagtgataaagtaaccctaattcaataaaggagtgattggtgatgaagtatcggcggttaggtaagagtggcttaaaggtaagtgaaattgcacttggaagttggatgaccgatgtgagtgacgagcagcaccaaacattagctgctgaaagtattcgaacggcttttgagaatggcgtgaatttctttgattgtgcagatgcatatagtggtggtgccgctgaacgtttcttgggtcaagttttaaaaacacttcccagaaaagagctcataatttcaagtaaagtttactttccgactggcgatggtgttaatgatcgtgggttgtcccgcaaacatattatgacgtcgattgatcagtcgcttaaaaatttacaaacggattacttagatctctatttttgccaccgctttgatccagaaacaccactagaggaaacgctacaagctttaagtgatctagttgatcgtggcaagatcctttactatggggtgagcgagtggaccccagttcaaatcttggaagcgcaactgatcattcaaaagcttgggttgcatcccatgtcggtggttcagccacaatacaatatgtttgatcgatatattgagcatgagttaatcgatgtttgtgatcagttagggttaggaattgtaccattttcaccattgtcgcagggattgcttaccggtaagtatcgccttggacaacaaattccatccggatctcgagctacttatcaagaccaaattcaagccttattgacaacgtcaaatttggaaaaagttgaggccttggtcaaaatagctgctgacttgaatactgatttagccagccttgctttagcgtgggatttgcgcgattcgcatatcactagtgtcataaccggagccagcaaacctgaacaactacaaaataatttacgtgcattaacggtttcaattccagaggattatctccagcagattgatgcattgtttaactttaaaaaatttaagcgacagattggttaaaatgagggatcggataggctgaaataagtcatgcggtcctttttagaatgttcttttgtcttgagcttcattcgtgagttcgttatgatgatcacatgtcatttgacgcgaaagaaggaatcatcatggatgaagccaatcgaacctgctatttgatgggaacggtcatcaaattatgggtgcaacatccccatgccgagcagttgttatcagtagctgaacagaaactgatcgattacgaaaaacgattcagtgcaaacgatcagcagtcacagttaatgcgaatcagcaccttcgcggggcaacgaccagttaaagttgatcatgatctatttgagctgattgctctgggaaaacaaaatagtcaggcacccggcagctttttaaatatcgccatcggaccactcattcatagctggcaaattggattttcggacgccaaagaacccactccagcagaggttcaggcggcactaaagttaattaatacggaccacattgtactcaatcgcaccgatcagaccgtctttttgacagaaccgggaatgtcactcgatctcggttcgttagcaaagggctactttgcggatcagattattgctgattttaagatgcagggcgcattagcgggaatgatcgatcttggtggtaacattttaacttttggcgatgcgcccgagcatgccgatcatcagtggcgtatcggcattcaaaatccctttcaaccacggggaaactatgttttgtcgcttaaaattcggaatctttcgattgtgacatcgggaatttatgaacgacaaaatacatttcatgggaaaacattccatcacatttttgaccaacgaaccggttatccggtggcaacggacgtggttagtttatctgttatttctgaaaagtcggtggacggtgaaatttggacgacacgattgttcgggcaatctccccaacagatgattacatctttaaagcaaccaggcattattggtggcgttgtgattactaaacaaggcgaccttctatattccggagcactgaaatcgttaattgaacggcgctagaaaggccgtaattaaatcctgttccaccgaactaagcgttttatccgctctgtgtgcaataaaaaaattgatcgaaattagatgatcggacaacggataaagattataggctggctgctggggaagtgagcctataatttcttccggaacgatcgtaacgccagttccgagcttgctaagattgaaaatggtgaaaatattgtcgctttcgaccgcaatgttgggctgaacctgatatttctggagtaaatagtcgacttgccgccgaatcgctgagccgctcgaagtcaatagtagttgttcgcccaacagttctgccatggggatggatcccaggggcagaactgtttttgtctgatcaaaaaaatcggatgtcggtggaataatagcaaaataactatggttaccacattcgtgaaaaatcaaatttgatgacagggtttcgggattttgaccaatataaaaatcaatttttccgtctaaagcattggcctcgttacgttggggcttattttcatcgactagaattttgacgtcgggatgtgtttgaagaaattgagggagaaatagtggcagaaggtaagacccgagtgtactgagtaccccgagcttgatggttgtgccgttcggcgttgtatattggctgagctgatcatcaaacttagccgtttcattttccaacgtttccaagtagttgtagtacaatttaccagcctcggtgagctgaaggtgtttggcagttcgattgatgatttcaacttgtaactctttttcgagcttttgaatgagttgcgttagatagggttgagaaatatagagtgctttcgctgctctggtgaagttaccgtacgtcagtagggcatcgaggtactgtagcatttttttggagtctttgagaatcatttgcaaaccttctttagtgagtaatagctatttagctattatacaataattaaataagtatttcacaatctttctacatctcgttaaaatttaagtatcgagaactagaaaggaagacgattatgaaatttatcggaattgtagggtccaacgccgatcagtcaacgaaccgaacattactgaattatatgcaacgccactttagtcaagtagcaacaattgaaatttgtgaaattaaagacttaccggcatttaacgagccagattcaaaaattgcaccacgtgaaattcaagccattattgatcaaattcaggcggctgacggggtgattatcagcacgccagagtatgatcactcgattcctgcggcactcaagagcttaatcgaatggttatcatatacgtccgaggcatttaataactgtcctgtcatgattactggggcatcacatgggacgttaggatcatcgcgggcacagaaccatttgcggcaaattttagacgctccagaagtcggtgcgcgtgttttgccaagttcagaattcttacttggaggatcattacgggcctttgacgatgcggggaacctagtagatgtagctaaaattcacgaactcgagcgcgactttacggagtatctggcgtttgctcaagatgtgaatcagttgatcgcacattcaagtcaactacacgacaaacaggttgtttggacggcagaataggaggacaaaatagatgaagttaatcggaattgtcggaacgaacgcagaaaaatcatataatcgtcagctactcacgtttatgcaacgacattttgctgatcaagcagaaatagaaattttggagattaaggatgtgccgatgtttaatgaatcggcggaccaaaatttacccattattcaaacgttcgatcaaaaaattattgatgcggatggggttattattgcaacgccggaacataatcattctattccttctgcactgaagagtacgcttgaatggctatcaaatgatgtccattcctttgagggaaaaccagttatgattgttggtgcgtcctatcacgatcagggatcatcgcgggcacaacttcatttgcgccagattttagatgcgcccggtgtcgatgccatcgtcatgcccggaaacgaatttttgcttggtcatgcgcaacaagcctttgatgagcatggtgatttgaataatgaaggaacggttagctttttagctagttgctttaagaaattcctgcgttttaccaacatggtcaaaatgttaaacgttccggaagatttgaaggtcaacccgggaacctacgacgtgacggccatggggcataatgggaaattaccgatgtcagtcgaattttcaggagataagattgaaaatattgaaattgataccagcgcagaaacggccggtattgcggatgtggtattcgagaaaattccggcacaaattttgagtgggcaaacgttaaatgttgataccgtttccggtgcttcggtaaccagcaaaggggttattgacggcgtggcagaagctgtgaagttagctggtggtgatcctgatgttcttaaaaatcgaccacggccaagtgcgaaacgacaagttccccctgtcgagtatgagacagatgttgtggtgattggtgccggtggtgccggcttgacggcagctgccagcgtgctacaacgcggacaacgtgttatcgttgccgaaaaattcccatcagttggtggtaatacggtgcggactggtggaccaatgaacgcggctgatccaacttggcaaaatgaattcagtgcgaatcccggggaacgaacgactttgcaaggtattttgaacaccgacgagacgaccatcgatcctgcatacgttgccgatttccgattactaaaaacacaaatcacgaagtatctggaaacaacagatgatgataatgaatacctgtttgactcaacgttattccaccgaattcaaacgtatttaggcggtaaacgggtcgatttagctggtcatgaaattcacgggcagtatgatttggtgaagattttaactgatcatgcgttagaatctgtaaagtggttagaaagcatcggcgttgaatttgatcaaactgaagtctcaatgccggttggtgcaaaatggcgacggggtcataaaccactaaagaatcaaggatacgcctatgtttcagcattgaagacctttgtggaacaacatgatggccaaattttgacggaaacaccggctaaaaaattgattattgaagacggtgaggttcgtggaattattgcacagggaccagatgatcaaaaagtcatcattcacgccagtgccgtaattttagcatctggtgggttcggtgctaatactaagatggttcagcagtataacacgtattggcaacagattgatgatgatattcaaacctcaaattcgccggcgattactggggatggaattaagctagggacgagcgcgggggcagacctcgttggcatgggcttctcacaaatgatgcctgtttcggatcctgaaacgggtgagctctttactggtttacaggtgccacccgctaactttgtgatggtcaatcagcaaggaaagcgattcgtcaatgaatatgaaggccgggatgttttgtcgaaagccgcaattgctaacggcagtctgttctatttaatcgcggatgataagattaaggagaccgcctacaatacgagtcaggaaaaaattgatcaacaagtcgaagacggaacgctgtatcgtgccaacacgttagcagagctagcgcaacagattcatgttgatccggcagtcttgacgaccacgatcgcgcattataactcatacgtggatgctgggacagatcctgagtttggcaagaacgtttttgatttaaaggttgaacaggcgccgttctatgcgacaccaagaaagcccgctattcatcatacgatgggtgggctaagaattgacacacaagcgcatgttttaaacgaacaaggtactgttattccacacctatttgcggccggtgaagtggctgggggaattcacgcaggaaaccgtctgggtgggaattcattaacagatattttcacctttggtcgagtcgccggtaaaacggcggttagtgaaaaccaaaaatagaacactcaaaaaacgaatgacatcgtgtgacaaacgacacgacataattcgtttttttgttgatttactaatttttactaaaaatattgtttaaattcgtccggataaattatacaatgagggcggtatatgccggtgaaaaagtgggataaaatttgaacgattaaagaaggtccaggatgtttatttgggaatcgagaattattacgtacgtaactaacattttagtgctcattgggtatgcgatgttatttaactggattcagtcggctaaattcaagagtattcgcaaccaaaagttggcaaccacctacctaattgcaattacggttttatttttgattctgtttcatgttgcatcgttaaatagtatgattcaagcgggaaatcaagagggctttggctggacgtacattaattttcagattgggaccgtcatgtttgcaatgctgatgtcccgtcggcggccgattttgtattgcttagcagtgctcctacttgcttggtactggtggattccgaatgcgcctaattgggtgcccttttacctgattagcttggtgctgatgataggggcacaaaattttggtccggtaatcaagcggcacttggtattgtatgtgcccttcagcctgatatttgcggcaccatttttgataaccaatgtgtattcactcaaaggaatcaatgtcggttggccttggcaaatcagcactagtttggtgattagtctggtgttgtggttggtgcagtatgccgaaaagcggcataaacaatcccaagataaacttttgagagaagcccgagtagatgacctgacgcagctttataattttcgggtgtttaatgaagatttattgaattcatttacggatatgcaaaaggatcatcaatcatacgcgctctacacgctagacattgaccactttaagcagattaatgatcaatatggacatttgatgggaaatcaggtattagaagctgtcacaaaaaagctgaaagaaattaccgatcacctcgaatatccggccgaagcttaccgaacgggcggtgaagaatttagctttgtcctccacgatgttcaaaaaagttttgaacgggcatgtgaaatttcacgactggttcatcacgaactgggcacactccaatttgtgaccgagcaacaagaaacgttccacattacgatttcactcggtcaagatcgatcaatggaggaagataaaaactatttagatgtctaccgacgagcagataaatacttgtaccattccaaaaatattggacgaaacgcaattacggttcgtggaatgacaatcgaaccaattgaatagatacaaaagcggggcacaagcggcctcgcttttgtattaatgttgaaattttagccagtgctgctgcaaataccgagttgttagactaactggcgcctgaactaatgtgagtggggcgccggtggcagtgatttgaccacccgcatccccacctcgcggaccaaggtcgatcagataatcggcattgatcatcaagtctagatcgtgtgtaatgatgatcacggtagcaccgttagtttgtagtcgttcgatgatctgaagcaacgtttggacgtctagtggatgtaggccaatggatggttcatcaaatacaaacagcgttccggcttcgtgtcgtgtgaggtgactcactaacttcaagcgttgcgcctcgccaccagaaagcgtgggggtgctctcaccaaggtgcaggtaggcgagaccgacctcttgaagttgtttcagttggcgttcaattgcgggaacatctttaaacactggtagtgcctcagttacggacatcgccagtagatcgacaattgagtacccatgccacttgattgcttgaatttcttgattataccgagtcccgtgacaaacgggacagacttcttgcatgtcgggaaggtactgaatgtcgagtgtgatatttccaagaccgccacagtttgggcaagccccctgtttgttattgtatgaaaaatcagcgatggtgtagccgtgttcctgtgctgtgggcagtgccgcaaagaggtggcggagtgcattcatgatgttagtgtaggtggcaagggtcgatcgggcatttttcccaacgggggtcgcatcgacgctgacgactcgctttagctgcgtcgatagtgaggtaacgtggtggggaagtttctggtggtgttgctgggcctgaatcgctggaacaagactgtcgagaattagactagtcttacctgcacccgaaaagccggtaatggcggttacttgattgtcggggatggtagccgttacatcatgtaggttgaagtaacgggcgattttgaggacggttttggtggttggtgcgggtgctgttttgggtcgtaagatgttagcggtccccgcaatgaacggtccaattagtgaagccgtattttgagtaagttgttgaggggttccctgtgcgataatttgaccaccttgatcaccggaaccagggccgatttcgattacccaatcagccgctgcaatgatatcaacctcatgatcgaccacgattaatgagtttccttgctcgattagttctcgaaagatatgaatcagtccctgaatgttatcaggatgcaagccaatagaaggttcatcaaggacgtaaagaaccccagttgtttcggtgcgaagggtacgtgcaagctgaattcgttgtagttcaccggttgagagtgtattaccgttccgagagagactcagataatctagaccgagctctaggagtggccgcaaggtgtcttcaagctccgtgaataaaatatttgccaacggttgcatgtttgtgggtaggtcttgcttggtaatcgtctcccactgggcaagatctccgagctgtaaattagcgacctccgcaatatttttttcgccgacaatttgtttgagtcgttcagggttgagtcgtgaaccgtgacaggtaggacacgtcgagaaatgataaaatgagttgattcgagcaatggaacgttcacttttagaggtttgaagtgaatcagtcactgcgtcataggcgttttcgtataaggccttatccatatgaaaaacacgcccggtgccagagtgcaaatcaaggggatactgttttttctcaccgtggaggacaatttgtttttcatgggcggttagttcctggtaaggcacgtctgtccgaacgcccaatgttgcgacgagtttgggcatgaagtttcgcccagggaggtgccatgatgcaacagcaccttcctcaagggttagggtttcatcaccaatgagtttgtcttcgtcgagctcccgaactacgccgagtccgtcacaagtgggacaggcacccgtagaattgaatgagaagtcttcggcactagttgccatgaattgaataccacatgtgggacaggttaccacacccattgcttgtccaggacgatccattgcctgagcaatttcaatggttggtgcgatgcggtgaccattgggacaaacgactgagccaagacgtgaaaaaattaggcgaattacgttgaatgcttcggttaaggagccaacggttgatcgttcagatggaatattggggcgttgacggagtgcgagggcggacggaatatgtttgacggattgcacctgagacttgcgattttgagtgattcgacgtctggtataggttgacagggcctcaagatagcgccgcgagccttccgcatataggatgcccatcgcaagtgagcttttgcccgaaccagaaggaccggaaatggccacaaactggtttaatgggatatcgacatcaatatctttcagattgttgacgttaccgccacgtacttcgatgtgatcaatttttgaaaccatggtaaaaccttgcctttgttttgaaatagtgtcttcatgataccgcaaatgatagaatatcgcagaacgaaacacttcacatgtaagtgaggggacaactgattcagattagtggtacgatgaaactaaggtgatcgtgagacatgattggtagaggagcggatgagaaaatgaaaaaagcatatttgattcacgggacgtcattgccagatgatgactggtttccatggctcaagaagacggcccgccaaaaactaaattgcacggttaaaattgtggatctaccacagccgttttccccacaccccagtgaatgggatgctgcatgtgatcggtcgattgtggcaactgatggggtaacaatcattgcccatagtctcggttgtatcgaagcgttgcggtttgttgaacagcatgatgtgcaacaggccaatttaattttggtatcggggtttgatgaaccgatttatacttatcccgaattaaacagttttgcggatcatacatttaactatgcacgtgatattttgcctaaggtggcgaatgcggtggtggtgactgctaaggatgaccgcattgtacccacacagtttagccaaacgatggctcagcatttacgtgctaaattgattttgcagtccacgggcggtcatttcttgggggatgccgggtatacgaagctaccggtggtactagaagagctagaacgggtaatagcataattaaatgctggttgcagaaaattaatcgttcacatcttgtgattgatatggtacaattaactctgcattgcgagtgtagtttagtggtaaaatccaagcttcccaagcttgtgtcgcgggtccgattcccgtcactcgcttagatctattaaatctagttcattttcataatttataaaagccctaaaccgttgatatatcaatgatttagggcttttgttatattcttagactctatttcattcgttctggttaattgtctcgtgtacacggcatgtacacgagcaacaaaataatccctaaaaaaggcctttttgcgttgtttttcgtgtaccaattttacttttgaccgttaattaagcttgtcactataccatctagagcactatcgtttctggcagaaacttctttgaggacgtgtacgtaggttttgtaggtggttgttacgttttcatgccctaaacgcttggagacgtacgttatatcacgattttgatagagtaacatgctggcgtgcgtatggcgtagtgcgtgcgaagtgtaagactgctggccttcacttatgattcctaattttttgcaaattgatgataattgactattgaggccgtcattagagattgggaggccattttctggccgaatgaacaatagattattcgggttatagtccggccgaattaacttacgtttgtcattcacgagcttgagtttgcgaagtacaccaagtgtttgcttgtcaacatgaattgaccgcatggacgactgattcttagttggcccgaatccataaggttttttcgtatagttccaagttttattaatttttattgtggcattgtcgaaatcaatacagtcccaggtaagtccgtctgcctcttcgaaacgcataccggtatttgccataacaagaataatatagttagttacccgacgaggatcgagatgggtgtaagtgtactgaattagagttttaaaatcatctagattcatgaatttatgggattcatctttttcaaggttggtatcaccagttagcgatacttcataggttggatcaattgatattgctccaaagtgatatgcttcgtgaaaacatttagctatataaacgtgagctttcaggacagttgccggtgcatggcccttaccaaattcatttaaaaaattttgataatcggatcgtgagatatcagcaatttttttgttaggaaaatatttcttgattttttttagtgcagatcggtagtggttgtcgtttgcttctgatttttttccttcataaaacgtgtgaaaccattcttcataatatctgtcgaatgtttggtctgtttgttcttgatatgtgccatgcttaatttggtcttcgatctcttgggccgcttccttggccatgcttcttaagcggtaaccaccgtttgagttaatgggcaatctcttcccatttacggatctattaaccctaaaatgccataagttggcgcgcttataaatatatgccacatttaccatcctttcatactttactattgatcattacaaacatatgttcttttttagcgttaaataatagccccgtgatggggccaaattcataaagtacatagaattatctaatgaggtaggggagccaaggactgaacactttgactgcatctccgttctcgtgaagaatcagaaatctgtctgcattcacatacttagcttcctgcagaagttcgggtaatgagttgtacgttatggcttcctcgtttcgtatcattgtgattgatacaacatcctcgtacgttttactgatttcaccagtttgatagtttttaaaaataatatcgttcataaaattgcctctaatatccatcgttagggtcgccagtattgtttgaatctgcgtttgcattaacttcgtcttctgcttgctgtcctttggcggtattagagccgtctggattttcatagccattctgaacagcccaatcatgttgtccttgtacccaagagtcagcagtaccatctggatttgagcctgcagcatggtcttgaccagggagcagcttgtttccgtttggatcatagccacgttcacgattaatttcgccttgagactttgattgtgttgttttctgagttctagctgctgaacttgattgtgctgcctgtgattgagaagcaaccaccgatgcagctgacgatgaattagccgcaatcgaactggctttactttcagattcagccttggccttgctttcagaagcggctttagctttcttaatggattcctttttagcatgtgcctttttcttagccaccagactgcttgaatctttcttagccttatcagatttagcttgcgagttcccacacgccgcaagtgataaggcagtaagtaacgttactcccagtgttaaactttttttcaattgttacatctcccaaattaataattcaattctcaatgtcatgagttttggaatatagtgggttttgttagaatataattctgtatgtcagattaatttatggttagtctgtcaactattttttttacattatcactattattcatagataaaatttggtgtttgcttaccaaggaaaagtctctaaaatcaaatccaggtgaaacaacgcaactaaccaatccaaaatcagttaggctagttacttcggatgcaaacacagtatttttaggaacttttagttggaggtgttgtccgtttgcaatatccttacctagatcgtttttgtagtattccccatcttctgaaatgcagtggatagttaacggtgatccgtcgtgataataccagagttcatcatgagttaatttatggaaatgtgatggactagtgccgtctagcataaagtatattgaagtgtaattataccgtttatctttactagcactatcatatatctgatcatcgctatgatagatttgacgataccagccaccttctggatgtggagataagtttagagattttatatacatttctttataattcataatagtttcacacttcttctcttttattttgtgttgcatgggaccttgatgaattccaaacaatgactgtatggtatgccctgactaagctaaagaccgaatatatcgacatccgatacaagtggaggcgatatattattctttaatcaaatggatcccaatagttatcaggaatatgatcatcctttgataattcccaatgattagacattcctctttttggaacagcatcgggtttcaagcatacaaagtgtctatgataactatcttcaataataaaaacacgtttatattcattgctataacttatgatagagcagtcagagtgtttatatccaaaaatatcaacatattccatgtagccacttcttccttaaaaccgtctttaaatcaatgaaaattaagcaatgcaggacactcttctgagaaccagttaaaaactaggtacaaaggctaaaaaataactattccaattctgcgttaaccattggttttatatccgataaaataatatcgttatacttgaaccatgcgaaaccgttacgatccctaccacattgttcttctggcaattggtgataatgatcgtagcaacaaattgctgcccttgaaagggtatgttccttaccacaacgacataatacatgattttttccgtctataacggtaactttaatatttggatcttctcgaaaagttaatttcgcacctgctggaatgcttaggtatttgaatgtgcgattggggcgagaaccaatctttcggctaataactgtatatttttttccggttatctttgaattgtattcttccggtctaatccattcagctgttgggtcattgaaggttagtagtttaaatgcttcttttgtttggttgtaagttgctttaaaaaattcttttgaagggctttcacgcatgctagaaagagctctatgtaatagtcgttcagcctttttataattcataatttttacagcaaatagtaataatgtcggcttcccgtctggaataccagtatcattaaattgagctaaacggcgagccacatcttttgtttgacctattttaatgtagcctgggaaagctttgttttctaatgcatatacatatccttcgtcatcgttggtgtctgataccataatcattcctccaaatcatgcttactttaagtattgaaataattaattcacatccagtttaatagtcccaatactctgtccggtttccggattcatgaacttgagcttcacgggataggtggtgttatctagcaattaccatgatccatctgatgccataccttcatcctcggatttttgcgttggggaaccgtctgagtttgcgtatccttgttgttcaagccattgttcctgcatgtcagcagtttcttttgaacgtctggatcaccattgtttgcttcacaataggcgttgtatgacgaatatcctctataaggacgattccaggtatttggatcgtttctgtccgcttgtgcggtagaattgacgtttctgtttgttgtgtgcgtacagccgaacttgattgtgcggccgcctatgactgcgatacagccactgacgcaactgatgacgaactagccacgatcgaactagctttactttcggattcagctttcgccttgctttcagaagtggcattagctttcttaatggattcctttttagcgtgtgcctttttctttgcaacccaactacttgaatctttcttagccttatcagatttagcttgcgagttcccacacgccgcaagtgatagggtagtgattagtgcaataccaatcgttaaaccttttttcattttaaatttccccaagaatttcagctttttaagacgtcagtatttggacttatagattaatatttcaaatgctcccaatcgatacagttataggcccatgaaggtacaccgtaataatttaagtattgttcttttgtttcaaattcataaggcattgaaccctcaagcatggcgtccaccataaaacaattagcttcatattcaatcccatacgttttcacatttaaatggttacgctgtaggaagcctgtgttttctctatgtccacagcgattatgtcccagttcgtgaaaacaaacatcaatttgctcaaactctgaattacgagtattaagaacaatagctgggacacgattaatcattgtattgtatcccatgattattgaacctgtatcgtcataataaataggaatatgaaggcccttacataatttaaatggatcatttgtgccaaacttatgaatcaagtccctcgccgttttttgaataaaatcacgttgcatgagatcacctactcatctgcactatcacgatatttttttggagtaaatttcttttttgcaattatttttgattgacggatgacgttttccaatgaagcttttaacagttcggcatcttcatcactgatttcagtaccaccatttttcatgaaggatagggtacctgcgttacttaaatcattcaaagtagactctaactgtttttggacatctttttcgtctttttcggttaggtcgtagtagtgacgtttggtggatcgctcaagaaggtaatccgtagaaactccaaaaagttgtgctaattttacgatggcgtctttgcttggctctcttgtatcgttttcatatccagatatagacactttactgacgttcaaatatttaccaagttcttcttgtgacatcttcttttcttttcgaagatctcgaattctactgcctagggacataagttaacacctcgttttcagattgataatacaattaactgacagttaactcaataaaagttaacgaataagtaattttatcttgacaattaacctcaagttaactattataattaacgtaaggttaataaaggcggtgattacatgacccttacgaagttgaaaaatttaagaattaaaaatgagttaactcaggaaaaaatgggtaaaatcattggcattactaaggttggatactggaagatagaacaaggtgagacacctctttcctatgatcgtgctataaagcttgccgccgtctttcacttgaaaccagatgatatttttttgccggatgagttaacaaatacggaactaaataattccaccactgaggaggtgagcgtatgaaactgtttctaaaaatttggttagttttcaatcataaaaaagttggttctaaatcagtatggaaagttgtgagattccaaaatcaatgtttttctataacgattgaaaatcacacgcaacagcaggctgaatttcagcagaagttagaaaaagtccgtaaataaattacgaactttcagattggagcttatagacgtttaaatgcaggatattttgaaagaatttcttcgaatattcgaccattcatctttctttcaaaattagcatttttgttgtcgtgtacggcttctaatgaagggatttctttatccgctcgttttttcaaatgaccatagataaagagtgcttcatcttcactaaattcaaaatccatttgttttcacctccttgagatcattatcccaccggagagtgaacacgtatattcaattttcaagttacaacacgaggaggtgagcgtatgaacatcagaaaccataacggaatgaacggcggcatcatcgaatcaaaagaacagcttatctgcaaataagctgttctctgaacgctaatgtttcttgtctttttggggttctgcgtttttcatcaattttttgttcatattcatttgatgaatttgtttttcaaacattccctgattagacggattggcattagcaaacttggttttagcaatttggagggattttttcgcaatcatattctccaagctgtcattcccattaatattgaaggtcaatttttcacctcctaactaaataggatatgaaaagtatatatcaaaaacaaaggagcgatttcatgaagttaaaaattgttgatcacagaaagaaaactgaagaaaaagttattggaagtttagatatttttattaatggtgaaaatatttcacattgcatttctaggttggatataaaaatggacgcacccaataaaccaaaagtgaccattgaatgcgtaccagatgagttaagccttgatgccacgtcgtcaattaccattaagcatctattaggattggactaacgcaagatgctgacgtcagctaacccggtgtagtaaatgtcggatgaatcgtagatattagggtatctcaagtgaagataattcatcgtgtcttttacatcgttttgattaaagccatctagtgaatatgtgccagcaccattaacttttcgaagcttttcaattctggcttcaatttcaggtctatacattatttttcacctccttggaattattatcccactaggaagtgaacatggatattcaattttcaaggagcgaggaggtgaacgtatgaaactaactatcaagccgagcgaatattgtgaaggccagaaaatgcctagtgcaggtgcctatgatgcctacattgacgactacaaacttggccgaggcgttacaggaattaaccttgatatgacgaacccagcacgaccaccaaaactaactataactgcagatctttctgttatcgatattgatgagaacgtgctggccaagatgaaagatgaaagatgaatggggagtgaagtaggtatgaacaaatcacaattagtagaggacttgatgtcctttcgtccggacctcaagcggtcgtttctagaaggattcggaacggacacgttaaataatatgctgaccatcgaacgtagccgtgtggcagatgaagtagccgaaatggctatagaatcatttgcttgattctaatttaccgtttatggctgtcatagggtagccgcatatgtgaaaaatcgaagtaaacattcataaacttgtttaatccattaaaaggaggtgtgatacatgaattcaataaacgttaagactaatgctggagagattttatcagataccatactttcaaatggaatgacaactacagaattagctaaaaaaatggcagtttctcagacgtatgtttccaaatggaaacacgatgctgcaccaatcagattggactatattcagcgtctacttaaggctctgccagaggataacgagtttctggcacttgaccttgcacatggaatttctaaatttattccaccagttgcaaatggcccgaaactgtacggaatatcactttcgtacgcaagtcgatcaatcgttgaattgaaacaagcagtcgatgccctagttaattcgctagacgaatttcaaggaccagctgattcaaggaccgatgggaatgatccacaagaagctgtcaaacagcttctagacgcagtttttgtagggctgaatgcaacaatcataatctgccgggattataactactctttgtgcaatattgaaaacgaacgagagaagttatggcggcaaaatggattaatcaagtgaggtgagaaaaatggcaacgcaaatcaaggcgacagttacaataaacgttcctgaggatcaggtgatcgttgataagtcctatattgagggattggaggattacaagaaacggacatcgttagaaggtcagtattggacgatggcagacttgatagctcgtgttgggcatgagcgtaagtgggtgaaagataacattctcggaccgttcaatgacgaactaagctttgagaatggtggtccagcatttattccggtagctggtagtaagcagcagtattcgttcaatgctaaggaaatggcaacgttcttgagccaccattttcctgacatttataaacacgcagatggagcggctaaagaagggaagaaatcagcatgaagtggctatatatgattcttggagctgtgaccagcctcgtgcttgtaactggcgatcaagtcttaatcaactggctagcgttgttctggatcgcgtttggagtcgtcaaagctggcaactatctatttgatcggaaggagcggaaacatgtttaaacacgcaaaaaaagacgctcaacggtggcacccgttaaacgtcgaaacaaactatttcaaaaatatcttatgtcaatatcataaaccgaaacgggggcttttgcaatggatgctcaaattagtttagtaaatcggaatcatccagaattgaatcagtttatggaagaagaagccattaatcccgaagtgcgacttacgttcccagatttcgacattacaccagatgagttggaagatggggcacttgataactacgttgcattacgtacaccacaggagcttagaaacatcgtaagcacagtcattgaaaattctggagattatgtagctgctcgtttaatgggtgcagaaagaaaggacgattcaaatgccatctgaaaatactgaagttgaagtccaataccaagcaaacggtgaggacataaaattaacgccaagcatgattacccagtttcttacatcgggtaacgaacagattactcaaaaagaagtagtcatgttcttgaatctttgcaaatatcagcatctcaatccatttttgaaagaagcctatattgttaaattccgaggtaagccagctcagatcatcactggtaaagaagcctttatgaaacgagccaatgctaatccgaattacgacgggttcaaggcggggatcatcgttcaacatggcgatgatctaaaggaaattcaaggaacggtacatttaccatctgacaagctgattggcgggtggtgtgaggtctatcgaaaagacttagccgagccaattaaggcgtctgtttcagtgactgagtacgacaagcaccagtcaacgtggaaagtaatgccagcaactatgattcgcaaaacggcaatggttagcgcactgcgtgaggcatttcctgaaacccttggaggtatgtataccgaggacgatcgaaatccacaggagatggttgatgattcaaaaacaccagttgaggcccctgaaggaagtgttgcacgggatttaattgattcatttaattcggaaaataaaaagtctaaggctggtaagcaatccaagacagtcataactaatccagaaaataaagaggaggcggttgataatgttacggaatccgacgagagtgaagagccaaccgatgaagctcaacaaacagaactactacagccaagccactagttgggattattggtccacatcccagttcaaggacttcgagaattgtgaagcggccgcattagcaaagcttcgtgatgagtggcagccaacaagcaatccagaggcgctacttgttggaaactacttgcatagttactacgaatcaccagaagctcacagggacttcattgaagagaatcatgatcagattattgccaaggctggtaagtacaaaggacagcctaaggcggcctacaaacaggctgatatgatgattaaaacgttggatgatgatgacttcttcaagatggtttaccagggtgagaaagaggtacctgtttcaggcacccttggtggtgttgattggaagggcaagcttgattgcctgaacctcgataaagggtacttctgtgacctcaagaccgtggatgacatccataagcgtcactggaacgattactacaagcagtggcagtcatttgttgaagatcggggctacgtgctccaaatggctgtctatcgtgaactcattaagcaaatttatggtgtgacctgtgagccgtttatctttgcagtaagcaagcagacgccgcctgacaagttagccattaatattgatcccatgcgatatcaggatgaacttgatcgaattgaccgacagattgagcactttgaagccgtaaagactggtcaggaaaagccagtagcttgtggaacttgtgagtactgtcggagccataaacaactagagggattcgtcgaggttggagatttgattgattagaggtgtgaaaaatggcacgaccaatgaaagacggtttggactattttccactcgatgtgcatgttttcgaagatgaaatcgttgttgctatctctggagagtttgaagtgaaaggcgagcttgcagtgatcaaactattatgtgcggtataccaaaaaggctactacatcgtgtggaatgaattgatgcaagcaaagattgctaagcagatacaaggaactgtcgggcttactaatcaaattgttaaccgcttggtccaatggggctttttcgataagtcactgtttgactcggctaaggtattaacaagcgttggaattcaagaacggtacgcagaagcaaccaagcgacgtaagaatcaggatatcaaaaaattgagttattggattaatgcagacattaatgacaactcgaacggagttaatgtagacattaatgcacaaagtaaattaaaggaaactacattaaataaaagtaatgaagaatctaatagtccggctgaggccgaacagcatgaatctgaatcatttaattacgctggtgttatccagtacctcaatgatcagtctggtaagcactttaagaatacggcaactaatcgtaagttgataaaatcacgacttgatgaaggctttgaccgccatgatgttcggatggccattgatcatgtcgtacaggcttggaaagacgatcccgagatggaacggtatattcaaccatcaacgatttttcgggcttccaagtttgagggctatgtaaatagtgtgccgggtggcaagcaatctaagggccaagtccgtgaatctacaccggattgggcaaaagacggctatcagcatgagcacaagccagttgatcaggacaccgtggacgaggtgagggctcaggtggcacggcttaagcaagaacaagcacaggaggcttaggacatgaacgaattaattaagacatatacaaacgatgatggcgtgaccgttgttgacggtcgatcacttcatgaatttcttgaggtcaaaacagcatacaaagattggttccccagaatggtcgaatacggcttcactgaaggcacagactttagctcatatttgagcacaagtaacggtggccgcccacagcacaatcatattgtgacaatggacatggctaaggaactctcaatgattcagcgctccgagaagggaaaacaagcccgtcagtatttcatcagcatggaaaagcaggctcaggtccttccccagacacctgaggagaaaattgacctgctgatccaaaacagtaagaacgccaacgacaagattaaagcagtcagcgaacgaattgatcagcttgaggacgatagactacttgccccgggtgaatacagcttcattaatcgccaagttcagaaggctgtacgtgaatacattattgaccgtcatttgaagctcacacagaaacagcgtggtttgttgcacaaggacatcagtaacggtctgaatgctgtgacaggtattcgaacacgaacacagcttcgtgagaaagatttcaatacggcttgtgactacatcgataactggtcaccgtcaacagccactatggtcatgattcgccagttggatgccgaagcaatcgcagaccaagctatgggggtttcataagtgacctggcatagaggatttgagatgtaccccagacggcagaaatacaacagccagaaagtagtcattgacggaattgagtttgattcgaaggccgaaggtgcttactacctcacaatccggaatgaatggaccgatggctggacacgtcaggaacggttcgagatcgtcaaagcatttcgatgcggccacaagcgttatgcacatgccacatacagaccagatttcgtacaccggaccaataacgtgatcgataaggtagtcgacgtgaaaggcggcaatgtgacgctcacaacagacgccagactgcgcatgaaactgttcatgatgcggtatgacgtaccaattacgatcgcaagatatgactatcacagcggaatttttgaagaaaaaattttttgaaaaatgtggaggatatgtaatggaaattgtaactaatcaacaattacaaaagacaacggaaaaatatatttttaaccatcgtgaagaaattcaagagatgattaataaaaaaattgcaacagcgattaaagaaggtattgcagaagcttttaacaaatacagtggatcagttaatgaccaaatcaaaaaactggttcaggacaaaattagtgagatcaccgcctcagttcatattgatactgaacagctgcgattaaggcttcaaaagcgagttgaacagcaaattaaaaaagcagatattgaaattaaattataggaggatatgtgatgaaatttaaagatggtgcagttgtggacgaaaatgaaaatgtaggttggattgttctagatcctgaaaaggtaagagctatccgtttgatcattcgtgatgaactggctcgtgaggcaaagattgacatgatcgttgcgaggacgactaatgactaaatacatcaaaacgggaactaccgagtttgaacagttcgatgaaactgaatggaacagaatctatcaggattttgatgatccagataaatgggaagccaaggcatctgaattaggtattgatcgttatcatggatactttgtcattcccacaaaagatggagacatgagaatccatgatggtgattggattgcaacgggtgttgacggtgaacactggccggttaaggacgagattttcaagaagacgtataagaagctgccgaaattaactagaccagtgtcacgatatcttgaatattgtaaggaacatggggatctgaatgacgcattcttaaacgtggaatatctggtctctgataaagatgctccagaagtatttaaatatcttagctcacaccccgacgattttgcacgcgcatggctagacggttacgaggtagcggaggtagacgaatgacaccagaatttagagcatggaatggacaagaatttgattattgcacgcttagagccagaaatggtttttcacctcaagaaaacggcatctggtatgacttaatccagacacatccggaaggcattatttttggaacactagagattaaaggtgaggaagaaattgagcagtacaccggattgaaagataagaatggcaacaagatttatgaaggggatattgttcactgtgaaaatgattatcaaggcactgattacaccggaaaagttatgtttttcaatggtggcttctgtgtatggacaggtggattccggaattacgtctgggacgatatgattccagagattattggcaacattcatgagaatccggaattgttggaggtagatgaatgacccatgaatcaaaaatttacgttgtttataccgatgaacccattaaagcgtttactaacgaacacctagctgatgagtatagcaagcgcgttggtggccgcgtgcaggtggttggattaagaattgaatcaatggaggaagagaaatgctagttgaattagatgatgggtatgtaatcaacactgacagaattattgcagtcgacaaaaaggaagttatactttcaaccggataccaccccagacttcgttggtggaaggctagatggggcagacttactgcggatattaccgaagccgacagaaagcgaatttttgatgtagtgggcatttatcgggctaatggtcaaatagacggagttcaagttgatttaaatgttggcaagttatatagaccggccaaagtatcagaacaagttttgagcaaactaggcaattcagatggtgaggtagacgaatgaaaaaggttgaattgatgatgggattatcagaaattaagcaaaaatacccaatcggatctgcttataaagatgaagatggcatgtataaagtagttggttactttaagccacttccaacgactgcatttgcttcttttccaggcattgaagttatggaggcagacgaatgaagcacggacacaaacgatcagcaatcaagaaaaagaagcggcgtatggcgcaacatgccaaagaacatgctaagaccacgctagacgtgcagagcttacgaccgtataaaattgggggttatggtaatgccagatgagaaaagacgtattgagagctgtatgcgaattattggttatcaaggttatgcggttcgctttgataagtcatctgcggacgaatatgtttatcatgtttgttggagtgatggtaaaaaatatctaattaacgtagatcaattcacggttgacgagattggagtagatcatgtgggagaagattaaaacggccattattggcattattgggtatggaattgtgattggctgcattggaattatcatctacctgatttggtttcatacctcatgggtgatcaattttataaatgggcactaaaaatagccgtctcgggcatgagacgactatcggtaccacttttaaattatccacaaaacttattatagcgctattttaacgataatggaatattcaaaggagtggtacctatgtcattttggccagaaatagatgaggaacgaacaattgagaacgttgatggattgttaaaggattacccacattatcggatgcgagctaaacgagaagctgggttactaagatcaccatcaatggacggaatgccgagagctgatagctatgataaccgtgtagaggaagaatacgttagccatgttgaggcacaacaagtcgaattgaattgccggtatgcaattgaatcaattgaggataacgagctgcggacgattatgtatgataagtacatgcgaggtgacaccaacgaagcaatcatgattaagctcaacaatatgccgaaggaaacataccgcagacggtggcacaatgcttgcttaacctttgccgagatttatgggattcaggaattacaggtctttaaaacagctaaaacgtaaaaagtgggtctatattgggtctaagttgggtctcacagcacaaattttggggttatgctagtagtgttgattggtggataggtaccacaccaagcagttatccacactaactacttattttctctcctttagcaaataaatgaaacgcaaattccaacaatacacacatcaatcaacgtgattcagtcgtttaattggtaagacggaaaatgtgggttcgatccccacctgaatcatttacacgcttgttcgtgcacggtcatgcccgatccatggccgttatctattgctgagacataatggagatagtcagcacgtaaaacgtgttcaggttcgaatcctgacagcgatataggcagagatgccgaagtcagtcggaaagctgactataagctaatattactcacttacagtaatcagcagattacagcagtaagttccttaatttctcgcgttggcaaggttcgattccttactggcgtttagccacggaatagtggaggtggaaaagctcccttctgacccgtggcacaacgatggattttcatatttggtcgccttagcaggggcgacttttttaatgcaataggtgaataacatgaaacaaacagactatggcttagttagctgcacgtttgagcgtgatgcgctcctctctgccgccggcatagtttattagtttagcagcctagatactcacgaatttctttgattgctcaaactaaaatccttcaaactgctctcgctttttagcgggagtttttgtatagttgagacagaggtgttgtcaatggaaaacattagaattgccaaagatgtaacttggaaagaagtaaatgatcacgtagatgctatctcaaagaaagcaaatgaaatagtaaaaatgagtaataaacgtgaagctttggccgaattaaggactctacgtgattttgtaagaaaagatagtcatgatttacaattagttagaaatcatgacattgtgtcaaaaacaccagcgttgtgggcctatagcttttattctattcatttgcattttattgaatttaatcaaaaaaatatatcttggaatgccgatgaatttgatcaagccaaaataggctatgaaatggcgaaaccagaaggtgcggattaatattttgtaagcctagtgaaatactgggcttttttaatacataaatttaggagtggtatcaatgtcacgaatgattcatagcaaatatgggtacgagccgccagagtgggtgcaggccgatgctcggctagaaagatggtataaggataagaagcgtcgtgctaaacagcatggcgcttttaatatgcagtcgaaagatgacaagatcaaacggaggtgtggtgatatgtaatgactgagaagtatgaactggctcagaaagattatgaagccggtatgaagtataaggacatagcggctaagtatgatgtgaagctcaacacggttaagtcgtggaagtcgaggtactggaataagggtgcaccccctaagaaaagtgtgcacacaaaacacaaaaaggttgcacacaaagttgtggacgagctggttgataatgatgacctcacggataaacaaaaggcattctgtttgtactatttgcaacggttcaatgccacgtgggcttatatgaaagcctatggggtgaactatgccacagctaatatggctggttctagattgctagtaaatgatagtattcaaaaacagctgaccgaactcaaaaagtcagttgcgtctgatctgcatctaactgttgttgatattgctcgtgagtacgccaagcaggcgtttgccgacataggcgactaccttagtttcaagaccattgatacgcctatctgggagcgactgtatcgtaaaaatggaccattcgttgataacaatggccattatgattatgtagaggttattgatcctaatactgataagcctgcgatgcatacgaaacatgaggtgcgatttaaggatcagagcatggtcgatacttcacttatcaagtccattaaaacggataagggtgaagttaacttggaactttatgatagacagaaagcacagagtgagttgtttaaatatctgaaagataatggaaatggtaacgaagccgacaccactaaattaattgatgatataggaggggatacagatgcccacagcggtagttgatgatacacgtaaacataataaagtgattcgaatgtcgcggatgattaatccacacttttatgaactttggaatacggagaagccttatatcatcgccaaaggtggtcgtggatcctttaagtcgtcggtgattagtatgaagttagctttgatgatgaaaaaggaaacacagttgaaccgtaaggtgaacgtggtttgcattcgtgagaataaaactaatttgcgtgattcggtttacaaccaaattggctgggcgttaagcatgttagacctatatgacgagtatcagttctatacttcgccattgcacattgaacataagcgtacaggtagtacattctatttttacggtgcggatgatccaatgaagttgaagtctaacgtcgttggcaatgttattgcattgtggtttgaagaagcggcaaacatgaaaggacccgaggtcttcgatcagtcaataccgtcattcattcgtcagaaaccagcttttattgatcaggttaaagtgttctggtcctataatccaccacgtaatcagtatgactggattaatgattggattggtaaatgcgagaacgatcctaattacttggtggatacctcaacttatttagatgacgtattaggattcacatctgaacagcaactgcgacttattgagacgtataaagaaaatgatcctgattattatcgatggttatatttaggtgaagtaattgggcttggcaccaatgtttacaatgccgatctgtttaaccgcattgaaacaatccctgatgatgatcacgttgcttcgttgtatttcagtgctgataccggccatgcagtttctgctaccactgtgagtgcttatgggataatggcgaaacgcgatgccaatggtaatcctagattagttttactagatacgtattattattcacctgagggtaagaatcataaaaaagctccagatgagctatcaaaaaacatcaagcagtttattgatgatttagaggcccagtatcataaaacggcgtggaaatacgttatggattccgctgaagccgcgttgcgcaatcaaatgtacagtgattacggtattaaatggaccccagttaagaaactgaaaaaatcaaatatgattgaatatgtgcaatctctcttagctagagggagcttttactatctgcctacgcctaataacgtaggctattttattccacaacatcaaaaatatcagtgggacgaaaagacaatgcaaagtgatgatcctaaagtaattaaagttgaggatcactgttgtgatcaagcacagtattttgtgcttacggcaagacgtgagttgcaactccaatactaaaggtggtgaagctacgtgagcgtgattagcaaaattaaagactttttcaggaaaggaggtgcagcaattggcatgacaaattcattgaatagaattacagatgacccaagaatagcgacagaccaagatgaagttgatcgcattcgacttgctaaatattattatgctggtagttatgaggcacaaaagggaatgccatataacacaattagttatttaaactcacacagcgttaaacgaactagaatctttaattcaataaacgttactcaaatggttgccaaacgtattgcttcaatatgcttgaatagtgggtttactgtgtcaattgatagcaaatcaaatacgcaagactcaggtgataatgagcaggataacgaaattacgaagctatctgatttcattaatgactggttagagcgttcaggcgttaatcgcaatcttgaaagcaaactagaacaaggaattccaactggcgggtttgcggctcggccatatgttgacaatggcaaaattgaggttgcttgggtgcgtgcagaacaattctatagtctagattcaaacacagaagacatcagtcaggctgtaatcgcctctaagtccgttaaagtcgtgaataagcagagatattattacacgttgctagagtttcaccaatggaataatgatgggtcatatcaaattaccaatgagctttacaagagcaccgattctaagatagttggtgaacaagttgtacttggaactgatgatatgtacagcaatattgagcaacaggcaatatttgatagtaatattgtcaagcatccactgtttgtttattttaaatgtcctggtcagaataatcttgcgccagaaagcccattaggtgttggcttcgtaaataactgtcagaatattttagatgcgattaactatacacacgattcatttgtgtgggaagtgcgaatgggaaagagaaaagttctagttccagctgaaacaatgaaacccggtgatgaaaatcatccaggaactaaatttgatcccgatgatgatacctatctgggtattaatacggggttggatgaaaattttcagatcacatccattaatcctgatatccgtgttcaagattatggtcaaacaatgcaacattttctgcatgaactagaaaatggaattggattatctacggggacatttacaactgatgcacagggtggtattacaactgcaacacaagtcgtttcagagaacagtatgacttatcagacaagggcaagttatctaaaccgggtaactaagttcttgtctgaattaatttactcagttgttcagttagcacaaacacctgcattatttgatgatggtcaagcaccttttcttggcgttgatgtagatgatttgcaaattagtgtacactacgatgacggtgtgtttgttgataaggacgcccaagctaaacaagacttattatccgtagcaggtggcacaatgcctaaaaagcaatacattatgcgtaattatggcaagtcggaggctgaggcagatgaatggctagccgaaattaaagctgagacaccagaaacgccatttaacgaggcgtttggagagagagatacccaaaatggtggtgatgagtagtggctatcaagtatgcacaacagatcattgaaatgtacgaacacttgcagtcacagatctttaatctgttaatcaacgctttaaaaaatagtcattacgaggatcttgcggctgatgacatgctagagtggcaactgcagcaattaaccaaggcaggattgctgacatctcagaccatagacctagtggctggggtaaataaaagggcgcctgaattgattcaaaacatgtgttcgcaattaggaatagagacagtaaaaacaacacaagatgaaatcaatcgatacacgaagcattcaggaaaactacagccagctacgcaaaaaatcattaattcttacgctaatcaaacatggaaatcactgttcaataatgttaatgaaacactgttaacgcgcaatatccattctaatgcgacagctcgcatttatcgtgatattgtgactaaaagtaccatggaagtatctgccggcttaaagacaccagaacgggccattagagataatgtttaccgatgggttaatgcaggaattccaaccaggttgacagacagtgctgggcacggttggtcgttggaagggtacgcacgaacagttattaatagcaccaacaataacgtcgttaatgagctacgtgttaagaccatgaacgttaataacgtcacgacttcgaaaatgagttggcacatgtgtgctcggtcggcctgtgcaccaattcaagggcatattgtgaatatggttcctagattggatcctaactacaatccgaagtatgacacgatctatgatcacggatatggagagaagtcagggacattgggaattaactgccatcatcagtttaccccgtgggatccagacgtaaacattgagcatccggatccggatatgccaagccctgatgaagcagttaaaatgggtgatgttcaacagaaacagcgtgctcgtgaacgggcaattcgccaaactaagaagaaaattaacgctgcccaacaattaggcgatgatcaaacagtaagcaacgctaaaagtaccttagctaatcaacaaaagcgaatgcgcgaaatgattaagaataacgatttcttaacgcgtgactatgcgcgtgaacaagttcaaagcaaataatttatgtcccaagtaagacactaaactgcttattttttatgcaatcaaacattcggaggcgttgctccgatacaaacacgaaaggagacattgcatatgtcagtaacaagagattttctgaaaactttaggtatcgagggtgataatctagaaaaaattatgactgaggtcggaaaagataaggggatttctgctgaaaaagtagaattacagagcaagattgatggtctgacgagtcaaaacgaaacacttacaggccaaatcaaagagcgagacgatcagttgaatacgcttaagaagtctgctggcgacaatgaggaattaaaagctcaaattaagtcactgcaagacgaaaataagcaaaccacagcggattatcaaactaaattatctgaacaaagtaagaacttcaaaattgattcagccctgcgtgatgccaaggcaaagaatcccaaagccgtaaaagcattattagatttagacaaggtatccgttgacggcgataacttgattgggctagaggatcagttgaccagccttaaaggatcagatgattatttgttcgaaaatgaatcgacgcagaacgatgatcaaaacaaacctggtattcatgtcactgcaaaaggtaatccaagtggtggaacccaggttacgtcgttaagcgatatgaccattgcagaacaaaacaaactgtatcgtgagaatcctcaaagatggagtgaactagcaaataaatcataaggaggccattcaaatggcagaaacacatttatcggacttaattgtcccagaagtatttggaaattatgttattaaccaaattattaaaactaaccgattcgttcaatcaggaattttaactcctgatccagaccttggaccacatttgcttgaagcaggcagtcgaatcactattccgtttctaaatgatttgtcaggtgatccagataactggaccgacgatactgacattgtggttaacagtttgacatctggtaaacaagtcggaattaagttttatcaaactaaggcttttggctacactgatctagcaaaaatgatttcaggtgcaccagtccaagaaacgattggtaatcgctttgcagccttttggcaacgtgctgatcaaaagacgttaatcagcgttctgcaaggcactatggcggttgatgatgtcaaaaactcaaaagtctatgatcaaaccgttatttcaccatctgatccaatgtttggtgcgaagggctttacgggggcaattgggttaatgggtgacttgcaagataccacatttggtgcgattgcggttaactcaccaacatactcgttaatgaaggttcaaggcttgattgaaaccattcaaccacaagaaggcgtaacgccttttgaagcctataacgggttacggatcgtgctagatgatgacattcctgttgatctgactgataagactaagccaatttctagttcatttatttttgccccgggggctgttcactattcaacgaatatgcaagctacacagacattctacttaccactaaagaatggtggtactgatagcattattcagaaacgtgtagggacaattcatgtcgctggtacaagtgttcaatcgagctttgcaccagctaagagtacttatccaaccattgacgaattagcaaaacctactacttgggaggttgttaatggcattgacgtgcgcaatattggggttgttgagtataaagcgcaacttgacccagcattgacacctggagcaactgtcactgcagcagcgggcagtggaaaataggaggtagcttatggcatatttaactagtgatgaatttaaaaaatatggattttcgccacctgatagtggctttgaaaccgttgaacaagctgctgagttagtcataaacagtgttaccactttttacgataaagatttaggcagccatgatttaaccgcagatgtttcaagctcagttaatttcgaagtacaacgtgcgacagcttttaaaaaggcagttgcaatgcaaattcaattcatgattgaggctaatgccaaatcagcttatcagttgcagcaaggtaatttattgtcttactcagtagatggcacatcaatgacattcaaagagggtgcggcagatgccgtcactagcggttcaaccggactgattaactcagccagattgctactagggcgatatggattgctatacgcaggagttgatcactcatgagattaccagtaccagtcgcaatttgtaatcaatcagtgaagctcacgaagtcgtaccagagtgaaactgatatgtacgggaagccgaaacaagacaccccagtcactatcaacaattgtgttgttcacttagcaaccaaatataccggaacaaacaacgatagacagctcgtagccaacgggactgtctttttatatgccgatgtttcaagcccaatgcccagtctatcgaagaataatctagggtctaagattgaatttgcgggcaatgagtacactgtacaaactattactgaaagtaagcaaccgctgagtgatgagatgtttgcttacaaaattgaggtgctgtgatgggaatggaagtgcacggtgattttaatgcctttaatgcgttaaaggctgctgtcaattcccgcaatgtgcgtgcctatgttttaaatcaaatggaatctgatatgcagcggtttgtgccatataaaagtggaaacttaatgcatgatgtttcactcagtttagatgcaacgatgttgatttattcaatgccatatgctaagcggcagttttatggaattggtatcacgaattacaccacggcagttcatcgactagcgggtaaacgatgggatttgaaagctaaagcccaatacggcgacgcatgggcacaggtagcacaacgagcaattgataaggagttgaaacactaatggatttagacgaacgactgtgtgagcatattcagtcactaggaggaaacgctgccaagtgtggcctgggctttgtaccagccaatgggcaactcagtttgcaagctgatccgggaagtcgggccctgcaaacgtatttcaatggtgatgccgacatggcaatgaactttgacttagcgctcaatgatcagtcgtataaggccgctagagagaccctcaatccgattgcggatatgttggtaaatctcgaagaattagagagttctgacggttcatttctgtttgaccacattgatataaccggaatgccgtttaaccaattagtggatcagacagggaacttatattggattactaactttgttgtttatgtaacgaagattaataaataggaggcaaattatgtcaggaacaatggaaaaaaactttacgcataactggcgaaatgacgtcgaaattgatacaagtgggtcactagatccaaccaatatcgccaatgccaagttttcatcattagcagcatttattacagggatcacgcacacaccaggtgatgttattgataacgcaatttactttgctgataaagacgaaaattcacctgaagttactggacatgcacgtacttgggcagttaccggtaatgtcttacagggtgatcctgcgtgtgattacctgcaaggcttggaagacaaagatgccacgggtaatgacgccaagacgcttgtccggattacgaaagcaaacggaacagttcgaattttcttagctacccttgaaaacatcatcacgatcggtggtaatgggaatacaaagtcaacaatgacgttcacgattgctcaaaatggtgcggctgtgttcagcaaagttggagataacccagacccaaaacagtagccgtcacgggagtcacggtggctccttcgacggctaacgttgaagtcggcaagacagctaagctagtggcaacaattgcgccagatgatgctactgacaagactggcaagtggtcaattggcgatacgtctattgctacaattgcagaagatggaacaattaccggggtgaaggctggaacagcagttgctacttacaccacaacagatggtaccaagattgctacagcaacaatcacagttgttgaatcagctgcaggttaattaattgaagtcgcctatgaaataaacaatagggtaaccggcggctattaacggaggatagaacatgattgatttaaatgaatcgacaccgtacgtggaatgcaaactgggcactaaagtttaccatatctacgcaaatgacaagaatattaaacaaattgaaaaactagttgctttttaccgtgagcaaatgcaacaaattgacgagttggataagcgggacgagaaagcacaagctggcgacaaggatgttaaaccaattgataaagaagagtttattgagatcagtaataagttgattgaggatacgcgccaagcaatttttgatgtttacgataatttatttgatgaagcaggaattggtagtcatatctggtcgttaaagcatgagagtaccgaatatttaatgtttacgcttggcgacattcagaagcagttacgtgctgaacaaaataaatacgaacataacaaacgtgaagcgcttaaaaaagcctatccaatacatcatgcacgaccgcaatataagcaacgacataattacaagaagtgatttagatgttagatattacgagcagtcttgaacaggatcgaaccaatgaagtattcgtttggcatgatgaggactacccaattgatctaacattcgataacgtattgagatggttcaatctgattgatgattcaagtatcgatcaggctggcaaggtgctactgtcatttgccatgtttgttggtgatggattagatgttccatttgaccaacagcaggttgaagttggccgtatttccaatatgttatttcaggatccttataatcccggcagtggcggtagtcgatcatttgattaccagcaagacagtgaagccatctatgccagttttatgaaagattacggtattgatttgatgaaggttaaagggcacatgtcgtacttcgaatttcgggcattgtttaataatttaagcgacaatgcgccaattaatcagatcattcagattcgaaaggagaatccttctgcacatgccgataatcccgaatacgttcgatcgttaatgacacaaaaagcggtctacgaactacatatgactgctgaacagcgtgaaagagaaaccgaagcacaaattgctcaagcattcgaaagtctttgatgaaaggaggtaatttaaatggcttcagatggacaagtattaattgatttattgtttcctgctaacaaacaggaatttcataccgatgttgactgggctagtaacttaatcaagcgttttggaactggcgcaggtgaacagatggatgaagacttcaagaagaacgcttcatcagttaaaagcgaagccaagaaagtacaggcggacgctgatagtgaaaccgataaaattggtaaaaatgccggcgaagatatgaaggacaacttcaaaaagaacgccaacggaatgaaaaatgaatcaaacgatactaaaaataaggttaacaaagacctcgatggcatcaaaaaagaagttcgaactaagttaattgcttctgctgaaaatgccggaattaaaaactttcgttcattgctggataaactgccgaaaaaggaagttaccaaccttgaagctaagattaaaaaaggtgaagtcattgactggcaagaagcaatggcgaagatgccacgccaagttgtcaccaaaatgaagctcgatgataaagaggcaacggctggtttatccagattaaaagcagatgctgaaaatacaggcaatcattttaagcacttgaaggaaattattgtgggttcgtttgttggatcagcaattcaaaacggtttttcaagcattgttaatggatttaaagaagaaactaaggcaggaattgaatacaacaaaacgctacaagtttcgcaagcatcgtggaccacattaactgatagtgccgtccaaggtaaaaaaatgactagcatggccacggaactagctaatcactttggtcaagcacgtgatatggttgacgagttggatcagcagttttaccacgttttggatgattccggtaaaaccaagacactgaccacatcgttcttaacccttgcagatacaattggcctttcttcggcacaaacgcaagctttaggtcaagatttcacccacactatgacctctggcaagttgcaactaggcgactttaatcaggtcgctaattatttgccgatgtttggcgaaagcttactgaagtatgagcgaaagatacagaataattccaagttaacgatgaaacaattgcaagccgaaatgtctgctggcaaaatcagcgctacggacgccatgaacgtaattaatcagttaggagacaagtacaagtcatctgcggataatatgatgaatactttgcccggtatggaacgggcaatatcagctaaagcaccacaactattttcagcgttcatttcgccgtttctaaaagctgaaaatccaatcgccaaagtagttatgaaatgggtcaatgatcttaaaaccgaaacagaactgtcaagtgcgggaggtaggttctcaaagacactgaatggtatatctgcgtctatcgtagctgctttgcctgaaattaaagacattattgttaatgtggtcaaattgtcgggaattattggcggcactatttggcatatgtttgcggatattatttacgatattgcgaacatgtttggactggtttcaagcaaaagtggtaaagccgttaacccattaaaagagatcgacaaggtattacaagccttagtggatcacaaacaaggtgttgaaatggtaacacgagccttagtagcgatgtttgccattaaaaaaatcactgatttcattggtgcaactaaaacagccattaaaaccttagaagaattatctttggttcaaaagctaacttcattggttccgggagctggcacagccggaactacagaaaaggtagcggctggtggtgaagaattggcagcaactagtcgagtagcgcgtaactccattggggcaactagcatgttaggcacgcgaagtctattcaagggtgccgcttcaacgctaagccttggtaaaacagtgccaattctagcagcgggtactggggtagctactgaattgatgagcaaaaacagcactggtgaaaaaattggcggttcggcgggatcagttgctggaacagtagcaggtgctgctattggttcaatgattctacctggaattggtactgcgatcggtggcatggctgggtctgcattagggaaaaagttaggtgaagtaattggtaaaggtgctgaagatcattttaaagggcaccccattaaagccaatgtcaaagttaaaacaacagctgctgatgttgatagtagtaagatcagcaaagcgctacaaccatcacttaaaaagttaagcaaacaattaatgcttaaatttaatactgatccagcaagtatcggtaaaactaaagctgaaactgaaaagctttattcaagtatgtccaaatcaattaactcgtactacaagaataaggaagctaagtcgaaaaaggatcttgacagcttagttaaacagggtgttatcacacaagcacaggaaaataagcgcttgagtgcccaacatgccgctgatgaaaaagcacgggtagctaaacaaaaatcgctatcacagatgcagtcggacaccaataagtattatgcgaaagttcaaaacatcgaaaatggtggaactaaaaagttacaagaaattgcccagaaatatggcaagaattcgcaaaaatacgaaaatgaaaaaaataaggaacttgaaaaggcccataaaacattcacaacaaagtacgtaaaagatgaatatagtatgaacaccaacattgaaaaagacgttcaaaagggggccaaacagcaagaatttatctacggtcagctgattaaggataagggaaaactgagtgaaagcgatcttaaagctacacaaaagcatgccaatgatttgtacaatacctccgttaaatcagccgataaaacccgggatgatgtggtgaatgcagccgaagataagtataaaaagacagtagccactgcaaagcaggagtggaaagaaaacggttcaatcactcattctcagtatcttgaaatcaagcataatgccgaacaacagcgtgatgacacttccaatgctgctgacaagcaatacaaagaggttactaagagtgcacatgatcagcactctaaagtgacttctgaaattgattcacagaaacgtgaagttactcaaaaggcccaagaacaggccatacagcatgcacaagcagctaatggtgaaatggtgacgacatctggaacatatgcatcgggttttaaaagcatcagcggactatgggacaagatgactggttttattaagaagatttttaaagtatttaatgaggacaagagttttccaaatcaaccgaatttcaacggatatgccaagggctctaccggtatttcgaatgaccaagtagccttagttggtgaagaaggatttgaacttggaaaagatgctagtggctttcacgtgctgggtgcacagggaccagaaatcagatccttgcgggctggaacatcgattctgacgcatgatcagtcgattggctttcttcgtaagatcggtctaccaggctatgccaaaggaacggaagacgatgacacaagcttcatgagtgaaatttttgaagttgttatgaatggtgctggtaagttgtggtcatggattaaagacaaaactggcattgatggacttctagacagtttgacttcgaaaggacttgttaaagacgccggtaaaggatcgttcaatattgccaaggatagcattgtcaaaatgctgactaaattgggtgagagttcagcggccaacccaggtggttcaggtgtcacgagatggacaccgtatgtaatacgtgcccttgcgatgaatggattgtctactagcgctgcaatggtggctaaggtattaagtcagattaatactgaatccagtggtgatccacacgctaaacagaaaggagcagatcctgatggtgatggctcaggaccagcaatggggttaatgcaaacgaagcgtatcacgtttacctcaaacgcttttcctggtcacagtgatatctggaatggattggatagtttgcttgctgggattcattatgcgaagaaacgttatggagcaagtctgagttttctcggtaagggtcatggctatgctgcgggtggcgatgttgacgaagatggactgtatcgcttagcagagggcaataataaggagtttgttgtgcctaatccaaacgtagccggtgtcgatcggacgtacgccatgattggcaagtcagcggcatatgtggctgctaaacaaggattgcaatcaaccaatagtcaaagttctgattttagtagcctagaagggcagattagtaatttggcaaaatcgatgaaagagacagcttcgaaagaagtagcgattattttcaatgactatgccattcgggggattgccccattaataactaaggaacaagaaagagataaaaccaatcaaaaatgggttagaggtgaaagacgtgtctgattttaaagtgttttatgacgggggtgaactaacccaatatattgacgttttagctggcgttgatgaaactttaatgcctgatcgagccgatgatctagtaagccctggacttatgcaagggagtgtccttaggtcagctaagcttggtactcgaactatgctaatgccatttaccattagcgcaccaaacattttagataaatatagtaagctagccagtttgatttatagcggtgataatcaacctaaaaagttaatttttagtagccgccctgatcgatactggatggcgattccacaaggcaatattccagcacctcaaaataatgatgtgagactatcatctaccatcacgtggctgtgttatgacccatttgcttatgcaattgaagaagatgagttcgatctagatgccaccgcaggacaatacactgttcaaaacgacttcaatggaaaagtgatggggcagacttcaaaagtccctcacacgatctatgccagccaagaacccatcactgttgccatgcaaccgcctagcgcttatacgcaagagattacaactgatttgtatagtaaactggcctcgattgatggaacgtgtgccacggtgatttcaaaggctaaacgaacgactgcaattacacagacgctgtttccgttggcgactgattcacctaaaactggggcgctcgattatttccggttgaatggtgacaacattgaaattggtgggtggtttgctttggatcaatatgccactcacccatataactacatcatcattactgatgctgactggcacaacgaatatggacgggtgaaggttgatctaactgaccgcccggacgtgcacaacgtgtaccctaattatcctaacggtggtcactgtggattctatggttccattccttataagaaaggaatggggaacaaagatctacgaattcatttcagatattcagatgctgaaaatggtgaaggtaactggtacaactgctcgtttattgcttctagtcaagactactggcaacaatcagcacctcacctgttagtgaagtttgacctagtgaatgcttatgagcaagctcaacccggttactgggataagtacaaagtaaatagccgacagcagcagctggaatggttgaagaagtacattgttagtgcccgattcagtgcagtgattaatggttcaggtgagagtggaaacaatgctcgtatgcaagtctgggatcagaatgacagttgggtggggagtaccagtaccgcttcacctacaccgtcactggtgacaattagttatgccactccaacggagttgttcaactatgcttcagcggatggctatctgtatttcaatatctttccacagtatgccgtgagtggtgataccaccgatagtgtcatcaatttggactattttggtgctcagattgtaactgatgctccggaagcggaagcgatgaacatagtcaatgacggcccattgccagtagctgcccgttttgaagtgactaatcatggggataatgggttcttgggtatcacaggtcatgatcgaagcgtcttgattggtaatcctaatgagattgacggtggaaaggtcaagaagtcagagacactatttacaattgataagacggctactgatttagctcaattcaaaatcaacagtggtatttcgggtgctgatgaggatatccgacaggttggatcaatctatattggttccaatcgtagtaagtgggcgctgatgtgttaccaaccatcaacaggttacgactttggtgcggctacttcagggactgatcgaggctggcatggaccttcagtgcaccgagacatgtgggaagacagtcaagggacgactggttcagacaacttcacttgtgaaaccagaatcggatttgaaagccagtttgccgatgctggactagttaatatcgtattgaatgcggcagccggtgagcggcttgtaactgtacagattgttacaggaaacaatgctaatgctactctattggttcggaattcagatagtcagaacgtttattacgataacagccctcgttggaatacatttgtgggtaccatcaaaattcagcggttcggtaatacgtggacagtggatgttcaggacactgaaagtggatcaggtgcgcgtcaaacaattactttcgaccaaacaacaagcggtactaaaaaggtaactggttggacttggcagatctgccagtggtcgaatatagagcaggtatcgaacatggtgctatttggtttttggtttcggaaagaaaacgttgatgaatatgttgatgtgcctaacacgtttgaagatggtgatctaatcagtgtgggtggtactgaaaataaggtggaaactcgtgtcaatggagcactaaacctagtacttcagaacatcgcttctaagtcaattatggtgtacccaggcaacaatatcatttcgtttttattttcagactttgcttcgacgcccagtgttaaagcctatatcaggaaaaaatatttgtaataaaagaaatgttaataaaaagtgatcaccataaaggcaatcacttttaatgagtatcatgatttctttcacttaaaattctgtttagccctttatcaatatcatcaacggcttggcgatttgttgcaaattcatctagtaattggcagagagctttagctagtttttcatcatgaacatcattggcttctagaatttcgttgacacgttcttgatgcattcaaaacaccccatttgtataaatataaatttagtatatcaaaattaaatagagaggagggaatttatttgcaattgtatgtattagatcgttccaaaaatgtactagctacaacggctagcttctataatgacaaacaccatcaggaattaactgctggtgctagtcaatttcaattcgatgtaagcaaatcagatccagccgctaagtatatgatttcgggaaattacattaatatgcttgatgatcaagggcggccttggtcgtttaccattcttaattatgatgaatatcaaacttacaaaaccattttctgcaatgatgttggtattgaattaatcaacaaggctacggatatctggtattatactgatccacacccttttagtttttatttcgatctaatcaccaaagatactaattgggagctaggcattaatcaactagacgggttgtcacgttcattgaagtttgatgggcgtagtacaggccttgcccgattgcttgatgtcctaactgaattcgatcatgcagaatgtatcttcaacattacaatgcacggacctgtgccagttaaatacgtggttgatgtttataagaaaatcgggacagttcaaagcaatcttcaaattgtctacaatgaagaacttaacaatattcataaacaagagacacgattagattttgtgacagcattagctggtatcgggtctgtaattgaaaacacagatgaaaatgccgaccccaatgcacctcaacaatatgtcgatttttccgatctggtatacgatgacggagatttctacacgactacaggcgataagtttctacgggcacgaactgctaataagcaattcaatcccggcgaccaaggctttgttgaagcattctatgagtatgacacatctgctagtcaagagttgtttaatcggaccctaactcagattcaaactcgttcacagccacaattcacgtatgaagctgatgtacaggtaatggaccctagattacagcttggcgatacagtgacgatgattgaccacgactacaatccagcactatacttatcggcacgcgtggcaacgcttgaaaaatcatatactgatctaacacaagggacggtcaccttcacaaattatcaagtattaacaagcgatattgacgcacaaattgcggcattaaaatcgaaggttaacggtatcaagaatggttcatcaagctacgtttggattcgctatgctgatgatgatcaagggactaacatgagccagagccctaaagataaaacctatgtggcgattgtagctaaggtcaatcaaccagtgccaagtgatgcccctaacgattatgccggtcactggcaaaagataactggcacagatggtaatgatgggcaagatgctcatacccatattgcctatgctaatagtgttgatgggaagactgattttactactgatcagaatcaggcccacaaccgggaatatttagggatttattcggataatacaaaagctcaatcaacggaccccaccaagtatacttggcaactcacacgtggcgctcaagggctaccaggtcaaccaggctccaaagatgtgccggtagtcatcatgagttcaacagcgccagcaagtcccaaggacggggacttttggtaccaaacaacgactgattccagtggtcaaaagatcactggtttttctgtctattcaggtggtaagtgggtgccgtcgaagattgatcaaagtacattggtgttgacaaagttggtatcagtcgagattgattctgccactattaattcaccagacatcacggtgccatttgattattttgatgagtcacaaaacgagtataaaggttcaatggaatttaaggatggcatgctgaagcatatttctacgatgactggcgggggcatgctcaagacggttgtaagccctacgggttacacattggatgcttatgccaatcaatccgagtatacgaaaaacaatccatacattcacaccgaaatgtatgcggacaacattagcttgtccaatgccaatacgaaaaagagtggaattctggattctagcggtattgggggcacgttaaacaatgggactgaccagtctaccaatgttagtgtaagttgggaagatgtccagaaatatttgtctgaaatgagtgacacaggaagtacgagagcttttgattggttcgacatcatgagttcggttcagtcgcatcctaatttaattcgtaattcatcgttcatcaatggacaaacaaattgggatggattcaacgaccagtgctatatggcaaatgtcacccatgatggaaactttgcggtatgtattgaaagtgcgggcggtgggaacttcattagtcaaaacctatcacacattcctgaccccggccaccaactatgcgtgtcgtactggggtaatattgaccgggacgacggtgacttcaatggcggcatgctaattagttttcagggcacaaatagtaactatgtatgcaatgtatcgactgttaacccaagtcatgctcacggttggcgtttttatacgtatgatcctatcacagttcccaacgggacaaccgggattcggatctcgttctacaacaacgaacacaacggtaacaagatttactacgctcaaccaatgattagtgatggcgacgtacgagcaccgtatatgccaacgtattaatgaggtgaaagaatgattgattttccaaattttatcgaactcaaaacggcatttgatgcgggaacgctatccatcgaaaacatgaaacggacggtgaaagaaaactatattagtccggatcaatatcaaaccatcgttggtgaagggtaccccgccaaaatcaatgaagcacacttactcacagcagctgagtatgccgcactaattggtacaaataaaacaaggtagaggtagaaaccatggtcgataaagaagatgtaaatgtgattgatttattgatggatattcaacaacgcctagtgaaggttgaaactaatactagtagcgtcaatgaaaccactaaaaaagccgatgaagcttatacactagccaagcaaaatgaagctgatattaaggatttaaaatcaaatagccagtggtggtcacgcacaatgtgggtggcgattattttgccggtcgcgttatttattgtagagaactttttgatgaaataaggaggaaatgtaattatgaacgtccaaaatattgcggatttactcgtgtcactatttgttgtcgtcgtccccgtgattggaggctttgtcaccaaacatgtactagctaacaagaaagtagttagtttactgcaaactgctgagccattggcgaaaacaggcgttgttctagccgaacaagccggagtaacagattacctcacgagtgaagcgaagaaatctaaagcagtcgcctatgtcctagcagaactcaaaaagctaggtttcactacggctgatgaaacaaccattgctagtgtggttgaaaaacaattcgccgaatcaaaacaagcgattgaagcagcttatccgcaaaagacagcgcaacaagttgcccaagaacaagcagacgcccaagcaaaggtgaatgctgcggcgttgcaacaagcgcaagctgatttagcagttgctcaagccaaggtggccagtttaacacctacggcaggtacggcaacggctcaataggaggtaacttaattgaataaaattaaacgattagtcatcacatttgtggtggcttttttagtagtgattggcattggaggcacagcccatgcggcccgcaccgatatgctagacgtgtctgattacaataacaatggtcaggcactcaccacgcaacagtatattaatttgcgtaataactacgggatcaaagctgtcacggttaagattagtgagggtcagacgtggaatgcctcgaccgccaaggccaacattagtgacgctagtcaagccggactatatacaaatgggtatcattttgcccgctataattcggtggccaccgcgcaagccgaagcacgtcatgcggtccaacaggcgcaagttgacggcctaggcattggctcggtgattgtgacggatgccgagagttcagcgcaatctggtgcatctaaggcaattaatgaccaagcgaacgaagcatttgcccagattattcagcaggccggttatcggtgtgatatctacacgatgggatcatgggttaacactaagatgacggttgataatggtactggttggattgcctactacccgtaccacgtgacaactgatcggtatactggtaatcatgcttggcaattctggtcgggcatgacctttacaggtttgtcagggcgctatgacgttagccaactgtacgataactattacacagccaacaccgacaagaatgccgtaattagcaactcacagacggctcacgtggctacccaaaaggcagctaagtctaatcagttggtcgttgatggtattccgggttacaatacttacttaggattgcaaaagctgtacggtatgcgataccaagatgggaaaatcagtaagccatcaccattcgttaaggtcttacagaagcatgtcggtgttactcaagacggttacttcggtccagtgacttaccgagctatgcaacgtaaactcggtgcacccgttgatggtaaagtgagtcggccatcgttaatgtggaaacagattcaacgcgatattaataatggtgtgaaaccgttctaaactgtgttaacatataaaacgcattagaattaacaacctcactaacattagcctcagtccttaacgggattggggctttttttgttgccttgatagtgtataatgattattgcaaaacataatttactctttgtttgcgccaatcatcagtccttaattggattgatgtttttttgttacaggtaagacgtaaataataatggtgtgaaaccgctttaaattgtgatattatgtaggcgatgtgtgtaatagcatatcacttcctaagagtgcctctatccttaattgggtaggggcttttttgttgtgatcaaataaaacgtttacaattactgaataaagtattatcattaagtatgcttattagcaattctctttctttaggaaataccacgaaaagtctcagtctccaccggattggggctttttttgtttgcggatatcatactgaaacagttagtggtattcttaaactgtccgttatggattcgtcagtgttgaactctatctttgattaggtggagttttttatttgcattaaaagaaaacgtttacattttttggataaagggttattattaagataatccttttagttaatactcttttagtagttgtaacttcgcagaatctctccagaaatggggggttctttttgctctcaaacgtattctgcggtaatgataactattgatatggtcacagggaaagcataaaaatagtacccataccaatatcggtacagatactacattgtctgcttattttttgaagtcaaaccatttacttttttacatgactcaaatataaaagtgcttaaccatcgtggctagaaactttactcgttatgatcaagatggattagaattccctttttattggtctgagttagtaacattttcctgaacaagatctatattgttttcgttatttgcaaacacaccagtcttcgacccataaatatttatatctcttagctgcgtgttctcagtgttttttaaccaaaatccagaatctgcaaatttttgggcgttatcaatcatttctggttcctcagcttcagcatttttcttcatgtagaggtttacatttgttattctgagcccatcaacgggagattctgggattccgtaaacgaatcctgctacggaagaaacaccagttgctgtaatgttagaaagcgaaatgtttttaatggatggtgtagagtcatcaactttttgtttttcatcagataaatatgattcttgttgagcaccactttttccgtacattgcattaatagcaattggtgttaaaacatttttcatagtgatatttgaaacagatatatttttaatatatccaccacgtccgcgacgtgtcttcatacgaattccacgatctgtttgatcaaagatgttattgtttatcgtaatatcggaaacaccaccactcatttcactaccgatggtgacgccaccatgaccatgcttcataatattattagagataataacatcttttgttgcacttttatgctttgtaacttcagttccagatttaatagcaatacaatcatcaccatcactaatagtattgtctaaaatctttacattttgtgaagattcaggatctattccatcagtattaggtgaattgagtggattattaattgtaactccttgaattaagacattgtggctttctaaaggatgaattgtccatgcaggtgaattttgaagtgtgatgccggtaattcgaatttttgaactgttatcaaatgctactaaatagggacgagaatacttaaatggaatcttatctgcatttttcagtggaccttctttagctttattgtacattttccaccaagctgatccgttaccatcaatcgtacctgatcctgttatagaggcattttttacgttcttagcatagatatctgcatgtcgcattttaacattttgtccctcgtaacgtgtttgaatagctggaaaatcactaaatttatcagaaaaaacaatcttagagccagcagatagatgtagatcgacattatctttaagttcaagatattttacattatacttaccagccgcaatattaacttgtccaccaccatctttagagactttattaattttgctttggataacttttgttgtattacttttactattatcaacagtaatattaaccggttttccattagaattggcactaatcgtttgattagtgcttattaaaagagaacaagcaagtgtagtcccaattaaacctaaaataatttttttttgatgcatgaatgagcctccctaaaaagataaaaatgatcattaactttcgaaaaatgttaccggtaacatttttgaattaaaaaataaagccatatccttagactttataaaaaatgagaaatatttcaaataaaatgatagcgttttcaaaaggctaagtcaagcttttctgaacgaggaaatatattttaattatggaaactagccttatgcaaagtaatttttatacttatagttataattgttagcctataaacgtacatagaatcatctcttaattaatggatacgcaattatgcgggcatgcccacgaaatgcccacaataaatataataagaaactatatacacgggaaaaaatgtttctactatattaaatttgcagaaaaaaacaacttaccgctcttagataagctgaataagtgcgggcttgccacggagtatttaagcgagttattcccttacctagtttttgatgaaaatggtagaaaaaaagatacttataatggactaagggtattgtagcttagtaaaaaagcacacactcctaagaatatgtgcttaaaaatataggattcgttcatccaagacgatcgtatatttttttacataaaagtcaacgggaacacatataaaactacaaaatgtgttgaatgatatcatgcgatttttttctgacgtacaccacaggtacaccgacaataattggaacttgatataaaccttatgtatcaatgatatggagagattactttgattcccgtcactcgctttaggctccaaacccttgatatgacagcgattctgatgaatctctgtcttttttattttattgcggatgcaatgaaaaatcatggaaatttcaatagatttgattaaaaacatccaacgaatcgtccaacgcttttttacgacgatggttttttatacataaagcattcattttcgagtattgcataaatattgatttgataggaatctcgaactttgcttatttttttatgcaagaaatacgctgatttaaagagaaaaaaatagactcgaaattctcgataacatccaacattattaaaaaatcattagagaattaaatctctatataactaaaaggagtatttagtttcttctatagtcgtgaaaaacaataaaaaaaggccatgcgataacgggtagcatggccggcgttgcctcgcggaggtgccaggcaatgcaagagacgtgtgatggggttaacatcacaactgtattatccatcaaattaggttgattacaagatgaacgcgcgtattattacaatcaattcaaacggtcgacttgctttgtgaccaagaaccagataatggaagcacaaaggtgaggacacccaccttaatttggttactttacaaaatactcaaagcgaataatacgcaaattaatgatggttaagcttacgtgtttatctttttttcatctccccagtagtcaagaaaacgatctcccacattgatactaattatcaatagagaagttattttttacatgatgggttagtaaagatcaaaatttagaattgaaaatattataaacgtatatcccaaagatgtttaatcatggtgatatacgtttttttgtattgcttagtacatatttctctacacttgtgatagatcatgataccttgatattaggggaaatttgggaaaataaaatcgtgtttatgggtacacccaaaaacactatttttaattcggaggtattatctatgaagtacggttatgcccgggttagttcgaatacacagaacttagccagacagatcaaattattgaaagaaaatggcataaaaattatttttaaggaaaaagcttcgggtgctgatattaatcgtccgatcttaaaaaaggcaattcaaaagttaactaaaggagacgaactagtcgtaatcagtttggaaagactaggcagagatcaggatcacttgactaaagttatgtttgatattcatttaaaaggtgctaaactgcacattttagacattccaagctttgaagaagttcaaaatcaaaacgtccaaaagttactgaaaactttaatgattgaactaaaaaaatttaccgcagccgacgagcttgaaagaattactgaaagacgtcgccaaggaatcgaactggcaaaaaaacgtggcatttataaaggtcgcgccataaaatatggtccaaactcaaaagatgaggatgcaaaatccatctaccatacgattttaaaaatgattgaagccaattataaaatagtcgaaattactagaaaaactggtgttagcaatagtgtggtttatcgaataatcaacgaacttaatttaaattaatttattcgtttaaccatatatttgccatacatctgtataaaagagaaaaaaacatgatttttttgtgaatgaagatatttacattcttaaaatcaatgttaaactctaatcaagtattaagtatcatatgttaataattacacgcatacttatcaagtgaatagtatacttgtatctattattaatcgtgtttatgggtgtacccaaaaacacgaaaattagtcgagcatggggggataagagaggtagaaaaatatagtggaagtcaggagcgaatcctaaacgacctagtcgtttaggattggaattttaagtaattggtcgtacaaccaatgggggagatatctaatggaaagtgattatagaaaagtttcaaaaaataatcaattaaaacgccaagaaaaagataatttacattatcgcatgtacaagtcaggccgaaattggttatttgcgggactctttagtttgacaatttttggggcgacgtcactaactgctcatgccgatgagacaactgatgcaactcaaagtaatgaaactgctactgttgatagtttagcgtcttcaagtacaacagtggtgttgaatacaaaaccaagtgtagctagtagcgcgacgagttcagcgtccaaaacgactagtacggcttcatccgcagaaactgctgcagtcgaaaaatcagaaagtgaaaatagcagtgctagcagtgctgataccccggcacagtccacaaatgtcacaaatttagggaatgccaatagtgatgaagttgttcaagcacaaagtgcagcagccgatcagtataaacagacaggaaccgcccaagaagtgacagcagttgcaagtacgaacgccagtgcaagcgcaagtagtacaactgcggaaaaggcagaattagatgctaattctataagtgttaatgcaagcgctgttagtaataatgtcgaaattggaaacacggcatcatttaatgtacatttagatgttaccggtattcagacaacatatcataatgcagaactgacgttaaacattcctacggatgatggtgtaacgctacaaaacaaagtttctgatttggcaattaatggtgttgttccaacgctggatgccactaatggcacattagtatacagttttggtaatctgaatgctggttttagtaatgatatcgtactggcctttgaaactacaaaaggaaaaaccttagccggtcaaacactgactttgagtggaagctttaaatctgatgaaaaaacagtcgatcttgaggatgtcagtgtaaaaacagagtccaatgcaacatatagtattactaaccaaatgacgggtttaacaccaatcaatcaggacaattataaccacgtaaatcctaaccctggtgatacagtgacattgactgctggatataatattccaacgacaaccgctggtaccaccttagtaaaagaaggtagtgatattgtattaacatatgctttacctgctggattaagttatacaggactacaaagcgggactgacctggattctgtagacgagccaactgttcaaacaaacgcggatggatcaagtgtgttaacttggactttcaaagctggtacaacagcagaacaaatggctaatgatttcgtcaagaaatttggtattcagattaaagtggacagtacgttaacgggtatcacgccattagccacagatgcaagtatgaactatacgactactgacggtaccgcagttaatagcgatgcaacagaagctacctttacagtttctccatatgatcctcgtgatggtgttgatcagactggaacattttacacaccacattacgtttctggggcagcggatggacaaggggatacgaatgcaactggtggagctaacgcagatccaacagtttatacggaagatgatccggtattaaccgttcatgttacggtagctaatccgtattcagccgcatttgcgaaagatgagaatttccaaaatattaagtatcgtgcggttcatgaaacaattgatccaaatgaatctttgcaggaaatctaccttggaaagggattttctgcaattgactctgccaataaaggcagtttaacgtatttcccttatgctacacttgctgtgaagtatgagggtgaagacgataatgtttatcacgtgctaaaatcggatatttctacggccgaaacaacagatgttacgcgtagcgatttattagcatggggattagatccagataaagctgtggtggatgtttacctgtattatcatttaactgaagatcctgataaagtgattcctgataatgttgatacatttgttaatgcgggcgcagatgacggtgatgcatacaaattaagtaatcctgattactctggacttccggatgattctggggttccgcttggcttcacccaaagcttgtatttcacgacaacagtaaatgatggctttactggcacaattacgcatcaaacattttctcagtatgatgcagatgtgcattcaggttcttggctggatcatgtattgacaccacaagatattactaatggcggtcctgacccggtagaagttgcaaattctgcgccacaaacagttgaggttgttaatagtccaacaggtatttcaagaacggttgtcgcaaatgtcagtttagacggtgccaatgaaagtaaccaaatttcgactggtgctcatcaattaacagttaattttggcctttctgctgattcctcggctaacttgactactagtacgcaatttataagttatgtactattgccacaaggggttacgtatgaccagtctacaactactgataagactgatgtttacacagtagttgataatgattatcaaggaacgggtcaacaattagttaaaattgcatggggcgtcaactacacgacaccaggctatgcaatccaaggccaaatgggaattaacgtttctgacgaggcagcaaaagtcttgcagtttaaagcactgactgatcttggcgatgacacatttcaggtaccaacagtatctggtacgccaacaatttcagacaccactagtgtaactgatacaaacgatattaatggtaatgattcaactacggatactttggttggaactggtgctgaatataatcttgcaaaaactgcaattttacaaacaagtcaaacaaccgatggcgctagcgctacaactaacacagtaacgactggattagattcaaatgtaacagttaaggttaataccagtgctaataccgatccaattttaaatacgttagatttattagatgttttaccaactataaatgatactggattaacgacatcagattcacgtaattcagcattcacaccaactttaactggaccaattacattgccagcgggttggaatggtaaagtgaccgttcaatacacaactgactcggatgtgacattggctaatgaaagctcagctaattggtcggcagagagcgcggttagtgattggagcaaggttaccgcatttagaattacgttaaatgctgcgtctggtcagacgatcgatggtcaaaatcaaaccattagtttcaacctgcacacaccaaatagcattgatagctatgcggggacaggcgatcaggttgcttacaatacctatgccattacttcaaatggcttacaagccacggaacctttggaatctggtattgaagttcaagtacctaacttaacgtatggcacttattcggttacgagaactatccattacaacttttctaagaatgatggtggaggtcaagctgcacccgacgtacaacaaacattagtatattcaactgttacaaacgatgtgactggtgaaaccatttatacgccagtatcaggatctgaaaatggatcagggattttcgcggcgcaagatagtccaacgattagtgagtttactccagacattgcatcggtagaaatggaaaacagaggtgcaacagctactcagccagtaaattcgaaggatgtaaccgtaacgtactcacggacgacctttacacccacaaatacggatgaaaataatcctaaaacttcacgggcagcactgactaagaatgttgtagaagttgtaaattatggttctccagtcggtggtagtcagacggttcaaacgacgccatattatcgtacggttacagttgatactgacgcaaatggtaatccaacgtacacatatagtgcatggacaagtgatgaaaatgtaaacggtgaaaccgcaactactgcaaaaggtgctgatgtttcaggtacattcgctggattgactgatactcagttgaaaacgccacaagggtatacagcgacggttgcaacatcaggggatacgacgactactgataatggtgaggcgccatatactttcaaagacaacgcaagtaatgaagtacttactgtcacacgtgatgtagattatgtggctaaaccgggtagtgttgttgttcactttgtttacgaaggtgaggatggcgtagcactgaaagatccaatcgtgttagacaatctgcccgctggtagtggttatttagctcaaattgagcaattagaaaacgataatcagacgattcaaacgccagatggtaagtcctatcagggtgtgcaacttaataatgaaaataaattagacatgtctagtgttaagttgttaattggctctgatccaaataattatacagttgacagtatcgaagatggtactggtaatgatgcagcgtatgcgacagacgggcaggatgtctggttgatctatcgtgcagatccaaaggatggtacaaatgggacagatggtcaatcaccgatgattgatccaagcaatccagatggcacaccagttgatgctgatggaaacccaattgctgatggtgacacaacgacaccagttgctggaacacaatacacattagtgatcaacgagatcggtgatgatgggcaaccagttcaagctgttgatgagaatggcgatccagagacggatgccagtggcaatccggtttatgtcaaagttccagtgggtacattcattgtgaagagtggtgaaacgccaactatcacgccggggacggatgcaaatggaaacaccacgattacaatcaatggtggtgatccaattacaatcaatagcaattcagggtacaactactgggtaaatctgacaccagatggcaccgctgataccaatggtgatggcacaattgatgcgagtgacaatacacttgacttgaatggtgatggtacggttaatcaggaagactactttgtttacctgaacaacgttaacaatgctaatagtgactcaggctacaatcactggttgaacctcaacattgatggctcaactgatgtaaatggtgatggcacaatcgacgataaggacaccaaccttgacttgaacggtgacggcacagttaaccaagatgactactacatttacttggctaatattgctaataataagagtgattctggttacaaccactggaagggattaactcctgacggtacggtcgacgtcaacggggatggaaaagcagatagcaatgatacgacacttgacctaaacggtgatggtacggttgatcaagatgattactacctctacttgtcgaacttggctaaagctaacaatgaatctgggtataacttctggttgaaccttactccagacggtaagacggttgatgtcaacggagatggtacgattgatgataaggataccagtcttgacttgaacggtgatggcacggtcgaccaagctgattactacatttacttggccaacattgcagatgcgaatagtgaaggtaactcaggatacaactactggttaaacgacattacagacaccactggtgacgtcaatggagatggtaccgttgatgacaacgataatagtcatgatctgaataatgacggtaccgtcgatgaacaagattactatctcttcttacaaaaccaacttggtaagggcaaaaatgggcaatctgcttacgagatctggctgggattagatggtaatgccggcaagacggttgaagacttcattgcttcgttgaagggtgacaagggtgataaaggggacgctggtactaacggtctctcagcacttgaaatctgggaaaataatggtggttcagatcttaacggtgatgacacaattgatattaatgacttccttatctccttgaaaggtgccactggaagccaaggtgattcggcctacactgtttggttgaagaatggtggcacggatcagaacaatgatggaacggttgatgaaactgacttccagattgcaattaccggtgccaaaggcgctgacggtaagtcggcttacgacgtttggttcaacaacggtggtaccgatgtaaacggcgatgggacgatcgacatcaatgacttcctcgcttcacttaagggcgccacaggtgaaactggtgccaagggtgataaaggtgataccggtgcaaatggtctttcggccttccaagtatggctacagaacggtggctctgatcaaaataatgacggaaccgttgatgaaaccgactttgaaattgcaattaccggtgcgaagggcgctgacggtaagtcagcttatgaagtatggctgaacaacggcggctccgatgtgaacggtgacggcacaatcgatgttaatgatttcctattttcgcttaaaggtgcgaagggtgatcaaggaaatgatggaacatctgccttcgatatttgggttgcaactggcaacagtaaagacttgaatggcgatgacacaattgatgagtctgacttcattctttcattgaagggcgcaactggtgccaaaggtgataccggtgaacaaggcgaaaaaggtgataccggggcaactggtgccgatggaaaatcggcccttgatatctggattgaaaatggtggttcggatggcaataacgatggtacgatcgacatcaacgactaccttgactcattgaaaggtgcaactggtgctcaaggcgactcggcttaccttgtttggttgaagaacggtggatcggatcaaaataacgatggaaccattgatgaaaccgacttcgaaattgcgattactggtgccaagggtgctgatggtacatcagcatacgatgtttggttcaataatggtggtactgatgtgaatggcgacggcacgattgatatcaatgactttcttgcttcactcaagggtgctaccggagccaagggtgataaaggagataccggcgcgaatggcctctcagcctttcaagtatggctccaaaatggtggttcagacttgaataacgatgggacaaccgacgaaacggactttgagatttcaatcactggtgctaagggtgctgatggaaaatcagcctttgatgtctggctccaaaatggtggttcagatgtgaatggcgacggcacaattgacatcaatgactttatcgcttcgatcaaaggtgctaagggtgataccggggcacaaggtgccgacggaacctcagccttcgacatttgggttgcaactggtaacagtaaagatctgaatggtgatgacacaattgatgaatctgactttatcttgtcactcaagggtgataaaggtgataccggtgcaatgggttccttttcagccttccaagtctgggtccaaaatggcggttcagctgaacaacgacggaaccatagatgaaaccgactttgaaatctcaatatacggtgcgaagggtgtgatggaaaatcagcctttgatatctgggtccaaaatggtggttcagtggaaggcgacggcaaattgacatcaatgactttatcgcttcgatcaaggtgcgaagggtgataccggggcacaaggtgccgacggaacctcagctttcgacatttgggttgcaactggtaacagtaaagatctgaatggtgatgacacaattgatgaatctgactttatcttgtcactcaagggtgataaaggtgataccggtgcaaatggtctttcagccttccaagtctgggtccaaaatggcggttcagacttgaacaacgacggaaccatagatgaaaccgactttgaaatctcaattaccggtgcgaagggtgctgatggaaaatcagcctttgatatctgggtccaaaatggtggttcagatgtgaatggcgacggcacaattgacatcaatgactttatcgcttcgatcaaaggtgcgaagggtgataccggggcacaaggtgccgacggaacctcagctttcgacatttgggttgcaactggtaacagtaaagatctgaatggtgatgacacaattgatgaatctgactttattctctcactgaagggtgctaccggcgctaaaggtgacactggtgagcagggtgaaaaaggtgacaccggggcaactggtgccaatgggaaatcagcccttgatatctggattgaaaatggtggttcggatggcaataacgatggtacgatcgacatcaacgactaccttgactcactgaagggcgctactggtgctcaaggcgactcggcttaccttgtttggttgaagaacggtggttctgatcttaacaatgatgggaccattgatgaaactgactttgaaattgcgattactggtgccaagggtgccgatggtaagtcagcatatgacatttgtattagtaatggtggttccgatgtgaacggtgatgggacaatcgatattagcgattaccttgcctcattgaagggtgccaccggtgaacaaggtgcgaagggtgataccggtgctaacggtctctcggccttccaagtatgggtacaaaacggcggttcggatcaaaataatgatggtaccgttgatgaaactgattttgaaatttcaatcactggtgcgaagggtgctgatggaaaatcagcctttgatgtctgggtagctaatggcggctccgatgtaaacggtgatggcacaattgacattaacgactttatcgcttcgatcaaaggtgcgaagggtgataccggtgaacaaggtgcgaagggtgatactggtacaactggtgccaacggtaagtcagctcttgacatctggatcgagaatggtggttcagatgaaaataatgacggtacgatcgatattaacgattatcttgattcattgaagggtgcaactggcgcccaaggtgattcagcctacctcgtttggttgaagaacggtggttctgatctcaacaacgacggtacggttaatgaaactgacttccagattgcaattaccggtgccaagggtgctgatggaaaatcagcctttgatatctgggttgccaatggtggtaaagatctcaatggcgacggcacaattgatattaatgactaccttacttcacttaagggtgccacaggcgcaactggtgccaacggtaagtcagctcttgatatctggatcgagaatggtggttcagatgaaaataatgacggtacgatcgatattaacgattaccttgattcattgaagggtgcaactggcgcccaaggtgattcagcctacctcgtttggttgaagaacggtggttctgatctcaacaacgacggtacggttaatgagactgacttccagattgcaattaccggtgccaatggtgctgatggaaaatcagcctttgatctttggattgccaatggtggcaaagatgtgaatggcgacggcacaattgatatcaatgacttcctcgcttcactcaagggtgccacaggtgaaactggtgccaagggtgataagggcgataccggtgccgatggcctttccgcttaccaagtatggctacaaaatggtggctcagacttgaacaacgacgggacaaccgacgaaaccgactttgaaatctcaatcactggtgctaagggtgccaacgggttatcagcctttgatatctggatcaagaacggcggttcagatgtgaacggcgatggtacgattgatatcaacgactttatcgcttcattgaagggcgacaaaggtgatactggtgccaaaggtaacgatggcacgtcagcctttgatctttggatcgcaactggtaacagttctgatctcaacaatgacggtacgattgatgaatccgactttatcatgtcactcaagggtgccaagggtgataagggtgataccggtgctcaaggtgaaaaaggtgacactggggcaactggtgccaacggaaaatcagcacttgatatctggatcgagaatggtggttcagatgagaataacgatggcacgattgatattaacgactaccttgactcattgaagggtgccactggtgcgcaaggtgattcggcttacctcgtttggttgaagaacggtggttcggatctgaacaacgatggcacaatcgacgaaactgatttccaaattgcgattaccggtgctaagggtgctgatggaaaatctgcctacgatgtttggtttaacaacggcggtaccgatgtgaacggtgacggcacaatcgatatcaatgattatcttgtttcgcttaagggcgacaagggtgataaaggtgatgccggtgctaatggtaagtcagcgcttgatatctggattgaaaatggtggttcagatgaaaacaatgacgggacaatcgatattaacgattaccttgactcgttgaagggcgctactggtgctcaaggcgattcagcttatctcgtttggttgaagaacggtggttcggatctcaacaacgatggcacggttaacgagaccgacttcgaaattgcgattactggtgccaagggtgccaacgggttatcagcctttgatatctggattaagaacggtggttcggatgcgaatggcgacggcacaatcgatatcaatgattatcttgcatcacttaagggcgacaagggtgataaaggtgataagggcgataccggtgccgatggcctctctgcttaccaagtatggttgcaaaatggcggttcagacttgaacaacgatggaacaacggacgagaccgactttgaaatctcgatcactggtgccaagggtgcgaatgggctatcagcctttgatatctggattaagaatggcggttcggatgtcaatggcgatggcacggttgatatcaatgactttattgcttcgttgaagggtgataaaggtgatactggtgccaagggtaatgatggtacatcagcctttgatctttggatcgcaactggtaacagttctgacttgaataatgacggcacaatcgatgaatccgacttcatccagtcactcaagggtgctaaaggtgataaaggtgacaagggcgacaaaggtgatactggtaataccggtgccaatgggcagtcagcacttgatatctggatcaacaatggtggctctgatgtgaatggtgatggcacgattgacatcaatgattaccttaattccttgaagggtgccactggtgcccaaggcgattcagcttacattgtttggttgaagaacggtggttcggatcttaacaacgacggcacaatcgacgaaaccgatttccaaattgcgattaccggtgctaagggtgccaatggcctttcagccttcgatatctggattaagaatggcggctctgacgtcaatggtgacggcacaattgatatcaacgattacctgacttcactcaagggcgacaagggtgataaaggtgacaacggcctttcagcctttgaaatttgggtagctaatggcggctcagatgttgatggtaatggcacgattgatattaatgattacctcaattccttgaagggtgccactggtgcccaaggtgattcagcttacattgtttgggttaagaacggtggttcggatctcaataatgacggcacaattgacgaaactgatttccaaattgcgattaccggtgctaagggtgctaatggtctttcagcctttgatatctggattaagaacggtggatcggatgtcaatggtgatggcacaattgatatcaacgattacctaacttcacttaagggcgctaagggtgacaagggcgataaaggtgacaatggtctttcagcctttgaagtctggctctataacggtggctcagatgtgaacggtgatggcacgattgatatcaatgactacctgacttcaatcaagggtgctactggcgctaccggtgccaatggacagaatggtcaaaatggcttaaatggtaacaatggtcaaaacgggaccaacggaactaacgggactaacgggactaacggaactaacgggaccaacgggaccaacgggactaacgggactaacggaactaacgggaccaacgggactaacggaactaacgggaccaacgggactaacggaactaacgggaccaacgggactaacggaactaacgggaccaacgggaccaacgggactaacggaactaacgggaccaacgggactaacggaactaacgggaccaacgggaccaacgggactaacggaactaacgggaccaacgggactaacgaaaccaacggaactaatgggaccaacgggactaatgggaccaacgggactaacggatctaacggaaccacagacggtaacaacacgaataccaacaccaacacgaataccaatacgaacaccaataatggtggcaacactgggactaatacaaacggtggcggtaataacaccaacacgaataccaataccaataccaataccaacaatggcggcaataccagcaccgatacaaatggtggcaatggtaataacaccacgacggataatggtaatggcggggacaccgacaataacggtacgccagaaaatggcggcaataccacaacgaacacaactggtaatgacggtgataacaacgggacaccagaaaatggtggcaacacgaacactgacattacaggtaacaatggtggtaatacgacaactaacacgacgggtgataacaatggtaagccaggtgatagcggcaatactatgacaaacaccacgggtgataataatagtaatactacgacaggtggtaatggctccaatggaacgacaactagtttcaatggtaacaatggcaatggcacagcaaacgccaatggtcaggttgtcacggttgcgacaaagacgggtaacggtaatgtgaataacaatatcaataccaacaccaacagcttcacaacgaatgacaagttaccacaaactagtgaaagtacagatggtaaggcactcatcatgctaggaattggtatgacagcagccgaagcagctcttgcttacgcatttgcgaaacgcaaacgtcaaggcaaagagaatcatagcgatttgtactaaaccatagatcccaaataggatcacatagtaacatctttttccccggagctaaccctccggggatacatataggaagcaactatttaataatggaggaatggacatgcataaattgatcagtattatcatcactgttgataacacacaagaaagtgatttgagtattccactgtcatcaattaataatcaaattgggtttgattttagccaactagaagttttagttgttgataatggggcatacaagttaagaaatgcggaattgtttagtatttttgccaacttggatttaaagtatctgaaattagatcaggtattggcaacatctaaggcgttacaatacggcatcgaccatgcaaccggtgactatgtcacgttaatgagtcctaacagtcagttaaatcagtcgagtatttttcagtcttacgttacgcaactacaagcacatcaaaccagcgatgtcctttcgggactggttatggagcaaaccattacccagcaactggaggagcaatatactgtcggtcgaaatgaccaaagtatctatgcccgctggttcaggcgtgagtttctacgtcagaatggaatcacgtttcgtgaggactttggtgactacgctcccgagtatgtatgtcgtttagccaatcaatttgctcaagaagatgtcaagattgaagaggttggctatgtaaagttctctagtcgtaacttagtgaataatgcacatcttgacggttcaggctcgatcaacggtgattggctgaagatgatgagcagctatttgctgaaattacaagaagtcgatcaacaattatacgtaaatgaattttctcagtttgtagttcgattctatacccaattgaaacaggttccgagaatgaaccgggctgaaatcatgcaatcactgaagagcttagtggggaagaatgtactggcttggggatacactcagcagtttattaataatttgcgaattcaggatcgtagtccacaggcaccatggaatgcagagtcaggcaagtttttttcatatgtaaatgaattaacgcagtatcttcaatcgtatggtttagctgttaaaccatagtggggtgaattaacacaatgaaaacgttggctataattattccgtttcacaccgctaaaaataatggactaatgcggcagctagaatccgtcaatcaacaaatgaaaatcgactttagtgaaatcaccattcagttggtcggtgatggaattcagaattggtcgctagaacaatattcatggttaaccaacttagacttacattttacgaggtacgaacagaatcaaggcgctggatatgcacggcaagttggtaatgatcaaactgaaagccactacatcatgtacttggatgatgatgacgtattgcaggatccattagcgcttagtgcattttttacagaggcagcgcggcaaaaacatgatttgattgtcgcacgctacacgcaacagtctcaatctcgtgatggttttagttatcttcagtcagagttaactgataataagtcaccagtagctaaatggtttaatcgccggtatttggatcgcattggtctaaaatggcatcccaatctacgtatttttgaagacacttattttgtcgggttggcttgtgaactaacagatgatattttccgacttaaccgtagtgtttatctgtggctgtggaatgcagagtcaacggttcgaaaaaatgaccatgcttttgatcatcaactgcatgagtgggtacatgccaatcggctgtgtctagatatggtgcaagaaaagaaacccgctaatttacaacgtgatttctttgggtatatgggtgaactttattttcacgaaactgtctacaaaccggtaaattgggatgcttatgatgctgaacaaaagcatttactgacgaaatacagacgattatggggcaatgaaaatagtcatagtgtcgtgacgacggtagctaaactattatgtcaggcaggtcggttgtatgagggtatgtcattagataacttgccgaaatttatgcaacatcaagatgcattgttgtatcaagcatttgaggaagcgcaggggcgataagagatgagattaacaattattattccgtttgcgaatgaaacgcaggcacagattactcagctgctgacgagtattgacacacaggtgggggtgtcatttgaccaacttcaagtaatcatcgttaacgatagtggtaattcatggccgtaccagtaccctaatttaacgcaatatcaacccaaaatcctaaaaactagtggcggtatgggggccggagttgcacgtcaatatggaatggaccacagtcaaagtgactttgtgatgtttatggatgctgatgattgtttgagtgattcgctggcactggagcgattctggagcgtggctcagtatcatgatttaattgttggtccatttatccatgaacacttagacgaaaatggtaggatcgtttattcactatccaaaaaggtggatcacggtgcggcatatggaaagtggtataaacgatcgtatttgaaaaagattggcttacgttggtcaccagagttgaaggtttatgaggatgcttactttgtcgatctagcgttacagctgactaaggattgtgtggtgttaaatgaacccagctacatctggcgactaaatatgcagtcagttggacgacgaaacggatttgcttttgctcgtcaactcgatatttgggttcagtccaaccgtttacggcttgcatttttacgaaatcataattcggcaagttatgtacatgatttttatagcgtcgttgcacgagcatattttaaagaatttcagtatggcattgcggatgttactgcatatcatcgagaacagcagcgtttacttcaggataaccgaacactgtgggatgacggtacgccagaactactgcgtcaaattgccacgctatatcatcaaaaatattttaaaaatatttcccttgataaattcaatcaatatttggatggtcaggcacagttgctagatagaaaggatgaatccgcatgactaagttagtgtcgatcattgtaccgtttcgagatgaggatgaacggcaattagagatgatcctatcaaacattaataatcaaattggcatcgatttctcacgaattgaagtggttcttgtcagtgatggcggaatggagctagatgaaagtgggctgaatgatgcctttgaaaatttgaatattcgcttttattattatgctgaaagcaagggcttaagcatggcgcgcagtgtcggaatggatctagcagttggacaatatgtgatgtttatggatccgagtgatcagttatattttgttggtgccttgttagaatttttcaatgctatcaaatatcacggagatcatcaaattattggtggtaagtatttagaacagcttaaatttaaggacgagtttcgctatattacacacgaaaatgatgataatgaagccgtgatggggaagtggtttaatgttgagtacttggaaaatttggggttagattggttggaaaaactatccgcatttgaggacgcctattttgtacggacagcatgtgaattggcggatgatcgttattcaattgatagcttgatatacatgcaactttggtccggtcaaatgttaggacaacaaaataacagcatgctagaccaatgggcgtatgcacagcggcatgttctcgaaaaaattgccgcgtataaaccacagaatttaatagatgacttaaaacagtatatgtcagacctatatttgaggatgcaactttttccggcccaagataaggcgcagttcgaggtgcaacagcaaaagttgctgaaagaatttgagaatcaatggacgttagtgaagccaaaattaggggagaccgttgaggagatcatgaaacagagcttgttgtatcgggggatgggacatagcggactggatagttttatcgaaaaccaagaacagcttttatcggccgcaatgtattagaacgaattgtgtgacagtaaattatttaatggacagtggatgtcgatcattgatcaaggcaattaacagtatatgaagcgaggtgatgagatgactgatcgggaacagatgctccatattcgacacgaacagcagaagctacattattccatcaaaaagctgaggggccgattattggcgcaagaagcgaatttgatcctccaacacagttcggttgatcaaaagcacgccattggaacggatgaacagtgtctggtatgttgtgaatacaatgcggtaaaaaggcaatctgaacgattatcagtgttagatgggtcaaagcgacaaacggggttaaaacgattacgcagaggattttattatctcggcagtattgataatcgatatctggcaattatcgtctcaccctcaaaaacagatgcagaaatatgtttcaaagatttaaaagttcaaattcagcatcagcatgcagaacttaaacgactaacatcagcggaaactcaaatcttaatgcaacagcaaatcggtctacggagatgggagcaggcccgtcgacagtatcgtgatgtggaccacacagaagtgatagtaacgttcgaaaaaaatagcggtaatgaggattagtgaatggtgggggaaacaatggagcagggtgtggaaaagaagcggaagacaactctggtcgacctgacgagacgacggtttggtaaattaattgtggttgcgttagtaccagaaagaaaccctagaaatgggaacacacggtggttatgtcagtgtgactgtggcaatcaagtggtcgtagatgcacagaatctgaaacgtggtacgacacgtagttgcggctgcctacgacgtgaggtgagtcgacagaaaatgttaacggatacgaaattggctggcagtcgtgccgtggaaaattttgttaatgaagagggcattcaatattcacacttgcataaatctaaaaagaacaaaacaggtgtcattggggtctcgtttgataagtcgaataatatgtatgttgcacgattgatgcttcatcatgagtacgtattgaatagggcggtggaaacctttgaagaagcggttaagctacgcaagcaagcagagcagcgatacttgcattctggatgccggtcggttaaaccgattggaaatcttacaagttcatcaaagtgacactagtgcactgatgacgcaaatcattatggaccatcatgatgttaaatggcataccattgcgtcacaccctgaaaattgtgatctttgtgacctctatataacggcccagcaaattatgcggatcattcagcaacaaatcgatgatgaaaatacaacgaaaaagcaacatttttcactgacttctttgaagtccgcgcactactattatgcgcaagaagaggacggcgacattcagatttatcgatcggcgagtttgactaagactaggcagctatttcggttgtataacggcaatgatcgtatgcacggtatgcctagacgaattaatcggtgtctcgtagaaatcattattaaatatataatggatgattcggatcaagcgtctcgactggtccaatcattaaccaatgatcacgtcttctcgggattggtgattcagtttgaaaataggcaactcttacgtgtggcggaggctttggggcaatataagattcatgatcggataatgagcgattaaattatgatactggagacgaataaaatgaaaaagaagttcacgacaacgcttgatgcaaaattagtgaaggaattaaaaattaaagccgcacagaaggatacaacgggtgccgccattattacgcacctgctacagttctactttaacgatgaatttgaggagttcaacgaaaaaattgaacataaaatctgaattattggagggaggaatttttcgataatgcagaggatagatttaacgggtaaaaggtttggccgactggtagtgattaaaccagcggatcattcgagtccaaacggtaatttaatttggttgtgccgatgtgactgtggtaattatattgaggtagacgggcagcgacttagaagaggtgaaacacgcagttgcggttgcttaagacgtgatcaaagtcgacaagtgtcccaaataaatgaacaattccagaaaaatgttggtaatgcgactcatttttttaattctgacggaataccgtttgcgagtcttaaacgctcaaaacggaatacaagtggtcatgtcggtgtttcatatgataaaaagacgaatcgatgggtatcgcggctcatgtatgacggccattatgtgttacttaaaacctttgaaacatttgatgaggcggtagaagcacgcaaaaatgccgaagatcgatacctgaaaaataaacctcagtcagctgatacatccgcgagtagtcccgacaacgacagtaatcattaaatctaaaatgagataaatacaatttaagctatcttgggtagggctgaaaactagtttaaattgttattttatccacatatatgacatgccgttaatcaatatcatagtaccgatattttagtcgtacatattcgaacgaagttattcccaagccaaccggactcctgtaaaattaacgggtatagatgcctatgagaactattgccggtgttaatttatttaaatatagcacggataattattggcacactaaatttgggaggaactattttggcaatacttaagggatttgatgcggtgttaattaccggtatcgtactggctgtactgggcgtgctagtgggagttggttattgggggattagttttgtgagtaaacgtccaagaaaacgggcggttaaagtcttagtcgtgagtttagcgacggttggcatttgttttacccttgatgtcgtggtcaatatagcgatggatgtccgtgcggaacaaattaaagtgcaacatcaaaagcaagcattcggtgaagcaaaggctgcgtttaagatggaatatttattgcttggtggttctttagaacaagccggtgataagcagattgaatattggatgaatcaaatcaataatcatggagcttcggatcaggcgaatgacatgcgcgataacatattagtggctagtaagtcgaaattagaatccgtggacatgtatgagactagcgtcaagcacgattaccggaagttaaagaagaaccagacgaataaagcgcagatcaaaaagtaccgaaaggcgtatcaaaccgtcatgaaacaaattaagctggtcaagcaccctgttggggattacgattcgtttcaggataagtttaatcaggatgatacccaaaccggacaggcatttgaaacagtaaagtaaccataatcggaaaatcaatgatgtcgtaaaagtgaggactggttggaatcagccagtcctttttttacaacaaaaaggagatcgtcaattattaggtggtctactaaaagccgtgcgttgttcaatttcttcctattcttgctttttttttcacgaggagtatccagccttgaattgtcagagttctaatctaagaaaaggatgggtattaaatagactgcagtaaattcaaatctaactcgatatgattttatgtgtgaacaaaagataagcgtaaaaaacacgaactgaaattctagtaaatatcagaatttcagttcgtgttttacttgtaaaagtgggcttaacccactgcagcgataatattattaacgagatgagcaaaaataccaaagcgaatgtttttggtgatcaggtaaataagtcccagaacaattccagaaatcacgtaacctaatgttgcccatgaaacacttgtgctgtgtagtaaaccaaataccaaagaacttcctaatagccccaatacttgagcgtaccaagcattggatttaataaagtatgagaagaaaagtccacgatttagtaattcttcgtaaatagggcctaaaatactgaccacaatgagcattgggactgggtacaacgatagtagaccgaccgttgcgttttcatcacctgatgattcgccaggccaattaaattgtaatacgatccagctaattgtaattattgcggtgaaaatccatttccatggtttttccttaaaaatacttctgaacataaagtgctgtgggttattagaatttaaggtggaacgatagtgtttgtaaagaaaagcgattgtaattagaccaattgctgaacagaggattgtgagtgtgatttgagcaaaggtgccatggccgaattttaaaaagtaaaaaagaaatacaggtaataccatcaggttgtgaacaaatagccataaaacaaatttaacgcaattgatcattatattttttaaataagtcatcatattgctccttagtttattttagtttcttctacaatatttttctaataactatattatacaccgtatagtattagacgcacacttaattttaaaaaataatagataaataaattatttattatgtggtagtcgaatacttgaaatatacatagatatcggttagaagatgttggttaatcaccaacaatctacatttttaaaccgccataaaatttgattggattttatatttaatgcataaaagatgctttttttaattgtttgtggaaaagcgatagatgatatcacggaagcaataaaaaagctcaatctacaaaagggtaggttgaacttgtaactagtatctaaattaatagttaagatttgttctagcaatgaaagcactgaactgtaaaatatcattttgtgacatatgaccgattaccgatgttagttttgattttggaatccaaactgaaccggagtaggtgtcaatatacgatggtttattcagtccggttttttatcgtacttactggttattttatacaccaaaaccttttcacccatcgcctgaataatgtataagggacgcactttacctgtattaacatcagtaaaggtcatgaagtgggtgataatgtcattagtcttcattcatccaattctcaatttccttaggatccgtcaatgtttttgggttctgggccattgcaaattgaaaaacattttgatttgcttgctcaaccaagtatgattttaggtccataaattcttgatattcagactttggcacgattacaagaccttgattggcgccatctttagttgggttattgatggtaatctcaacaggttcattgtgtttaagaataccattgaagatagatgcttggttttttatgaaattagtagtggaatatacattcattttattcacgctctctgcacgtgattgaagttgatcttgtcttatcaatcacggtctcaatttgatcatctaagaactttgcatttgtcaatcgaatatgagtatgtgcgaatggtggtagtcacgtctgcattccccaactgttttgatatgagatatagttcaatatgattagcaagtagatatgcaatatgagtgtgtctcgtttcaaaatcgaagcacccttttagagatatttttacccatatcattgtgctattttttcaccgaaatgttgcaatttcagccagtttctgacgactggtacgactgccatttttggcgcgtaaggctagtaagattgtaattaaatcaacgacttcctggaagagagcacctatcaaagcagggatcacaccggttgcggcgattgccattaggatgatcaagatcacaattccggtgatcacgtcgattttggtgattcgcatggtatcttgaccaatagcgactgcggcggctactttactaagatcgtcctttaaaatgacgacatctgctgattgactggccgcagtagccccatgttcacccatcgcaataccaacgtcagcagctgtcagacttggcgcatcgttcacaccatccccaaccatgataatcggattgtagtctgctttcaccgaccgtaaaatttggatcttatcagcgggtaataggttgccatgaatttcatcgagtggcaatgtatcaccgatctcgtgtgcaatctggctttgatctcctgtcagcattactaatcgttgcaagcctagctgcttgagctcagtcagggtggcgggtgtttccggtcttagttgatccaaaaatgtaatccagccggcaaactgatcattaatactcacatagacggcggtccgactaagcgacttgattggttgatctgtgacatatttgagcttgccgacgcgaatcattttgcctgccacttgaccttcgactccctgagctgtgacttccttgaggttggtaacgggctgtaagacatcggaaccaaggtaactcaccagtgatcgggctaaaatatgtccggagtgttgttccgcactcgctgccagtaggagtagttgttcttgattccaaggggcctctgcgtgaattatgtcaacttctagtcggccacgagttaatgttccagttttatcaaatgcagcagattgagcttgtgccagtttttcgatcgttgtgccagttttgacgatgatcccatttttactggtgcgactcatccccgcgaccagtgcaattggggccgcgagaatcaacggacatggcgaggcaaccaccaatacctcggcaattcgtactgggtcaccggagatgagccatgctccgattgcaatgatgatcgcaattgcagtgaacggtacggcataacgatcagccatacggacgaagtgtgccggttgcgtttccgatgatttaaccaattcaatgattgcctgatactcactgtcggcggcctttttttctgcgatgatcgtgactgttgcatcaccattcaccgaccctgacataaccggggcgcccacgttctttgatatggggtgtgattctccggtgagggaagattcgtcaaatgtggattgaccggcaattagtttaccatccactggtacaagttcaccaggtttgatgatcagatgatcgttcactgcaacatcatctacatgaatgtccaccagttgatcaccgctaatccggtgcgcaaactgaggcgagttgtcgaggagagattttagttcttgtccggctttcttagtggcgtagtcttccagcgagtcaccacctgtgagcatgatcaaaacgaccagactagcccagtattcaccgacaagcagggtggcaccgatcgcgaggattgccaatagatcgatgccgtattttcctgatttgagtgttttgatcatgtcgacaaacatcgacagtgccaccaacgaactggcaatcgttacgagccaccggccgtaggtttccaagtgaaagacgaatgttaacaataatgcgatcgctgcaatgagtaaggttaacagtagttttattctgtttttcatggtagcacctcctgtgtcttctttataatcattctaacatagcaagtgagacgcacctattgatacagggataacaatgagacaattctcattagtctgttccggtgataacggcgtctgttgtcaattaaatcattctttgatatactattgccacttcacagggggtgatcaaatgatacgtaatgtatcttccaatgattcgggtaatgtctgttagccgaatcattagtcaggcgtttcctttctaatgattcacgtttgaaagtgaaaggaatgctttatgaaattagaactacaaccttaccaatacatgcaaattcgtgaaattatcgccgacttgatccatagttatcagtcagtgagcgatgttcggacaattcagaccatccgcgcgattgcggtcgagaaaataaatcagaccatcaccggcgattacccggagattgatgtgctgattaagtacgccttgaatgatcacttacggcacgggacagctgataagttgtttgcaaatctcaaatccgatgtgatcccgtttactcaaccatccaaaaagcaggttggaaaggtttttcataaaataaaaaaattaaaagttcctgattttgagaccatcgatctacgtgagtgtacgtttgtcgggtggaacgacctcggtactcgtcgtaagttcatgctgtactacgaggatgatcagctacgtgggatatcgggtgatatttctagcgccgttgtcaaaggtttttgtgctatttgccaccatgaatccaacgtggccctgtttaccgtaatcacgaaacggggcagtgagggtcagtacactaagaagggaaactatatctgtactgatagcatgcgctgtaatcagcagttatgttcgcggacagaattagatgactttttggacactataaattaggcaagaaaacaggtttcctaggtgcgatgaagtgacttttaatgcagttcagtactagtattagaagtaggtatcgtaaccaatttatataaaaattaacagaaaataggcatcacataaagtccgaaagttgaccttatgtgatgcctatctgttttatttatcagttattgtccattgattttactcgtaatgatggtacttcagtccaatgttcaatcagattcattaaatttggcaaaccatcagagagatctgcatctccagtcaagaagccatccgcatgtgcaaaaactttactgattaatgcttgagcttgtttagtttcgggacgttgcgcggcacttttcagtgattccatgtatgcctgataatcgtaagaagagtcgataaacatccagtattcttcttcagagttttcgggaacgtctctagtatagtaactagtagagctatattggtagaggtcagggtgagcctcttcgaaatctaatacagctcggaagccgcgttcgatggcatcgtgatctgccttttttgctttgaatccagaaattcctagttgttcagttttcatttaaatcaaatcctttcaatatttggtgagttatcactcacttaataatgagagtatagcatccaagaaatgaaatgaacacgacacttatcggtaaattgttggggaactgatttattgtcgatattttcgctctcaatgaaaaactggtttagtttaccatctcgtatgaaagcgatttgataatttttagtgtgattgcagcaaaatcgtctgacgattctcggaaatttcgttgcacccattcatcaatcatgcttccaataattccacttaccacggctagtgcgtacgattctggtacatttaagtgtttaataatatgattattatcccagctttgccgaatagtcgtagttagttcgttagcaaacgctagatcacccttaactgggtctaggagtagtgaaagcagttgaccgttagcttgtaagtaggtaaaaattggactagtttgcttaactagttcagataaattagtttctgggtcattgtgtaggaaaatttttcccggtaaagtacgcgaaatttgtagtaaaccgtctagtagtttggtttcaagttcctgaagcagatcggctttgtctagatagtgggcgtaaaatgttgtgcgattaattttggcagtgtttatgagccgtgtgactgttattttactgtatccgccagtggacatcagttgaataaaagctttgcgtagtatttcttctgtatgtttaaatcgtggatcgttacccatcgtggtcctccttgaatatatgtttatgatattaagtaaaattcattaaaaattaagtaaatatcatgcagtttttacgaaaaattttgacaagataattgtaaacgcttacgataaaaatcgaaatattgtgaatattgcactctgcaatcgagaataaacgtgtttaataacggggaaagtgtgtatcggttattatggttagttggcacgtttgatagtgatgttttctagttattgaatattttacaatgttactatgatgcttgcatggttattgtctatcaacttatatgaaggagattatgaatatggcaattagaattgaaaaccaaaaccttctttttcatcttcaaacagatcacacaagttacatattccatgtaatggaaaatggggaattgggacaactttattacggtaagaagcttcactttaaaacaaagtatgataatttggaaaccaaaatgcaacataatgccgcaccagcttggagtcttgagacaccagacctacaacctcaagttcttaagcaggaatatgctagtttgggaaagggagattttcgttatccggcttataaagtatcccagccagatggtagtcggataactgagtttgcctacgaagatcatcagcttttggacggtaagcgtcgactgagtgggcaaccgtctactttcgatgataaccaggatgatgctcaaacattgattgttacacttagggatcacctactaaatttagttctccatttatattatacggtttttccgcatcaggatgtcattgttcgaagtgcaaagtttgaaaatcagggtgataacaaactcagactggaagaagcaactagtgcacagcttgacttgcccgattcagattatgattttattcaattttctggtgcttgggcccgtgaacgtcacatggtaagaactcatcttagatctggaattcaaagtattagtagccttcggggaacgtcgagccaccaacagaatccatacgtgatgttggcacgaccggagacggacgatttagctggtgaagtatttggattcaaccttgtttactcaggaaatttcttggatcaagttcaagtcgatcagtatgatgctagtcgagtattagttggcattaatcctgaggaatttgcatggaatcttaaaccaggtgaaaagtttcagacaccagaggctattttgagtttcacagatgaaggtatgaatcagcttagtcagcaaatgggtgaattttaccaataccatttagtcaatcaaaaatttgcacatgctgaacggccgacactaattaacaattgggaagccacatattttgattttgatgaagcaaaattatacgagtttgctaagacggcccaaaagctaggattagagatgtttgtgctagatgatggatggtttggtcatcggaacaatgatgatagttcattgggcgattgggttgttaatcagcctaaattcccaagcggctttgcaacatttgcaaataagatacatgggttgggccttaaattcggtctgtggtttgaaccagaaatgatttctattgatagtgatctttataagcaacatcctgaatggatgattaacgccccaggtcgacgaccttctccggagcgatatcagtttattttggatatgaccagacgagatgttgtcgattttttgttcgattcaatgagtaaaattattgatatgacaaaactagactatattaaatgggatatgaaccgaaacatgactgaaacgttcagtagtcaacttaccgaggatgagcaactggaaatgccacatcgttacattttgggtgtttatcagctttatgaccgattagtgaaggcttatcctaacgtgctctttgaatcatgctcatcgggtggtggtcgattcgatcttggcatgatgtattatgccccacaggcttgggtcagtgatgacacggatgcagttgagagaatgttcattcaatttggtacatcgtacggctatccattatcaatgatgggtgctcacgtatctgctgttcctaatgatcaggttggacgaattacacctctagagaccagagctgaagttgcttattttggtgactttggatacgagctagatatcactaaattatcggaagaagaaaaaacacagataaaaaaacaaattacgttttacaaagaacatagaaaattgttccaatttggtagattttacagactcgatagtccgttcgaaaatgacggtaatgtagttagttgggaggttgttagtgatgataaaaaacacgctattgctgcccgctatcagatattgaagcggcccaatattgggtattttagattatttatgcaaggcttagatcctgaaactagatatacggttaacggtagtttagaagaattttatggggatgagctgatgaatgccggattgattatcaaggacactatgtgcggagtaggtcagtcaacggattttagttccaaactatttgtaattgacgcaattaaatgagcacagtgagtattatatgagagtggcgattataataactcaaaactagtgtgttagctatttgaagtaaatggcgaagaaagaaaataataggatttttttaactgataatttaaagaaaataaaaaaccattaaccagaaacggctaatggttgaaatgttcaaacggttatacaaaaataattcagcgtcctagatcatctactcgcaaagtcggaacttccgtccagtgatcgattacattacctataaatccttcatgaagatcaactactcgggccatgagttgttgaccttctttgttttctggtccgtgagaggctttgtaaagtgagttaatgtaatcctcgtagtcatcgaacttatctacaaacatccagtattctttttctggattattttcatctggcatagtgtaggtacgtgttgaagaatagtgatagatttctggatgtgcacattcatagtcgtagaattcacgcatgttacgcacgatggcctcgtgatcagtcttttttgctcgaaatcggccaataccaagattttcaatttccataaaaattcgtcctttcaacttgatttaataaatgtgattatttgattttcggatcgccaacgatttcaccgcatccttggccggtgactttctgtccgttatacgtaccttctacatgagtgacactttcgatccgatgaaaacctacgaacgtttcctgtccttgaaaatcaaccgtgactttaagattagcatttgcactaggaattttgacattccatccagaaggccactttattccactgcgttcgctcttccaaattccaaacagattttctgaaattggttcaacgtccgcaatcgtgtggctaccgtcagtgtgaagaacgtccgcccagctacgttcgcgtttgccggttgcgctccagacggcaactacttctccgttagatagtctcatcgaaatccacatccagcgcgtttcaccggatgcaagggtttcagcatgtgctactgggaaccattgccgatcaaaccatccgttaccggttacagggtagttagttccatcagcggtaatcgttccggtaatgtccattgttgggaatccatattcataggttgtgagttgattgtcaatgagtggaaagcaaccagtaccgttatatgccataactggaccctgacgttgcagtgttagatcgaactgtgcagttcctgattctactgtgccccgggtatgcatggttgatgcgctggcagaccatagaaggttatcactggaaactttgaatccttcacctgcgtcttcgtattttgccagtttagcttcatcaagaatatagttgctgttcgcgacatcagcaatagcaatagtacttgttccatcggcagcgggttttttaatgtagtgtacgagaacaccgaattctcgatcagcggcgtgaagattgcagcagatgaaccatgaatcacccatcatcccaatttgcggttttagatctgcaactgggtcgataaacattggtcgatttgggcgctgcatgctgtctggcttggtgtttggcattgaaatatttgattccattgttaattcctcctagatataaaacttgcttggcagtctattgtaatgcaacacatgttgtattattatactaatctgatggattcaagaaaaaaaccatcaattctgctaaattgttggaggaaatgatatggctaggcccaaaaaagatgaaaattcaaatccaattcgtagccgtatagaaacagagttttggaagttgatgaaaaagaagtcgctgtcacaaattactgtgagtgaacttgtgaaaaacactaactgtaatcggacaacgttttattattattttgataacgtcgatgatcttgcatggaaggtcattgctgaaagtattccggtagaattaccgaaaattgcacaggcatacttcactggcgaagttgaagatgtcactataaattctaaaacaatgcagatgattgaaaaattgagcgcattaatagggcgagatggctcatcccgtctagcttatctagcagcagacgctttgaaaaagatgtggatagcgaaacttttaccagatgaaagtgaatatgatgaggaaatttcacacatgtttgattttacggccagcgggattattggcataatcagcagatatggtcgaaactcagatattattcaactaaaagaaagtttgttactaatcagtacacttttttcgaaaacagcattagaatttatttcgtcgaaacaagtaaattagaatttggtgcataaattcaataccttgatcttccattattaggagcgcaagtgcactgctatttttatcaataatagttgaaattggtatttttttagactaactaatgtatttataacagtactaagataaaacagactggtgattaatatggctaaaaaataggaatcctgttaaatcagcgtttgtgatattttttcattaaccgggttagaaaagactaagattcttcagaagaataaactaagcatctacctttaatcgggtagatgctcttttatttgctattagtttggctgcatagaaaatgtgtactggtttccgtcttcatcagagttggtgtaatttccaaatgaaacattgccattggttatggtgtatggaaaagttttattggcaattgttaggtttgtatttgtcagtgtatagctttctgttgatacactggttgacatcgcataccgaactgatgcggtattagatccagtgaattttactactgcgaaattatcatgaacagcattttgaggtgcattaccatcatccattgccgaatcgatatcttcgccattaaaaagagtaggggtaattgtatacgatttatttaacaagtatttttgtgcctgctgttcattactcataatgctacttgatgatgactggcttgatacggatgagttgcttttctgattagtcgtgtattgctcttgtatggacgagctagtactatcagagatggagctactagtcgtctcagatgcagtctgttcttcttgactattacgagcgttgctatggtgaacgtatagtgatgcaataataccaaaaacaatgactaaaactacggtgatgatgcttttaataaatattgaccgccaatgtaatctgcgaacttcataaaactcttcttgccattcgggatcatttcgccgctctttaaaaaacttgtatgagtgtttggcacgagtatgctcagacatatatttttttgccaattttaactcctcctaccgagctgttatcttctttttctattatatataagcatatgggttctaagctagacgttggtcataattactagtgtaattcgattaggtcaggttaatcatggttcgctaacaattatgttacgggctttggctagtttataatagggcaatttttttgagtgtactcggtatggtgcgttttaaaattactttttttagaagtaaacatctaaaaaaagtaatattggcttagtccactttaacgtatttggtacactccaagtacatcattctgctagccaaattcacgaacccattgactcccaattcaacctcctgaataatcaaaagcatgggaggacacgattatgaagagggtaactcgttttatgaagcgtcactggggatggttgattcttggaagtatcggaattatggtgataattgggacaacgtttttcattacgacgcgaggctcattagagcacgtccacttgaaatacagtggttatagcggtgttggtaaggtgaccgtcagtgatcgagcggtgagtgcagttcgaaaacagcttgtcaaaaaagttgccacacagcgacatgaacagacaaaggtcaggcagaccgtgggtcggtccgccagctggcaggaaatatatctgtacagccgtctttccagcactttcgatcaagaagagctcaacgaaaagaacattttaatgaaatatcctattgaaattcgaccggccaccggtttaaagaatggcgataagataaaattacggctggcactcacagctgccgatgcccggaaatatcatctcagtaacccgaccatcacgcggactgtccatggtttgaaaaaaccgaaacagacagtgacagctgccaatctaaaacagcagttgaaagtgagcttcactgggtttgaagggcatggagtagtcatggtcagctccaaaagatacggtgataaaatgcagttcacactaccgcaaaatggacatttaaagaatgggcaaataattaagctaaggttagaagatgactatcgcctgaatcaaatgacccacggtatagccttcaaaggaactaacacctaccgggtccacggactccaggcgcaaggtacgattgccaatctgaaaggcgttcaatccttttgcgatagctatgccgagtatgatcgtcagtttaatgaagccacatgggtcaagaaacaacgtttagcaatttatctcatgccattcacgttagatcaggaagatgatttatttattgatggcggtataaatgaacgcgcggaaacggtttacgtgactcaacctaaaaaagcccttttggcaccatcgagcgctttaacagttctcggtttataccgcgttacggaaccaaacggtaaaactagtttaagagcatttgctcgcaaggaaatggtactggaaaagggcggtgtcatccaaatgcgtttgagtaagggaaactttagcgaagaagtctatgatttttcggattattcgcaggatcaagttcagaacgccttagctaaatacggtcagcaaatcaactaaaccacttattaaaaggataccgacatggatagaattaaattcgaaattatcagaacagtagaaaaattatcgattaatttaaatcatcagcacgattatcgggagtacgaggtggtcattcaaatcaacgaagataatgcatatgaagtctttgcgactgacgagcgcgcgagtgtttacggtgctacagatattttcgaatcaaaagcggctgctttcgagaatgcaattgatcgggcacggtcaatgaagaaggttcaccaataaggacggtgctgctttggatgattatttagctcaatatgatatggctgataagcaacgtgagcaattatcgattagcattaaaaagcggagtgcccatatggtctccgcttaaagttactatttatctttgttgctgagtttgtctttcagaccgtcagaagcaccttttaaagtgtcttttgcatcgcttagtttttctttggccttgcccagcgtactttgagatttaccttcggcttcgagttctttgtctccggtaacttttccacctgcttctttagctttacccgcaagttgttcttttttactttcgaatttttcgtcttgagtcatagttaaatctcctttcttatctatgaaataatcttaacaaataaggttcagattaatcaaataataagagtagataaaggacaaaggcgtgatggtgtgcaatagtaaacgaaaaatttctggtgactaaaaagtaacagacaacttctaactatgatggcggaatgatgttcaccttacaacaagacacaaactaaagtcgctgaaagttgggagactgatgggtagcttcaactattgagcctgtttaccaatttaaacttgatgggtgtttttaattagttttatagttttgggaggtctttgaagccaaagtcttcgacggggtcttgaatttttttaacgagttcactgatttttttagcgggtttccctaatggatttagatggagtggggatccgttattatttttaccaaaaatcctgatatctgcatgttgattcttaaataaggtaatgattcgctgatattcatcaatgagtttaggattcttcaaattaccagaaaaggccacgacgtcggggctattaaagcccttggtgtaatcgacaatttgggagtagttattcattaatatgaggtccagtgcttgtgaatccattgtttcaatgacttcattcattaccgtactcttggttgctcggattggtaatatgttaaacatatagagtgtgtcatagtcacgtttaaaagtatttaagaaccgagatacagttgtgtctccatgctttgagttggcataggaacaattcattcctaaaccgaataaaattttccgtttaccacttggattgcttgcaattgatgatgtggtgaatggtgcaatgtaacgtacataaagttcaaaatcaggaatcgttgcgtcaatcttattcagtttcaagggtacccgaatgttttctgaataggaggaattatattgctgctgatacagttgttggtcaattaatgtactgtattcataatcggttttgatatgtttacgggttggtataatcgtacgatcgtgcaataacatggtttgggtagcagcctttgtcatttgtgtcacttcctttaactggtaatgggggtcttcagatgaagcacatttgaagcacatttttcgtgattcattgttcgtaacaacgttattacgttttcatcgaaagcttaaagcagtcgtagtttacttatttttactagttctagtgttaattttattttcatgatctggtttcttgctgttcgttcaaatcccagaacttatcaatggttggtgcgagttcatcaagtgagtgcaacgaacgatagtattgccaatgtgcaggaaagtagcgtcggtagcgtggcgaatcaaagcgctgatccatcaataaaatgacgcccttatccgtcatggtacgtactaatcgaccagcagcctgcaacacatggttgaggccgggaagctgataagcaaactcgaaacctggttcgccttgactatcaaagtagtcgcggagaaggtcgttgtcggtacttaacccggggagtccaacgccgacaatgccaacgccaattagacgatccgccgtgaggtcaataccttcagaaaaaataccaccaagaattgcaaaaccaaccaaagattgatctggattgtcttcaaatgctgcaagaaatgcagtccggtcggcttcagtcatactggatttttgaattaccgttgcaatttccggataggctgtttgaaagatcaaacttactttttccaaaaaattgtaggaaggcaaaaaaatgaggtaattaccggttttgctggatactaacgtttttatgctggtaacaatttttgatagattcacgtctcgggtgcgataggtagtactaatgtaatcggtaattaaaatactttgatttttgggagggaagggtgatggaagctgataggttaagctttcttcgtttccgcccagcacacgttgatagtaatctaatggagaaaaggttgccgaaaataacacagcaccgcgccccttgtccaaacagtcgtgcaagaaaatactaggatctaggcacaattgtttgaaggtgatttggtagtctgggttatcgcccagcgttatttttgttcggtaagtgtcatcgtaatagtctgaaatctttaagtagcttaagcagttgaaatagtaatccaatacggccttggtgaagggatcctgttcacgtttttcgtcccccaaccagtcactaatagtttcggttaggtgagtgaccgccttattaaagccttcagcaggggcagccgaaacactttctattttattactactcataaggggcccagcaaactcgaaaaatgctttacgaaggtcccgtaggtcttgaagtaggcggcgattaccagcacccttgccgtgtgcgtcggcaattaagtcggtcagcggggctaagctcagttctgccgagtacatatcacgcgcccgactaaccaagttgtgggcttcatcaaccaagaaaaaattatcgtcatcatggtcaactgcgaaaaagcgctgcagataaacttgtggatcaaataggtagttataatcacaaatgatgacatcgcatagcaggcttaaatctaatgaaaattcaaatggatctagcatatgtttgcgtgcgtacgtttcaattacttcacgggtaattgcgaattcgttgttgagaacatctttgattgctggtttgagtcgatcgtaatagccgatcatgtaaggattttcttccgggctcaggtcccgttcctcaggaaatgtgattgtgtccttagctgtaagcgtaatgttatgaattttaagcccttgcgcacgcatcatggtgagtgcttgttccgcaactcgtcgggtactttgcttcgccgtgagataaaagagtcgttgaatctgatcttcacccatggcttttactgctggaaagacggttgaaatagtcttgcccgtaccagtgggagcttcaatgaacaattgttttttcaatcgaagggctttgtagaccgaaactgccagttcgcgttgaccggtacgatagtgatcaaatgggaatgtaaggctcgcaatagattcatttcgattaagccgtaaatctgcttgaagttgcagccagctttcatattcggccagtacctcataaaagaatttttcggattccttgtacgtgtaggtaatttggcgggtggtaattttctcggtagggcgttgaaagtaggtaagttgtaacgtcagtttgtggcagttttcttgagtcatcaaaatataggcgtacattttagcctgtccccagtatagagtaagcgtgtttttgccgagttcatcaaatgccgcatcagaagttttaatttcctcaattagtgtctggtctccatcaatgacaaccccgtctgcacgaccgtggacgagatagggagtgtctactaatgaaacttcaaagttcaatgcgtactctttttgatagttttctgatcgctgtttttgtaacatccgatggattcgagcgccttcaagggctgtattcttactgttcatactggtgtttaagtcaccagtttttagggtgaattcaatcagttcgcgaatccccagctttgtgattgacatgctgtgcttccttactttaaatagtaaaactattatatcatttttcgaacgagtgtttgtactgggcggaggagtgtttatttaaatgcttagtttcattaaggtgttgcaagtcttttactgattttccgttaatgattcaatgaaattaacgtttaacgaaactttattttttgaagaaaactttgtgtatttctagtacgtaactgaaaccgatcgtttttaatttcgttataaactataaattggataaatacttattgaagcatggtagggacgaagataaatagtgaatgggataggattatcctaatatccaaattgacaattggcttagatttgttaaataaaaattaccacttctcattaattatcgggaagaggtaaatttaaatttttttcagttttgcagttgaatcgcgtttgataatcttaaatggtaaatagggagagcgaacttgtccgtggcttgttaagtattgaacgccagcgatacccatttcatagaatgattgggtaacacttgtgatagctggtcgcatcatctctactagttcagttccatcaaagctcattacacttatatcatttgggacttgtaagccagactcagtgcaagcatttatgaaaccgattgctgtgaagtcactagcacaaatggcacatgtaatttctttactggaaagttgtttccaagcatcaattccatcttcatacgtgcaactaccatactgaatccattcgggattgacagtgagattatgatcttccatgcactgcaaataaccatgagttcgttgattgatagagccgttagtaggtataccaaccaaaccgatttttttatgtccatctttaatcattgcgtttgtggcatcgtatcccatttggtaattattagaagtgacgaaagggattgtggcatcttttactgaagttgaaagacaaatacttggaattgaggtgtctttaagaatttgtagtactttggtacctaactctaatgaaactaaaataatgcccataactgagcgttcaatgactgtattaattgctcgaatttgggatgcttcatcatggttgccggcgtgcagaatataagtatcaagattctgtgtagttgctttagattcaattgcgtcaataatttgagtactaaagtttgatttagtattggaaactatgactgcaatgatatggctttgacgatttacaagatctgcagctgaagtatttcgaacataccctaactgttgagcagtttcggtgacaagctttacggtgtcagaattatgctgtcccttgtggtgtaacacacgtgagacagttgcgaccgaaagatgtgtttcacgtgcaatatctttaattgtgattctgttgtttaggttcataagtgacatctccagaaaaaaatatgatgaatatattatcgatctagaagctatatttggtaagggattaacgatttttagtaaatattttacttatgttgttatttatattaactattgtaaacgtttacagaatgaattacaatgcagctgtaaacgtttacagtaattatattaggaggtgttccttgtggaaagctcacaagagaacttgaatgctaacgtgcagcaaaatagtgcaacaattaagcatggacataaattaccaaatattactttgacaacaatgtttgccattacctttgggtattgcggtgttaatatggctttttcgttacaaacttcgcagatgagtcgtattttccaaacgttaggtgcagatcctagcaagcttggctttttcttcattctaccaccattgataggtatggtagtacaaccgattttgggaaagttttcggatggcttttggtcaccacgttttggccgacgtatgccattattgatggttgcggcgcctttagcggcaatcgtaatgattttattgccgaatgctggatcatttggtcttggatatgcatccttagctgcgttgttgttcggtgcagtagcaattattttaatggacttatcaaataacgcctgtatgcaaccatttcgtatgatcattggtgatatggttaacgagaatcaaaaagataaagcatggtcgtggcagcaagctttcagtaatgttggtggggtgctagccaatctttgtccatttgttttaacttggataggggtagctaatgttgccaaacgtggtgtcgtaccattttcagtacgcctatcgttttatattgcggcagtgattttgcttgcaacttcaatttatacagttctgtcggttaaagaatatgatccagacacctatgcgctatatcataattttgatgtaaaagaaaagaaggcaaagaagtcatactggacgctacttaaagaggccccaagtacattttgggaagtagctgtaattcagttttttgcatactttggagttcaatatctatggacatatacaaccggagcaattgctcaaaatgtttggcatacagctaatgcgacatctgcaggttttcaatcggccggtaactggtatggaatattgacttttgttcagtcaattgttggaattgcctatggattcttggttttatcgcgaacgagtcaatataaacgtaagttttggtatcgagttggtttggcatgcggtgggttagggatgatctggactgcattcacacataatcagtacattttgatccttgcatttatattgatcggtgtatgtttcctaacaatgcatacggaaccatttgcaatttttacaactgccacggatggcgcaaatgacggtgcatatattgggttgtttaatatttttatttgcttgccgcaaattgtcgcttcaatcagtagttttgtgatctttccattggttggtaattcgatgcctgcaatgattatgataggtggtatttcatggctaattggggcagctcttatgggaattattaaagataaaaagcaaactacgaaataaagtaattataattagaggaatgaaaaagtatggaaaatgagttattaagatatacagatgataaacagaaaattacggtatttatggataatcagtctatcagtttgcaagttttaaagcctgatatcattcaggtctttcaggatcataattgtagtactaattcatacgcggttgaaaatttaaaatatatggatactaaatatgaagtaaaacagaacgaaaattcagttaatattgtaacatctcaattgagcattgatgtggacactgatctgaatgttgatgtatacgatgccaacagaaatcctttggtaattcactatacaggcaagcgggagtcaattaataaaaatattgatgctgctcatcagaaaattgtacgttcagaaggacatgaagtttctgcagtcgaccagcaggatacaaagtactatgaaattatgaatcaattaagtgaagatgagcagttttatggccttggtgataaaactggtttcttaaacaaacggggctatgaatacgataattggaactatgatgaaccgcgtccacatattgaaagttttacacatttatacaaatctattcctgttttatttggtcagaaacaagggcatccatatggattattttttgataatacttaccgaagtcatttcgatttaggtaaagaaagttcaaaatattactactattcagctgatgatggtaatttaaattattatattttaggtggaaaatcactgaaggatgttgttgccaattacatgtacctgacaggtgttacacctttacctcagcgatggatgctggggtatcagcaatcgcgctggggatatagtatgagtcagtctcgagttgaagagattgtgacaaaatttgcggagtaccatttacccctggaagcagtgcattttgatattgattatatggatggctatcgtgtttttacgtgggatcttgataagtttcagcatcctaaagaatttttgcagaagttaaatagtcatggggttagagtcattccaattctcgatccaggtgtgaagagggatgataagtaccaaatttacaaagaaggaattgaaaaaggatattttgccaagaatactgatggcagtgtttatatcaatcgtgtttggccaggacaatcagcatttccagattttggaaatccagatgtacgtgcctggtgggcaaaaaaatgtaagtttctcgttgataacggagctgctggaatatggactgatatgaatgagccagcaacattcgatggtgagatgccagataacgtggtgatgacagatgaaaatcgtccagggacagcaaaacagttgcgaaatgtttatggccataatatggccagagcaacctatgaggggttaaaaaatgctactggaaaacgaccatatgtcattacaagggctgcctattctggaacgcaaaagtatgcgactgtctggactggcgataatcagagtttgtggcatcatctgcagatggcaattccgcaattatgtaatcttggtatgagtggctttagctttgctggtactgatattggcggctttagtgccgatacgacgccagaattattaactcgctggattgaggcggctttgtttagtccgctatttcgtaaccacagtgctttacaagttcgtgatcaggaaccatgggtttttggtccaaaggttttaaatatctatcggaaatttttaaatttacgatatcaatttatcccttatctctacgattgtttttatcaagaaacacaaactggaattcctgtgatgagaccattagtgttaaattatccaaatgatgaaaccgttagaaatatgaatgatgagtacatggttggtgatcaaattctggtggcgccaatcttacagcaaggacaaacagtaagatcggtatatctacctaaaggtgaatgggtgacttatgatggaactcaacagtaccaaggaatgcaaaatattttagtagatgcgcctattgatactttaccgatttttattaaaaaaaataccatactaccggttggtgaactcacagagcacttatctgacaagccggattcagaaataactttccatctctggggtgaatttgggaaatatgctcattatcaagataatggagtggattttaagtatgaagacggtgagtataatctttaccagattcgagtgaatgatgatggtaaatgtacaattgagttacaacaccatggatttttgagccaatataaaaaaattaatgtacaaattgaaacaggattgcaaacttttgtatatgattcaaatcgagaatcttacgtagcacaataatataaaaaaatgatatccagatgctgaattcaacgtcttgatatcatttttaattattatagatttattttttgagaaaccatttttaagtgacttacagctaatggctccgtgtttttttgggaaagaagcgtttctctgcgtccattcgtgcttgtattgcttcatccatggtatcaaaagattttagtaggacatagtgatttcgaaacatcaaacgtgcaaaccatttgccggaatcttgatcgtaagacacgccaatatgaccactcttgttgcggcttgatctctttaatgagttataacagacaccatcgtcgttaagaaaagaatcggttttggacgagttttttatcaagatagcattactgtgggctctttgctgcatgacgtcacggcgcagacagccacagcttttcgtgatgccatgttgcagtctcgcaccggttacaatcacatggttaccacaattgcaacggcacagccaacgcgcatttccatttttatcgctgggttctgctttgataacaagcaaacggccaaatttatgatttaataaatttttctttttcattatattccaccatatccaacaaatttctaaaaaataaatggaaactaattatgatgtatgaaaacttagttgggttagagtttgaatccatccgtatcaattagtgagtacagcttgaaagttataaatgggtgttttgcagtaaaccctaaaacacctaggacaagcgataaaatttagttttttagtaatgtcagttgtgggacaggaaaaaagtttgtgcttattaaaatattgcagtcaaaggatttcaataaaagtcgtgaatagtgttgaaaattataatacagctatgataatgtttatttataattatgaacatacgaataataagtgttttagagtttacgctaaaagcactattttaatatttatgatgataacaaaagtgaggatgtaaatagattgcgtttagaaaaaatattaatcagggacataaatctcaattagattagatggacgatacgaatcagcccacattaatcttcaaaaaatgataaatattccatcgttctaggtagtggggatgctttctagcagcgctcggtgtcacaccaacaaacactttaaattgtcggctaagatgtgcttggtccgcgaaattaagttcagcagcgatttctgccatcgatagatcggtgatcgaaataagctgaatagcacggttaattttactgagcattttgaattcagtgattgtaatgccgacttcctgtttaaattgggatgataaatagttttgtgaaagtttcagttggtggctgtattgcggaatggagggtgtttcttcgggtgtatctaggattgtttgataaatgtggcggatgttttttgataaatgcacgtttttgagactctggacacgtgaagccatgtctatgagaattttttcgatttttttcataacatcgtcaaatacaggtgcctcttcgatctcgattacgtattgatcgttcagtgtgtacgcttgttcataatcaattccagcgttaattgcggcacgcaacgtcacggaaacacaaatgatgccccaatttttgattgctcttaaagtactctcgtttgaaagaacgccaattcgaccggagcttaaaagatggtggaatgcggaatgaatcgcgatcgaatctcccatcatgacggcggttttgagtgcctgttcgtatttgtagctaatatgagcgccttggttgttaaattgaacggacatgataatattgttgagttcgtttgaggtgattggattttggaacgcctgatcgattgacgcagcgctggttgaaagaccaatcagttgggaaaagaaagtaacttggtggtagcactgatctttttctaaaatgggggtctgcaatttgtgtgaaaggtaaacaatcattgaacccagattttgacttttgcgattggaacgagaattgattagctcgggaccaattaaaaatgccgtttcctgcgtgatgaagcaaaatgtcagtagcgtttccgtgtgtcgtaaaatatagaagccagctttagtggggagtcgctgtaacattgcataataacgccgtgttaaaatattgccacacttgaattgtacggttggcttgttgtgtgacagactaaatttaattgccggtacgtttaatgactgaatataggcttgatcgagagacaccatggatcacctcatgagtaaaatattcaaaaaactgttgatctgttcaataaatgaagtaacaaggctattacactctttattgtaagcgttaacaaaacattgaacagttttgaagtcgaatcaattagggggcatttagttatgaagatttacgtcgatgcaactgtgatgcgagatggtaatggatctaaagaggcaccatataaatcaattaatgcggccgctaaacgagctgtggccggggatgaggtgttggtttttccgggagtctatcgtgaaaacgtggatcccgttaattccggcaccgcagaagcgccaatcacttaccggagtgttaagccgttacaagccactattacgggagcggaaagtgttaaaaattggcaactttatcgggataatgtctgggttgcacagatcgataatggggtctttggaacgtataatccgtacactacatttgttgtgggtgattggtattttggcccggtggacaaacatacgggtgcggtatacatgaatgatcaacaattttatgaaaccacttcattggcagactgtttagctggcgcggtctatgcgcgttcttgggatcgtgagcattccatttataagtggtataccgaacaagatccgacaaagaacgaaacaattatttacgctaattttcagggcaagaatccaaataatgagcatgttgacatcaatgtgcgtcgcgaagtattttacccacaaaagacgggtgtagactacatcacgctcagtggattcaacgtgaataaagcagcaacgacatgggccccgcctgctgcttatcaggatgggatgattgggccacactgggccaagggttggattattgaagattgtgacattagtcatagtcgttgtgcgggaatctcattagggatgtacgaagatccagacaataatcattactttacctataagcacgttaaaagcccgacacaaatggaacgggatacagtatgccgtgggcaatatcatggatggctcaaagaaaatattgggcatcatatcattcgcagatgtaatattcatcattgtgaacaagacggtattgtgggacggcaaggggctgtattcagtctcattgaggataatcatattcaccatattaataacatgcaggaattagccggtgctgaaatcgcgggaattaaaattcatgcagctattgatgttatttttcgccgaaatcattttgaccatacaacgatgggattatggtgtgactgggaagcacagggaacccggattacccaaaatctatttgatcacaactatgcaccggaaggaactgctccacggttagatggtgcaatggaaagccaagatatttggattgaagtaagtcacggcccgacactgattgataataatttattgttatctaaggattcgttgaaaattccgacacagggcttagccgttgtgcagaatctgattttgggatcgttcacgtttgtgggtaccggaacggattatccaggacctggagaatcgcagccacggttcactccatatcatattaaacatcggacagaagtggcaggctttatgacgatcttgcatggggatgatcggttctataacaatatctttgtccaaaagtggccagctactgatcctgctccagaggataatgaagaggttggaacctttgtctttgatgactatccgacgtttgatgagtggtatcggccatttaagtcgttagagggaaaagcggccaaggaacatgatatggaaaatctgaaggaagctcatttcagtcatttaccaatttgggcgagtggcaatgtgtatctaaatggcgccaaagcttggaaaaaggaaactgataatttagtgaatactgaagatcagatagaatttgaactgatcgaaaatgatgggcaaccacagattaaaaccaacttgtatgatgtgatcggtgactaccaaagtggcataattaacactgatattttgggtgaagcttttgagccagaacaacgatttgaaatgccaaatggtgattcgatcattttcaatgaagattattttggtaatcatcgggggacctcgaccattgcaggaccctttgcgtcggagaaggtagcccgtgaaatgttgtggatgaaagaataagaattgttaacgttagtactcaattaatgtaaaaataagcatcttcatttgccgtcactattgacgaaaatgaagatgcttattttgtgtttttagaggttaacattgtgtgactaacataaataacacgatgaattttagaaattagagatatatttttgaggtgttgtgccggtgatctgtttaaaaacacggttaaagtaaggaatgctattgaatcctgattctatggctacttctgatatcgtatgatttccatcacgtaactgtgattcggcaattttaatgcggtaatgattaataaatgaaaacaatgtttctccagtatcttgatgaaatctacgtgaaagatatgacgggcttgtatgcacggcctgagcaataattttcaggtgaaggtcgtctttatagtgcaacataacgtactcgatagcggcagacacgcaggtgttataacgcttgcttcgtttgatacgaacgaggtcgcagtatttaaaaggcatttgagaaataagatgagttgcctgttgtaatgaggatattttttcgattgccagtgcatatttagaagacagttggtcgattaaaattttgcttgcagatccgcgctctgctgcaatccgacaaagagtattgaaaacgaacatgatgtttttcgctgacctcaattcacgatttggtatgcgatttaaaaagggtttcattgaagtcatggtactagtaacttctgttaagaatgcatgattaccagtagaaatagcatccataagttgattttgagcaacataggtacttaagatttggctggcatcaccgagctcgtcactggttatttcttcgtgtatttcaggaatatagatttgttgctcttggatacgcacatcgagtggtggttgcctaacaagattgatcataagatatgataaatcgtcacttgcatcctttgatgggccaacaattaggtatcctaatagaccactgctattccaaataccaacagcttgatagactccagagctatcacgaacgcgacaacacgtttcttgtgtatttggaagctggtgaaagccagggacggtttgtttcgcatcgggagttgcatagactggcacaagatgggacgtacataatcgaactggtacattacttagctcatgtagtgcaattgcaactttttgatatgtagaaatagaaatcataacaaatgttactccttacaatatgggttatatcagggaatgctacaaaaataaaaggtgaaaagaagtcaatattgtgtaatttagggaaatataagtaaatatcactttctaaaaatatactaacatacaagtaagcgtttacaaaacgacttaaaaactataggagtgataagtaatgttatttccaatttcaacggaaactagaacggtgacgagtttaaatggtgtctggcggtttgcagttcaacaaccgggaaagataaatgatcctcaaacaaagctaaattcggaccaagttatggcggttcctgcatcatttaatgatcaaactgttgatcagtcaattcgtgagcatagtggatatttttggtatgagcgtgaatttgaagtgccaaatatcttaacaacacagaacttagcactacattttggatcggcaactcatgaagcatgggtatatgtgaatggtgaactagctggtcatcataaaggaggattcaccccatttgcgttaccagttaatgaacttgttcacgctggaactaatcgagttacagtcaaattgagcaatttacttgatcagacgacattaccagttggaaattatacggaaactaaggatgaagatggcaatgtaatctatcatgtcgacgaaaattttgacttttttaattatgcgggactacatcgaaatgtatcgctattagctacgccaaggacatatattgataatatttctattaacccggatgttgacttagctacacagcatgctgatgttaacgtacttgtgacagctagcggtgattttgatgaaattcacgttgaaattagggatgaggacgatcaaatagtaggtgaatcaaacggtgaaagaaatgtaatatcacttgatcaagtgcatttatggcagcctttagccgcatacctatatagcgcaaaggtttcattgctgaaaatgggacatgtagttgatgtctacactgaaccatttgggattcgaaccgttgccgcccaagaaggtaaattcttaatcaatggggagccattttactttaaaggctttggaaaacatgaggatacgtacgttaatgggaaaggaatcaatgaagcttataatgtcttagatattaatttgttaaagaaaatgggggctaattcgttccgtacttcacattatccatactcagaagaaatgatgagactgtgtgatcgcgaaggaattgttgtgattgatgaaactcccgcggttggattaatgccagcctttaacttcgatatttcaagtgcaatggcgggaacaaagcaaaagaatccattttggtatgacatcgcgacacaagatgcacataagcaagtgatcagggaaatgattgatcgtgataaaaatcatgcttgtgtagttgtatggtccattgctaatgaacctgcaacttatttagatggatcatatgaatattttgcacctatgtttgagctagcaagagagcttgatccacaaaaacgaccttgtacgtttgtgaatattatgttgtcaacagctggtaatgataagtgtacagatttagtagatattttggcactgaatcgctattatggctggtatgtgaatactggtgatttaaaaacagccgctaaggatcaagaagcagaattaagaacttggcaagatttatatccagataagccgattatgtttactgagtttggtgcggatacaattgctggaatgcatagtgcatacaacgaacctttctctgaagaataccaagttaattattacaagatgaatgctgcggtatttgataagatcaacaattttgtaggtgaacaactttggaactttgcagattttcagactaaatttggcattcaacggatacaaggaaacaagaaggggatctttacgcgttcacgggagcctaaggccgcagcaatatggttaagtcaacgctggaataacattccaaacttcaattataagaagtaaggcgaggtgtaaataaatggaaacaaacagctcaattcaaattgaagaaaatcaacctagtgaacaaacaacaattagtaaaattccctttactaccaaggataaagtaggttatatgtttggcgatatcgggaataacctgacgtttacaactgttagttcgtttttaatgattttttatacaaacgtgttagggatctcggcagcaatcgtaggagtgctatttcttaccgcacgtgtgattgacgcttttgcagatctaacagttgggcgccttgttgataacagtgcattacatgatgatggacgttttcgtccatggatcaaacggatgaaatatccactgtttttattctcaatacttctattcttgccttggattcaaggtatgtcggttggcattaagacagtttatattttctttacctacattgtctggggaattttgtattcaaccgtcaatattccgtatggatcgatggcctcggcaatttcgacaagtccatctgataaaacaagtctttctaatttccgcagtatcggtgcggcaatcggtggaattttggttagttatttaattccaatgtttatgtacgccaagggatcgcaacaaatctctggtatgcgactgtttattattgtaacaatttgtgcagcagctggctttgcatcatatgtgattttataccggttatcggttgaacgcgtgcggaccaataaagctgagaaagtcccactttctttggttattaaaaaattatcacaagatcgtgctctaattgtacttgcccttgtggatgtattaatgtgtctgggcctgttttcaaacaactcatttattccgtatctgttcaatgattattttcaaaataaggcagctatgtcaattgcaatgatttgtggaactttggggattttgattttagcgccgttttccaaaaaattatatgaacgtttcggacgtaaggaagtaactgtggcgtttctctcgtttggctttttaatgttcagtgttttgtttttcttgcacacacgtaacgtgactttgttcctcattgtgactttatttgccaatctcggaattggaatgtttaatctgatggtttgggcattcattactgatgtcattgataatgaacaggtcgaaaccggaattcgtgaagatggtgtcgtatacggtgtgaattcgtttgtccgaaaagtagcacaagcattggctggaggtttagctggattcttattgacttttatcggatatcaaacatcgacaagtggtggtgcagtgcaatcggcaaatgttattaatcatatttatcaggttgcagttggtgttccggcactatgctatggattagccttggcttgcctatttttcctctatccgcttaataagaaaaaggtacttgataatgcagtatatttaaaaaatattgccgaagatcaagcaaataactaagtctttaaatgggtgaagttgacttcctacaacttctgtagctaattggatggttgggatggctacttttaatgcagtaagctcttcgtcaagatatgctgcaaagtctactggttaacaacaagaacgctctttcagttttagtgaattgagagagcgttctttgttgtaaatatgatatcattttgatatgatactatcaaaatgatatcataaagaaggggattgaattgagcgacgataagaagcgatttttgctgcgaattgatcaaactttgtatgatcaactggcacgtgatgccgaaagtgaaaatcgaagtatcaatgcgcacatagaaacgattttacaaaaggcaacgcaaggaaaaacgtttgagcgacgacaaattgtcggtcaggtaatagaaggcacgcagattaattcagaaaatgggttggttacggtagctggtatttattatcgttacttaattagtgataattcgactgtcaacacaactggccggtatgcagtaacggatgcggtcgggaatattttaacattacaaaaaatttgattaacaatatgtggaggagcaaatattatggctttaggaattaaaattgtgccccaaaataacttgggacttgttgagaccttaggaaagtatcggcgtagtgtagagtcaggtctacatttttacattcccttgattcaaaaaatccgtaaagtaagtttagcaatggaaccattatcattacccaattattcgattattacaaaggataatgccgatgtttccgcaagtgtgaccttaaactatcatgtgacaaatggcgtgaagtatcagtatgaaaatacggattcagtggaatcaatggctcagttagtgcgtggccatttgcgtgatattattggacgaatggatttaaacgaagcgctgggatcaaccgctaaaattaatcaggaattggccttggcaattggtgatttgactaatacttatggtattaatgttgatcggattaatattgacgagttgacaccatcgcaggcgattcaagaggcaatggataagcaattgaccgccgatcgtgaacgagttgctacaattgctaaggcggaaggtgaggctaaatcaattgagttgacaacaaaggcgaagaatgacgcattaatggcaactgcgaaggcagaagcggatgctacaaaaacacgggcggatgcggaacgttaccgaattgacacggttcaaactggtttagctggagcagacgataaatacttccaaaatcaatctatcaacgccttcgcggagttagcgacatcatcagccaacttggttgtcgtgccaactgatagtgcgagcgaatacggtaagttaccggtagtggggcagttacttaaaaagggtgctaagtaagtcgattacgttaactaataatctgaaggttactattaattatgctaccgaatattttaaattcggtagtttttttataagttgagtgttgatgtctgatcaccaacgaagataaaacagcgcataaatgattaaataggtaaaatatataaaaagtgcagaaaactctatatttttggaatatattgtggtttaataatagccaatataggtaattgtgtaatactttctttgtgaataggagtcattaaagataagattgggagttgggggactatgagcttattttttagaccggtgggacggttaaataatactgataagggaccggtcgtgcaagatcaacaaatatttgaacgtgttctgacagagttagaggatcagtcactagcagtggtactgcaatttgtgaccgatatttatattcagggagttcatgagggacttgattggcatgatacggatcaagatgtggactatcaaagtgtgcaactgcaaaatgtatggttaggacaaaatcgaggccggaatctttttcaacgggtagtcaaagcgttgaatcaagccgatagctttgaattttatattatgagtgaagcgattactaaggttgttatggctagtaatgatgttcagcaaattagtgatctcgagtcattgagccgaattgtattaaaacaagaggatctgtttgaaattttcttgagtggctggatatttggaaaacaaagttactactatcagtcaagcctagatcgttttggaatggatgacgatgctgctatttttgaccatgcaatgaaacaggccagtgatgaagctaatcgacttgggtacactgaatttgatgatgatgaaacgcaggcttattttatggcgtgtattttgaacgtactagaataataatttttatggattaagtacgaaagcctagacaaaaattttgtctaggctttcatgcgttaacgagtccgaaaaacaaaaaattttaatttttttatacgtacgtattgcacgcccgtgtaacatgtaatactatgtaggaaataaaagtattcgttggcttgtacatctctattactggtaagtattggatggcaaggtggattttttacaaaatatgggatgttgtgcattgtataatcgaggagaagtcgaggatactaggttaattacaaaatataattggtgaaaacttggaaatcagtaatcaaaaggggtagaaattatgggagattttgacaagaaaaatcggcaactagtatatgatcaaacaactcggcgggtacattttaagctgtataaggccgggaaggtgtggcttgctgctggtttagcaacttttacctttggggtcacgcaaatggtaggaacgacaacgctacatgcagctactgtcagtgaaacgcaaactacagttgataacggtctccagcaaagttcagttacattgtcagagagtgctgctactgccagtagtgctgcggattcagcagccgatagttcagctagtacagtagttagtacagatagcgcgagtgcggctgatgaatcattaaatgaatcaagcgcagctagtgttgcgagtcagtcggaaagtaatgcgagcagtgcaacgaacgagagcacggcggatgttgctgcaagtgctgtagcaagtggggatgtgagcagtagtgcaagcgggcaaaatactgatagtagtgcatcgaatgtaaccgcttcgaattcaacatctgcatatgggtcgccacaaaccaaatctttagtaaaagcggctgtggcggcgactactccagcaacaagtagtgcgacagatccgttgccagctgggttcagcgtgggtgaaccaacatatccagatggtgtttttcactatgatgaagatagtgactggtatacatttgctcaaatcggaaccggttcaggcacaatcacatttgccattgatcgggcaactcaatcaaatattcaagtggggacggttagtgtaaccgacggagtggcgtcgattagtgcagttcagaacttggcggcagggaaaagtacctacgatggtgcgatgatttttaatgaggatcaggccattgatgttgtagcatcaattacctatatatttgatgtgtatgcgtataaagatggaaacgatcagccatggggtggctatgcatttttaaagccaattcttcaaactcaaacgacagagtacattgatcaagacggtaaccagattgctgatccagttgttatgaccggattatcagggcaaagttatacaactagtccctcaactcaaattacggggtataacccaactgcatctgataattccacgggttttatgtcaccttttactagcaatggacagacttttgtagaagttctatacaatattgatggcagtaaaaaaggaacgttaacttatacagttgatgattataaaacagggtctatggattatgattttgagcctgcgacaccgtcatactctgcaaagaagggcacattgaaatatggagaagatccagaggcagtgacggttcaaacgagtgggggaaattatacggttaaaaatccctatgttcctcaaactacgacgatcacatatacctacaatgcttcagatgtgaacgtcacggtaaagtatgtggatgaaaatgggaacgcaattgctgcggatgggattgccactggtaaatttaagcaggcgattacaattgatcaaccaaatattactggatatacgtatgatcagaattacgcagtttcggacattgataatgcgtcacagtatactgtgacggactacacaggagaaaatgtcgtgacgctgcactatacgactgatgatgaaaatgtcgttattttgcacatggatagtgacggtaatttattgaatgatgccacgattggaacgggtaagtataatcaaacatttacggctgacgccacgaatgacaaaagctttgatataccaggttatcgtctcgatccaacttcaaatttagcagttaagattggcgctggacctaatttaataaatctgaaatatgacaagttgtacacggcgacgatcaactatgtcgatcaaaatggccaacaaattgatagtagcttattaaacaatgctactacgacactcagtggcattgttggtgaaaatttagcaattacaagtccgaaaattgcggggtatactgcatacgcagacaatccaagttcgtatactgtcgttgctaatgaaacaaccatcacgctacgctatgttaaaacaacaatgactgtttcagttaatgtgacaccaacggcagacggtacgaaagtaacggcgacggttgtggatggtgatggaaattcggtgaatgcagggcaaccaattgacccgaatgatctaactgggccaaaatggcctagtaatttaacaaccgatgaaattgggtctgcaacatcagtaagtaaagcaaagaatgatttagatgctgcggtgaatgaaacagtgcatgcgtatacggtcggtagtgacggtgaaactttaactagtaccagtgtgagtcattttgaagtctattttaaacgaacggcaacagttgattttagtgatcttagttcacctaaagtagtatttgatagctggacaccaatcattggtgcgggaacgcaaaatatgatttctagttatggaagtgacgttattgggtcggacttaattccagctttggattacgaaatggcctatgcaagtaaccctgggactgagcagacagtggttgggtacgatagtacaggaacgcaaattgaattaaaaaatatgacctttcagggaatatcgtttttaggaattccgccgattcaggtcactgcaaatagcgcagatttagtttattatattgcctactttaatacagaccagctcacaaaaaaatttacacgtacagttcactatcaaacagtacaaggcacgcagttaaaaaatgatactcagcaaacggcgtcgtatacggtgaagtcaagtttggatgttagtacacctgcgagtccaaaacttgtaaatacaatagtttgggagaatggtattaatgctttcgcagcagttgatgctcctgaaattcaaggatatacgtctactaagggagttttaagtaaaacaattgagcaaactgatgccactgctagcgaggcgacgattgtgtacacgccgaacacggtgacggccgatgtcacgattcctagtaatcttggaaatcaagtagtgacaaatactaccggagttgttggtaatactgttaacatttcagtaccaatgatcgaagggtacacaccgaataagacgacggtgcctgcaaccgttaatcccgatggaacgattacaacgacagagacagtaacatataccggaaattcaattgattactatattgttcctgttgatagtggtggttcaccattgtatggaacaaatccgattgcagaaaacggtacagttgggacaaaaattactgttccagttattcctgggtatacagccgtggcaacgaatgaagtagtacccgcagatggtggtaatgtagagatagtctatgttccagttaaggattacggcaccgtaggcgaaaacgaaaatagtgaagtggccaccccagttaacgtgaaggaaaaggtccaggttccaacggaaggtgtgccaagtattgatctggcaacgtcaaccgtgacaattatcccggttgatctaagtggcaaacaattatatggacaggatccgtatgtaatattgggagccgtggccgggtacgacgtaccggtaccagtgattaaagggtacacaccaaaagatggaatcacgagtatcgtagcggtgaacggtgataattatgtgacgtatgttccagttaaggattacggcaccgtaggcgaaaacgaaaatagtgaagtagccaccccagttaacgtgaaggaaaaggtccaagttccaacggaaggcgtgccaagtatcgatctggcaacgtcaacggtgacagttatcccggttgatctaagtggcaaacaattatacggacaagatccgtatgtgatattgggagctgtggctgggtacgacgtatcggtgccagtgattaaagggtacacaccaaaagatggaatcacgagtattgtagcggtgaatggtgataattatgtgacgtatgttccagttaaggattacggcaccgtaggcgaaaacgaaaatagtgaagtagccaccccagttaacgtgaaggaaaaggtccaagttccaacggaaggcgtgccaagtattgatctggcaacgtcaacggtgacaattatcccggttgatctaagcggcaaacaattgtatggacagaatccgtatgtgatattgggagccgtggccgggtacgacgtaccggtgccagtgattaaagggtatacaccaaaagacgggatcacgagtatcgtagcggcgaatggtgataattatgtgacgtatgttccagttaaggattacggcaccgtaggcgaaaacgaaaatagtgaagtagccaccccagttaacgtgaaagaaaaggtccaagttccaacggaaggcgtgccaagtattgatctggcaacgtcaacggtgacaattatcccggttgatctaagcggcaaacaattgtatggacagaatccgtatgtgatattgggagccgtggccgggtacgacgtaccggtgccagtgattaaagggtatacaccaaaagacgggatcacgagtatcgtagcggtgaatggtgataattatgtgacgtatgttccagttaaggattacggcaccgtaggcgaaaacgaaaatagtgaagtagccaccccggttaacgtgaaagaaaaggtccaagttccaacggaaggcgtgccaagtattgatctggcaacgtcaacggtgacaattatcccggttgacctaagcggcaaacaattgtatggacagaatccatatgtgatattgggagccgtggccgggtacgacgtaccggtgccagtgatcaaagggtacacaccaaaagatggaatcacgagtattgtagcggtgaatggtgataattatgtgacgtatgttccagttaaggattacggcaccgtaggtgaaaacgaaaatagtgaagtagccaccccagttaacgtgaaggaaaaggcacaacaaccagatggcgttaacaccgatggtcaaacgatcacaatcacgccagtcgatttaagtggtaatccactatacggccaaacacccatcacaattccaggtgtggcgggctatgaagtaacagtaccggaaattccaggatacacagcggtcacggatacaaccgtgccgactaatggtgagaacaaggtcgtatatgtaccaaagacagactatggcaccgtaggtgaaaacgaaaatagtgaagtggccaccctagttaacgtgaaggaaaaggcacaacaaccagatggcgttaacaccgatggtcaaacggtcacaatcacgccagtcgatttaagtggtaatccactatacggccaaacatccatcacaattccaggtgtggcgggctatgaagtaacagtaccggaaattccaggatacacagcggtcacggatacaaccgtgccgactaacggtgagaacaaggtcgtatatgtaccaaagacagactacggcaccgtcggtgagaataatgcgacggatgatggggcgattatcagtgatccaagtcatgtgtaccaaaaggtccaacaaccggccggagttaacactgatggtcaaaccgtcacaatcacgccagttgatctcagtggtaatccactatatggtcgaacacctatcacaattccaggtgtggcgggctatgaagtaacagtgccggaaattccgggatacacagcagttacaaatacaaccgtgccgacgaatggggttaataaagtggtatatgtgcccaatgttactaatgggaccgtcggtgaaaacgaagcaaatgatgatggtgcaattgtcagtgatccaagtcatgtgtaccagaaagcccaacaaccaggcggcgttaataccgatggtcaaacagtgacgatcacgccggttgatctcagtggtaatccactatacggccaaacaccgattacgattccaggagtggccggctatgaagtaacagtaccagagattccaggctacacaccagtcacggatacaaccgtaccgactaacggtgaaaataaagtcgtatatgtacccaagacagattacggcgccgtcggtgaaaacaacacggcggatgatggcgcgattgtcagcgatccaagtcatgtataccaaaaggcacaacaaccagccggggttaacactgatggtcaaacggtgacgatcacaccagttgatctaagtggcaatccactatacggccaaacaccgattacgattccgggagtggccggttatgaagtgacagtaccggaaattccaggatacacagcaatcacggacacaaccgtgccgaccaatggagttaataaagtggtgtatgttcccaatgttaataatgggaccgtcggtgaaaatgaaacaaatgatgatggggcaattgtcagtgatccaagccatgtgtaccaaaaggtacaacaaccggacggcgttaatgcgaatggccaaacggtgacgattacgccggttgatctcagtggtaatccactatacggccaaacaccgattacgattccaggcgtagccggttatgaaatgacagtaccggaaattccgggatacgccccagttacaggcacaaccgtgccgacgaatggagttaataaagtggtgtatgtgccaaacgctaataatggcaccgtcggtgaaaatgacacgccggatgatggcgcgattgttagtgaccctaaccatgtataccaaaaagttcagcagccagcaggaactaatgcgaatggccaaacggtgacgatcacgccagtcgatttaagtggtaatccactatacggccaaacacccatcacaattccaggagtggccggctatgaagtaacagtaccagagattccaggctacacaccagtcacggatacaaccgtaccgactaacggtgaaaataaagtcgtatatgtacccaagacagactacggcaccgtcggtgaaaataacacgacggatgatggtgcaattgtcagtgatccaagtcatgtgtaccagaaagcccaacaaccaggcggcgttaataccgatggacaaacggtgacgatcacgccagttgacctgagtggtaatccattgtacggccaaacacccattacgattccaggcgtagccggttatgaagtgacagtaccggagattccgggttacacagcagtcacggttacgaccgtgccgactaacggtgaaaacaaggtcgtatatgtacccaagatagattacggcaccgtcggtgaaaacaacacggcggatgatggcgcgattgttagcgatccaaaccacgtgtaccaaaaggtccaacaaccagacggcgttaataccgatggacaaacggtgacaattacaccagttggcctcagtggtaatccactatacggtcaaacacccattacgattccaggcgtagccggctatgaagtaacagtaccggaaattccaggatacacagcggtcacggatacaaccgtgccgactaacggtgagaacaaggtcgtatatgtacccaagacagactacggcaccgtcggtgagaataatgcgacggatgatggggcgattgtcagtgatccaagtcatgtgtaccaaaaggtccaacaaccagccggcgttaacactgatggtcaaacggtaacgatcacgccagttgacctgagtggcaatccactatacggccaaacaccgattacaattccaggcgtagcgggttatgaagtgacagtaccggagattccgggttacacagcagtcacggctacgaccgtgccgattaacggtgaaaataaggtcgtatatgtacccaagacagattacggcaccgtcggtgaaaacaacacggcggatgatggggcgattgtcagcgatccaaaccacgtgtaccaaaaggtccaacaaccagccggtgttaatgccgatggacaaacggtgacaattacaccagttgatctaagtggtaatccactatacggtcaaacacccatcacaattccaggtgtagcgggttatgaagcgacagtaccggaaattccgggatacaccccagttacaggcacaactgtgccgaccaatggaattaacaaagtggtgtatgtaccaaacgttaataatgggatcgtcggtgaaaatgaaacaaatggtgatggggcgattgtcagtgatccgaaccatgtataccaaaaagctcaacaaccagccggtgttaatgcgaatggccaaacggtaacgatcacgccagttgacctgagtggtaatccactatatggtcaaacacctattacgattccaggagtggccggttatgaagtaacagtaccagaaattccgggttacacagcagtcacggctacgaccgtgcccacgaatggggagaataaagtcgtgtatgtaccagtcaatggtggctctgtagaccaaaatggaactcctgaaacaagtgaaccagttacggatccagatcatgtctacgaaaaagatcaggtgccaggcactgatgtaccatttgtcgacttagccaccgccacagtgacgattacaccggtagatgtgaatggcaatccactgtacggacagtcaccgattaaggtgcaaggggtggccgggtatcccgttactgtaccggatattgctgggtatacaccaactgaaacgacaatcattgccactaatggcgccaacgttgttacgtatattcctaataaaaatgctggaattgtgcctaatgatagtggtgaagtagcaaccaatgttcgtgtgtatgaacgaaaccaaatcccagatactgacgtaccacatacttcagtgacagcgattacagaaaagcaagcgcaaaattcgatttcgacaactgaaaccgtgcttgatgaaagcaaccagtctggcacaccatcagcgtctcaatcaaatagagatcattcgtcagtaagtgcagctcgtttgccgcagactgataacgcaagtaactacctgggaaaattgggagttataatgctaagtgtggtcagcttgataacggccctgggagcacgaagaaagaaagattccaaaatgcatgatcatgattaagaaatgcttgtcgcattgcgaatcaagaatcgttatttaacttaaaaaacggaatcaaattcagttgtctagctgaattttgattccgtttttgagctgcttgtttttaaaaatttggttgcatgtgaccaaaacattaatttagatgatcgtaatagatgactttaggcgtttgttcgtctgaaagaatgacttttgtaatgctgccgttttgagtcgggtaacccgtatccaattctggcgcatatcgagatataatcgagcgaatcgtgtttccatgagaaacaacgacaatattgtcttggtctgctgaattttgaagtagcttgtcaaagccgcggtttaagcgtttccaaaacatatcattattttcagcatccccatagagatcggctttgtgaattaaatcacgagcgcgctcgagtccaaatttttgcataattccagtttcagtagtcgtttgaacttgttctcccacgaactgccacatttggctgagatcgttaccttcgaagtaaccgtggcattgttcgcgtaattctggaaattcataggaaattaaatgaatattttctggattttgtttcaagataagtcggagcgtttcaactgcgcgaccagaatcactactaaaacccgccgcaaatttgacgtttgctaatcgttgaccagcaccaatggcatctttgatccctttgtcggtgaggggagagtcgatccagccttgaactttattgtaacggtttaacatagtttgaccatgtcgtacaaaatacgcggtgatagttttcatgatgatagtccctcctaatagtttatgtattcactagagcaacgatcggaaacggtagccacttactgaaaataagacccctgctataggataactgtatcacactagaaaagaataagtaaacgaatacaattcttgaattaaaataacctcaatccgataagttaagatcaattcattgaaaaaaacgtgggcgagtactctctgctttaagagaaaactagctcacgtttctgtttagtcgcgccaatcaaattcagctgggacaatatttttaccccgaacttgtgtgccattaccgtttaaaatttcaattaaaatttcagcacaactcgcaccgatcaagaatggattctgatgaatgagcttgatttcgggagtgagtgcgtgagcaagtctggtatcagcaaatgcagttacctgaaattgttgtgggtcgacgacttttgagacaaacaaaggcgcaataaattccaacaaccagcgttcttttagggcaaaaaggagcgtcttttcatttgtttttgaaataagctgcatgagttctgcttttacttgttggcgttggtaagattcttcgggaatattaagcacatctattttttcaaaaacatcttgaataccacgaaaacgctcgcgtcgtgtggaggccgctgagatgtcagatgagaggacaatgacgcgggtgaaaccggcccggtagaagtaagttgcggcacgctgtgcagatgcatagttatcggtaataacttctggccaagaggacttctctagttcccggtctgcaacaacgattggaatgtcacgtttcacttgttggcgaatggtatccgcagtgtctgttagcggttgtaaaatcagaccatcaaaattattttgattaatcgaattcaaaagttcattttcgcgctgattgtccgaatcagaatcaaataggaccccggtataatgatgactttcaaggatcgaatttgcacccttaaaaagttcagtcgaaaaataatcatcgatgttagcaacggcaacggcgacgattttgctcgaatgagtgaccatttgtctagcggctgaattcggaacgtaatttaatttagtgatggcttccttgatggttgctgcagtttgagtcgacattcggttgagttcaccgtttaaatatctggaaaccgttgcaatagaaacatttgcaagtgaagccacatctttcatgttggctcttttttttactgtcaatataatcaccagttcattttcttagtaatttcattttactccttgattcaaaatagcactagaagaaatattgttctcaccaaattacaggatataggtaaagggttaccaaaacaaagtgcagtgtaaaagatacgtaaactattgatttcaaagggattaaaatcaattaatataaaacgcttgcttttttctaggaaaacgtttaccataaaactcgtaaatttgaaagccgttacatgtggcaacttggaggtagaaaatggacaaacgaacaatcatagatcctgatcaatttgcaatgcaatttgctaaatcaaactatgcaaagggatttaatgaaaaagaagtcgtcgtagaagctaaaaaatttttactgagttatttaactgcttattatttgattcaagattttgatgatactgaacgacaaaattttgaacaaacaactgataaaaaatttcaggatatgagttttgaggaactgatgaacaaggtaattcatcttaataaatattaaggagtgatttaataatggatattattttaaatacttgggttttcgaggatcgggttaaatcaggtgttagccaggctgaattagtcgaaaaagctgcgcaactccatgctgatgggttggaaattcggcgggaatattttaaggatcttgccacagagatgcctttaattgctcaaaaagttcgggaacagtcgttaattcttaactatagtgttccggacgaagtctttttacaagatgggtcatttaatccgaaacttaagcaatattttgatgaagcacatgcaatgggagttaccaaaatcaaatttaataccggcaactttgcagattttcatggtgatttggccgcagaactggagcaactaccacttgatgaaattcaaatgaatgttgaaaacgatcagacagccatttctggaactgtaacggcaattgaaacgttcctaacggctgctagagaagtcggaattaatgaaattgggtatgtctacgatctcggtaattgggcgtttacgggtggcgacgcggtagaagccgcgaaaaaactgggaaaatatactcattacattcatttgaagaatacgattaaaaatgaaaccggtttagtgacgtccgacgatttggatgatggtctgtatgactggcgtaaattaatgaccattcttcctcaggatcagatggtcgccattgaatttccaatgaccacggatgaacaaattagtcatcagattgagctacttcggaactggaaggggcggtagtgatgagttcaacagtaattgcgattttacttcttctctcgttctttggatttatctactacatcgttaagggcggcaatttgatgatcggatttttcgtcatggcgattctctggtcaatcattgggatgattccgtttcaaactgcaattcagaaagtttttgctgaaccagccctcaactatgggccaacaattatgtatatcgtatttgggtcgtggtttggccgggtactggttgatagtgggattgcgccagcaatttctgaaaccaccaataaagttggtaaacggcgcccactgattgcggcaatattagttgttttggtcacttcgtttatttttatcagtgcttatggagtaggatcggttattgccattggtgtaattttgctgccaatcttgctttcaattgggttaccgcgtgatattgcgctaacagcatttgctttagctgtcggtgcaccaatgtatttgaacgttgttttatacaatcaaattaaagcttttttcccgcatgcacattatggcggcacttaccttcagtttggttggattgcgatgggcattcagattgtactgattattatcttcttggttttgaatcgaaaaaaatttgatgcaagtcatgtagacgagaatttagctaagattggtgcccttgaaaatcagggcactcaggaaggtaataaagtaccgaagatcgcttttattgtgccagtcattccagtgttgatgaacatgttgtttcagtgggatgccattcctgcacttacattggcaaccttaattgcgattgttttaaccgggcatgcacgccactacaagggctttgtgaaattcttgaatgatacgatccaacaagcgatctcagacattgcaggattgatcatgttcttgatggctttgattatgtttagtggagcagcctcaatgaatgcgaaccgatttaagccgcttttcgaagcaattttaccgcatgatcatctaattttggcattagccttagggatttttgcaccattagctctatttagaggtcctttgcatgtctggggagccggtgccgcgacagcagcagttttgtctggaaccggattgttcagcgatgccttcctattaccattactatatgtaccaaccttgatggctgtttcgacagatatcacacaatcttggaacgtttggggcctagattatatgaaagttcaatcaaaggactttttgaaacgagggataccgattatgtggattgtctcgattgtaaacgagttgttagtttaccacttctttgggtagcaaaatgataaataagaaatgaggaatataaaatgagtgaagttattacaattggcgaaccagtggtcacgtttgccgctactgacccggatgtctcgctagcgaaggccgaaaattttaagaaaattttgggtggtgccgaattaaatgttgcgatcggtattcgtcgattaggtcatagcgttgattatttttcacaggtgggaaccgatccactgggcgactatgtgattgatacaattaaaaatcaccaaattggaaccgagcatattagccgggattcagagcattttacgggccatcaactaaaacagctcgtcacagttggggatccgaaaacatttaactaccgaaaagattcagctgcttctcatctacagagtcacgctttagaagatatcgatctaagtgatgttaaatttgcccacatgtctggtatctttccagcaatttcagcaacggccgagaaatcgttccgagttctgtatgaaaaattacatcaaaataaaattccgaccacgttcgatcctaatctccgaccatcgctttggggtgaccaagagcgaatgattcgaacgattaatgagttggcaacgaacgccgatatcgtgttaccgggtgtagatgaaggcgaaattttgatgggatctcgtgatcctgaaaagatagccgatttctatttaaagagtccaaaaacatcggttgtcatggttaaggtgggtgctaaaggggcctttgttaaaactaaaaagcaatcaggtcaactgattccaggtttcaaagtggatcaagttgttgatacagttggtgctggcgatggatttgccctaggtgtaattacggcacttcttgaagggaagtcactggaatcggcggcgttacgcgggaatgccgttggtgcgatgcaggtccaagttttaggggataatgaaggttatccaactcgcgaaaaattactgcaattttatgaaaaacaagggggagaagaaaaatgaaattacaagtcgcaattgatcgtgttgatttagaaactgctaaacgattggtccagcagttagacggggttgtagatattattgaacttggaacatccctaattaaagattacggatttttacaactcaaaaaagcgtttgctggaacatggcattcggaactgttgtatgatggcaaaactatcgatgagggtgtatacgaattcgaaaaggggtttgatgcgggggccgatattttaaccgtgatggctgcttcatcagtcgataccttgacaaaggtatacgatgtggcacaacgacggaataaacagatttttattgacttgatggaagttaatgaagaaaaaattcaaacgattcaacattttgaacatgcaatttatggactgcatcattcaaaggattcggaaagtacgtttgatgctgcggattcagtggctcattttcaagcagcattcccgacgattaagcatatttcggttgcagggggcattgatttgacgacagctcaaaaattggctgatcaaggaatcgttgattctgtaatcgttggaagcaaaattgtcaaagatgaaaacccactacaagcggctcaaaaatttatggaggtaattcgttaaaatgacactagtgaatgacgtaatgagtgaagttgatcatgtgatggcaatggtcagtctcccagaggtagaacaagcagaaaaattaattcaaaaggataagcgaatttttgtattaggggcaggccgttctggctttatggcaaagggatttgcgatgcgcttgatgcaaattggttttcaagtatatgtgatcggtgaaaccattacaccatcaattcaagccggcgatgtccttatttcgatttcggggtctgggaagacatccagcatcctagaactgacacagcgtgctaaggatgacggcgtgaccgtgattggtgtgactagcaatgccgcttcaccacttggtcaggtagcagacgcggtgattacagtgccgggtgcaactaaaaatggtagtggcattgactcaattcaactattgagtacattatttgatcaaagtgtccacatcactctcgatattgtatgtttacaactgagtcgacgtgatcacgtgtcgaacgatgatgctgccaacacccacagtaacatggaatagcaacgaccaaaaaggctactacttgcatttatgacaagtagtagcctttttagtagtctaagtcgaaccaaacaggagtatttgtatcgttcagcggtactagtggcgtaccttcagaattaatgagtggaatatcgccctgtaccgcccaagcaataatggttgccgcgggatagcccatttttgacgtgcaggcggttacggtggtggctttttgatcgtaatagagttcgcacaggtcgttaatgtgtttcgaacggtttttaacgttgatctggcgtgcgttgtcatcagtaatggcgaccactggttgtccatggtcatcgagtaaggggatgtttccatccaacgcccagcgtgttacggttggtagcgtgtatccggtactactgacgacgtctgctaatgtattatatttttcgtcgttaaaattctgacgtaacagcataatattttgattacgtcgttcgttactagctaagcctaagtcgtcaagttttcccattacaaaacacccctaaagtcgcgttaattagtgatcctattatagcatggaactctaaagatttgagttttgtgtcaaagtgggccgacttatttaagtgcctgctgtagaagcggcagtaagactacggcattgttatgctcacggtccttggctgcgtataataacaccacattttcgggctggtcatcttgaatctgttgcgccaattttgttacagcgccactttcagccaattcttgttcaaatcgagttttaaactctgaaaatcgttcaggatcatggccaaaccacttccttagttcggtgctgggtgcgatttctttatcccacaggtcaagtttagcatctgtctttttgattccgcgtggccagatgcggtcgattaaaatgcgaaagccggttggttggtcatcatcataaattctggcggttatgatcgtcattgtcgacactcccttcataaggatattgtacccgctttcagatatcatgggtagcaattcgtttcaaaaaagacagcccacgggaaggagggctgccaaaaagagtatccgtcacgggtcatcgttggatgactgatgacatgctagagtgaacgtcgaccgatctagtaagcaaattaggaagatctaagaggaatacgtcagttattattgcggcgtccgatggtaaagggtggatggcagtcaaccataggcggctgctttctccaaaccactgacgagagttgattaaaaatttgagcatttagctcagagagcagtataccgcagttaatcttaaatatcatcattactttaagtgggtggtttgatcacttcacgtctcactcggtcagtagtgaaccagtacttcgtgcgacgatttgagcggctaactggtttgcatgttgaatggcttctgggagagaatcaccagctaataagtgggccatgaggccgccacaatgggtgtcaccagcgccgatggtgttaactaccgtcgttgagactgcggggatgattttagcgtggcgaccgtcatagtaataggttccccgcgctccgagcgtcacaattactggactatgagtgcgatggaaaattgcagcagcttgttgctccaacgtcggttgatctggaactagtaattgaatttcggtcgcgttaccatgcacaatcacatgatcagttaaaaattgatcaatcgtgcgaggcgatagtcgactaatccagggtgaggcgtcaaacagtaagaacgattctactgaccgccgggcgagggtcgtcagtaagacatcagcggtagcctgttcagcgagttcgtagccactgagataaatgtacttgtattccgataaatcggtgttataaaaccagtcggggttccagtgctggtcgacgcctggaattgttaagaaacttcgctcaccatttggttcgaccattgaaagatcccagccgttgtcaccggccttgacggatagtttaactggaatttgatgttgataaaaatagtcgcgaacaaggttagcatagtgcccggtgccgatggggacgagcagatctgccggcgcatggcagtgggtggttgcaccgtaaacgttgaatgctgaaccgccaactcggtaggattgtaggttgccacgcacatcagtaccagttgtggggagttgtggaacgtcgacgatgacatcgacgtatgcagcgccaataattaatattttttgcattaaattcgacctcgtttaaatgttttaacgatcagcatacagaagatagcgactacagctgaaagaaaaacacccaagctattattgcgaaagatgccatgggcaaatggaccattccaaatggcgttgtttgtgaacagaaaaccggttgctgtggccaaaatccaagataaaataccaccgaaattatagtgaaccagtgaatcttgtttgaccagttggatatcatagccatgccgccgaaacatgatgctatcacacaggaagatggcgacccagctagctaaacaaatccccagaaaattaaggaaaatttcaaagttactgaggaagttgcctgaaataaagaggacgtaaattggaattagaatcacgatggcaccgtgaatcagaagggacgctggttgagagacatgaatgccaattgttgccaagttaatgcgggcggaacgaaatgaaatgatacattgaggaattagtccaccggcggcaactagaaagtaaattacaccaatccagcttggaagtgcggcatacatgacaccaaaaggatcgccggtagttgcgagcgagggttcgatggtactgagtagaattccaccggccatcagaacaaacattggaacggcaccgccgagggttgtattccaaaaggttgctgcgggacgggtttgtgggttaacgtaggcgccccaatctgcagctgccatcgaccaagaaataccggatccagccgctacgatgctgatagcgggtagtacgcctgttatccagttaccggatggaagcgcaaaggcagcgtgccagtcggctttaacaagaaaaagaatcagaataacaacggtcaaaataccaaagatgtaactgagccaggtttgaattttagcgagtgtgttttccgtgagtaacccggagcaaatgactaatccgccaaaaataattaacgcaatggccttagtgaccgtatttttttcaacgtgaattacattaaaaagtgatactaacagtagtgttcctgtaatgacgttgaccgcgagccagccaaccatattgagccaagcaatcacgttgggaattttattaccgtaaatgccatatgctgcacgactaagtttgaatgtcgtgatgccttctcgttggccaatcatggcaacccaacctggggctaagaacgacagtgcaccgattagggcggcgatcatggattgagtaaatgacagatgataattgacgatcatggccccaaaaacgaagcccatgataccaatgttggcggcaaaccagttgtaaaatagtttgcccggagtaagtgctttttctgaattgggtactttaataaaatcgtcttgcattgaaattaaattctcccttaaacgttttttatagggtggcagttaaaaggtgttgcccatattttttgagatcatgggtggggttcttttcgtcaatcaagcgaatccaagttggatcaattgatgcaattccattttttgcgccacagatcgcagtggccattgctccgattgtatccgtgtcaccacctaaattggcacacgtcacggcgcattttttgacgtcttgcgtgtagtacgcaatcgcaagtgcagctggaatactttctgaaatcattgtgcccgtcccaattagggtgtatatggcatggctgaaagcgacggcatcatttgtgtattggtgcgcgagacgtacgcccaactcggttcgtgcacggacttgtgctgcccaagtgggcgccccgagctgccgagcttgatcacttgtgtttagggcaaaggtgatgagatcttcccacgagtagtcggcaataccggcggtaacggctgcggcaattgcggttgcaccactataggcgacatcgctagagtgggtcattttggtgatcacacacaccattgtcactagggcgtcacaatcagcgggggtaaataaagtcccgattggggcaatgcgcattccggccccattagttaaggcctttttagtaacatcggtcgggtcttcgtgatgacgaatcgctagtaatgcagctttactgctaggacccaaaatattgttgtgccacgcatcgacttcatttgcccattgcatgatatgatctacaagacaagcttgatcggggtgccagttggtttcaattaaggcatcaataatagcaagtgcttgattggtgtcgtcggtgtattcgcccttagtaaagttgcaggcaacgttattggaactaggcccatcaagaaattccgtgataggatgtttaaagtacgcatggatttgttcaattggccagagctcggaaggcattccgaaagcgtccccgatggcctgaccgtacagggtacctaagatatgatctatgttacgcataaaatattgaacttctttctaaaagagttaatcgcatctgatggaatttcccgggcccgggatgaataaaaaggagctttaagcgtcatcagatgaaacgttgtaactaatggttattgctaaatacagttatcatttagctacaacactataagaataccagacctgtcaagacaggtcacgaataaaatattttggaggcctaatgaagtgaacctagtttaatataagttcgtgttttattgtaaaataagctgataatagcgttatataactataattatattattaacacgaacaatattcctaaatgttaaaaaataatttgtgtttttgtgataaacgaggtatgatgattttgcacttaatactacacatcagagaaagaggttgttaggattatgtcagattatttcaatacagttgaggaagcaatggatcgtttggagcagggtggtttcattattttgtcagataatgaagatcgcgaaaacgaaggtgatctcgtcgcacttgcacaagatgtccaagcagatatcatttatgatatgttgcatgaagccaatggattaatgtgtgtaccagtcaatagtgagattgcgcaaaagttaggcattcatgatatggtggccaatagtaccgatccccaccaaacaccgttttcagtgacgatggacggcacttttgaagcaacgggggttacaacaggggtttcggcatttgatcgtgctcgaactatccaacatattgcggatgataaggctcaagcaagtgattttaatcatccaggccatattcaacccttgattgcacagcctaatgggttgcgtgatcgtacaggacacacggaagcggccgttgatttagccctactagccggaaaggcgccagctgcagtgattattgaagtcctcaaatccgatggcacgatggcaagaagagatgatttgaaacagttatccgacaaactggacgtgccatacattacgatcgatcaaattgtgaagtatatggatgcgcaacatattcaaagtgccagccaattagtttcaagtaagtaattgttaactgaattcgggaaatcagttagcgaagagattggcaattaaataagagataatgaaatggagttgttacaagataacgtagtcttgtagcaactccatttgtgttgaacaaaaaaaggccccacacaaaagtgtgagaccagccattaaataacgcgtcgagcagtatagcatatttttactaaaaggaatagtgcttgacgatatgggcagatcgctatttagttgttaaagtagctaatgcttttcattaatatgcgacggtcatgaccaaacttgtctgatcgatggttaacttgttggtaattcatttgttcatacaacccatttttttctgtggcaatataggtcgtatcgaaacctgcttgggctgcagctccctcagcttggcgaacgagttcaagtgtaagaccgattccgtaaccgcggtaactctcattgacgaaaatcgaactgacaaatggactgagtggggtagctttgaaaacatcgttttttaatagcgcacaaaaaccaacaacttgatcgcggtcactaattacaatgacgcgttcccagtcaagaaaggcatggttgtgcataaggcgtgcgagatgttcacccacgatcggagagctattatgaattttttcagcgaacatctcccattttgaatcgaattggtgcataaccgtaatttccattgatcaaattcccctttgatgttagatcgatttatgtataatccccagtgcttgatagatgtaatcaccaaacaagagatgattttagtcggattccagttgacttgcaactggtcgatcagttctaaaagacaaacattatgcggataaatcagataattagtacacttattttcaattgatcggaattattacaattgtgtaactcatttagctataattaaattcacattatattataataaactagtgcattcacgactaattcaatcaaaaaaacgaccccatcctgaaagggtcgtcattcaaatcattgccgcttcatctagtgatgaagtacatcagttgttattgcgacaatgatttatgtcggggtaacgtgcgaaaactgcacattcaaaccactgatgagagtttgttgcgataaatatgttgagctggttaagctcaaaaagcagtatatcgtaaaaaccgaatgatttcacctatacttttagtattattcgtgctttgtgtgtcatcctatcatcgtgaacgtaggtttaaaacaagcccaaaagagatatataacgataagcatttcaatggattccagcatttttaggcttaattcgaaataagataagaaattgattaacaaacgattcaaatcacgtaaaagtattgagccggcccattaaaacggttaatattaaaattgaaatgatgcaattatgattgaattgcgtaatattgggaggaaatcaaatgaatacgaaacgaattgttggggctgcattggcgagtaccatcctattcgcaccctttgtcggacaaacaacggcagtagctgcggatagtttttatactaaccaaacaaatgctgaacgtgctgacattactaactgggttgccaacacatcggagcaaattggcaacaacatcagtgcgcaacatattaatctgaacaacctgaatggttccacttatgttattcaatggggagatacattatctggtatttcaaccgcgacgggcatttcagttcgtaagttagcgtatgacaacaacattgaaaatattgatcttatctatgctggcgatactttggtattaaaccggtccggatatgtgcctacgggttggacttacgatggggatgggacccgggttgctaacactaaggtcacaatcaataattttgtagataacagtgatcattcagtaactattaatgtttcaccagttgctccttcaggtgaaggaaccagtgatgattcatcaagtagttcaactgattattctgcaccgtctggtagtagcgtctcaggtgagtctgatgatgattccgatacttcaaacgacacaacaacttcggatagcatggattcagacgaattttctgatgccgtcagtgagaaactggctgataaattaggcttgtccgaagatgacgctgataagttatcaattgactttacttcatcaagtgatgacgaggatacggagtccgatgatgccgatagtgatactcaaacggtctacgatgaagatcagacggtctcattaaagaatgataagttaacgcagaaaaatgcgaagaagcttgccaacaagatttacaagcagttagatgaagatggtaaaactgctgatattatggatgctgatgaaattgaagttacaatcactgaagacggtagtgattacaatttcaatgttactttaacaactgagtcggatgaagatagtgacagcgataccactgatagcgaatcagactcaacggaatcagattcgaccgatgaagacacaactgatgatgaaacgtcaacgcaatcggatgaccaagaaactgattctcaagaagataatcaaaatgcaacgacatctgatgaagatacggatactacggattcagactactaattaaataataacgggggagtcataggttatgcataagaaaagatggacaattgttgggattattgtcgttattattctattagtggttggtggcacatactggaatatgagtcattcggtagcgaaaaaggttccggggaacacttaccgttatcaaagtgtttctaaagacaaggcgttgtatattacctttgcccagagtggggatcaggtggttgttaaccaaaataagagcactgctctaaaagcggctactaattcaagcgattttaattcggagtatcaaacgcagtccaaagatgcaacttggacgtataaggctgatggtggcacgttgacattggcagaaacttcgaaagataacaaagtttcacaatggcaatataataagattttagcaaccagtaagaaatttacctcgcacagctttacctatcaaattgctgatgctgggcaaggacaagtcaagagtaagacattttttgaaaaagttaattaattaatttaaataggtatctcatggtaagtggcgaccgtgggatacctatttttttatgtttttctatgcttcaaaagcatagaagacaaaaataataggcattggtagaaatgaacatctcaggatagactgatatctgtagtgcaattagttcataaaattagcaaatggatcaaggaaagaagggttagttaatgacagttcaaaataaagtggttatcatcaccggtgcctcatcagggattggtgaagccagtgcaaagttattagccgccaacggggcaaaagtggtattaggggcgcgtcgtgaagcaaaattaagccaaattgttgcagatattcggcagcacgggggccaagcgacctatgcggtgactgatgtcactaaagcagcatctgtgaaggcactggttgcaactgctaaaaaagagtttggaaccgtggatgtgattttcaacaatgccgggattatgcccagttctccgattagtgcgttacatgttgatgagtgggatgcaatgatcgatattaatatcaaaggtgttttaaatggtattgcggcagttatgccggaatttaccgcacagagacatggtcagattattacaacttcatcggtcgcaggtattaagagttttcctggcgcaggcgtgtatggtgcgactaaatttgcagttcgtaatttaatggaagtgattcggatggaaagtgctcaggaaggcactaatatccgaaccgccacgttgtacccggcggcaatcaacacggaattacttcacacaattacggatgagcaaactagcgccggtatgaagcagttatacgaaaccgtcggtattacaccagatgctgtagcgcgagtggttaattttgcgatcgagcaaccagcagatgtcaatattagtgaatttacgatttatcccacaaaacaggcctaatgaaagggagtatgaatattgaataaaaataaggcactcagccaagatggtatttttccacgcggtccgaaaaatgatgcttatgcccaatttttcacgggacaaagctatctgcaaggattagtaagtgatgatcaagtaaccgtcggcgtgggtaacgtgacgtttgaaccaggctgccgaaataattggcatattcatcatgatgggtatcaaattttattagtgacgggtggtgaaggctggtatcaagaggctggtaaaccagctagacatcttagtgcaggggatgtcgtggtgacccatgacggcattaaacattggcatggggccactaaggatagctggttttcgcatatcgcgattactgccgggacaccagaatggctggagccagtaaccgatgcgcaatatcaagcagttgaggaggcacggcaaaatggctaagaaacagactgcgggacgtgataacttgggagattttgcaccgcaattcgcgaagctgaacgatgatgttctgtttggtgaagtttggtcgcaagaaaatcaactgtcagcgcatgatcggagtttgattacggtggcgagcttgatgacgcaaggcgtcccacaacttgaggcacatattaaaattgcaaagcaaaatggggtcacaaaagatgaaatggtggcgttgattacacatctctctttttatactggatggcccaaggcatggtcagcattcgggttggccaagcaggtttatcaaaattaatataataaaacaggccaacttcaattagttggcctgttttattggcttagtaatggatgccagattagaatatacgtcaaaaacagcatgattgcgtgggttaaagatttgcaatgcagcttggtttgatagctttgtgcctgctggcgcgcggtgcacgatgtcgaatacaaagtgaatcgtcacctcagtttcgaacggaatagattgatcgatgtggacgatgatggtattgtcttgttgcttcactgagtattgctctgtgagtcgctgattattaacagtgacttcttcgtgattgtagcgtgcgaagggcttcaatgcagcccagtttgttttaaaggcgtagcaccgacgccgtttgtcgttgtatttaccatagtatcgaataaagacgtggtatttgccgtccgtccagcgatccatgacgtagtggcgaaagtgttttgattgcatacgattatttaccttcataaaaaagaatgtattagtatactagtcctgtttggccgtaaagtgaagaattgacatcaaatttaactaaattaaatagatttgactattgcaggagaatagttgtaatgttaagtgttcaattattcatggtagggagagaaaagagtgaaacataagaacagttatttttacataaaacattattttttgttgtttgtcggtattatcattatggcaatgagcgttgcattggccaaaattgctacattaggaacgtccccgatttcaagtgtgcccaatgttttgagtatcattacgccactaacaattgggcaaacgaccattattttcatgaccttggtgattgtattggaggctgttgtccttgggaaaaatttcaatcgcaagaatgtagttcaaattgtgccaacgattgtttttggtgaattaatcgatctgtttattcggatttttggatttattgatccgcacgcatattgggttaaattgtgtctcacaattattagcattggttgtctcgcgattggtgtgtttttcgaagttaattcgcggacaatcatgatggctggggaaggcattgcggccgcatttgcgtttcgtcttcgccagccattcgcgaaaatgaaagttcgagctgatattacaatggtggtgatggccgtgattttatcggtgatatttacgcagtcgcttgtcggtgttcgggaaggaacgattttatctgcgatctttactggtcgaattcttggattgatcgaagaccatatgccagcatttacaaagtgggtacaaaattaagagtgaccgacgaatcctttactaacaagattatgtatatagcaaataatcagaatgaaaaaggcgtgaacttagttgtatattacaagcacatttaatttcctaattgcagataaaacttaggaattcagatcgatctgtgtgcgttgcaagatatggattcgtgttaagctaacaccatcctgaaaaggatgcccaagtacgactgtcaaaccgatatcctgcgctgtctatttgatacttcatcggtttgaaaaaagttccgatcgcgaggcgatgatcggaactttttatgtggtcttaatgatctttggattgaattaattgttggcgcttagggctgacccacgttccagaaccaaatcctaatattgttttgagtgctgggataaacgttactgcaattgtgatagggttgatcatccaaaagaacagcatgtagaggggagcaaaaataagatattttaatttggccccgtgatgatccagaatcaaggcagcaagcagctgcaagaggccggccaacatttcaaatgtgacgaagataaatgacatttcaatgctatgaaagaagcgttccacgttacccgtcattaggaaatagagcagggttatcaaaaagatggcagttgtaatgatgaagaaaaacgaccacacgatggaaagcgttgagtcaatgaacattgataattggtagcggtgtttgatgggatggaagacaaattttttaatatttgtgagccaaacttctgtgccaccctgtgcccaacgctttcgttgcttgtatagatcaccgatagtttcgggaacgttcatatgaaaaacgatattgggtgcaaatcgtggaaccgcaccgatcatttgatgatcccaagcgatactaatatcttcggtggctcgattttgtcggaagccacccacgtcaatgagaaatgatttacgatacatggtattggcaccactataggcatacatcgaatcattgactgccgattgactacgttttatgacgcccacgatacttgaaaattcaactgtttgcgatttaccgattaatttggtgcgattttgaacatccatgttggcagtgacggccgaagtgttgaggtctcgatcgtgaatgaaataattcatatacttcatcaaggcgtcaggttcgggaattgtatcggcgtcattactgagaatgtagtcccctttagcaaagtacatgccaatattaaaggcgtgggctttacctttgtttttgacaatttcaaccattcgtagacgggggaaacgttgctctaaccgcttaatgatcgttgcagtttcgtcagttgaaccatcattcataacgagaatttcaaaattggtgtagttgagtcgttcaaacaggtatgtaatagtggattcgatcatgacctcttcattatgagcgggaatcataatcgtgatcattggttgatctttgggtgccagtacctgccaatcgttatcttcagagttaggtcttaaaaaacggtaagacagggcgccaaagaaccaaaagaaggcgcccgtaatagggtatagacaaaggatcagcatggcaattgtgatcactgtttggatagttgttgcttcaaaaatatgatcaatcatggataatgttagtctccgttcttaaacttataggtcgtcaagatgctgttggtcaaagagttggtgaatttcgtcggtatccagattttgatcactttcaactcgataatttcgaacagtctgccggaactgatcgtccccaaaccggtcattcataaatttatccagctcggtttcgcgggctttttgattgatcggattgaatgtaggccattgctctacaagacgatctcgcttgcgcgtctgaataatagtcattgagactgtgaaaataagggatacaaccgcgagaaataaaaggatgatcccgatgaattgaatctcaaaaataccttcatggtaacgccaaattggctggaccttgccgatcgttgtgccaagataactccaaacggtaatgaatacagggactaatacgcaaagccagcccataatcgcgacaaaagtttgccaaattttaaggccccagtgaccacggctgaagtaatcgtcagtatataattgttgtgaatcttgatgttgttgcttgactgacatagtgaactccttttcattagttactaataggatcaattggacggccaaataagtatccttggcgtaaatcaatatgcaattgttctgctagagattcgtcttcttcgttttcaatgcccgtcaatacaaggttgatatgttgttcttctgaaaagcggtgccagaactgcaggttaagatccagccaaatagaaggatcagttttacgaaaatcgcgcatggaacactttaatgtatcaatcactggtagcatccattcgatgctactgaggttagcgttgtccgtaccaatattatcgacatctagttgcataccgtatgattgtccttggcgaatatgatgaaggaaacggcctttattatggtaatgtgtcccaggttgaacgtttaattcgattgccaatttcatcggtgcaatcttgctaattgcccaacgcacaaaataatcaaattctggactgatgatttgatcgtattctaagttgatcgacagctgaattttttcggtcggtaatgacttgaaggtatcctccaataagaaaatgacacgttgtaggggcaatgtgtctagatttttaggaagtgtccaagaaccatcggtatttttttgtctcagaagacattcgtatcccgttaaatgaccgtttcgatcaacttgtttttgaatgaaataacgtagttcgaattgttgctgacctagatagttatttgaacgtttacgggagtgataaaagtacaggctaataatggtaattgaactggccagtaaaagcatggatagccagaataaccagaattcgagttgatgtagcaaaataacatcctcctaatataaggtatacaaaaagtagattgatttcattttagttaatattatttatgtcgtatagtagtatgcacgaatttgttgaaaaaacggcttttttcgcggtttatataacaaaaataacgcgcaacatcttgaactttcactgtaaatcgggtaacttatggttaaagagtaaacggtagaaaatatattttgtatgggagagataacagttggagaatcgagtcatgaatgacgatcggcagaacaaggtagtgtcgatgtataatacaggaaaaactgtgaatataaattataaacaacaagcccccgattatggcgatatgattagacagcgcgcacaaccggttatctgtgaaccgttggttcgtgatacgctcgactggttgactgtcagttacgactggttggactcagagacggtccaccgagttcttacatgccttgaaccccaaattgaacagttgaaagctgagcgacaaattgcggtggaccgcgcaaaagtttcgttgtgcgcacttaccgaattggatgcggcaaatccagccatacgggatagaacacgtatactacagcaattgctgcaatttgaaaagcatcatgtttcaaatgtgtcaactttggatatcgttcttgccacggaacatttaaatcaagcaataactcagtctcattgttcgagtcaacaaccaaagccgcatacgccatctttatcagatacgccgtttggacgactgaaacaattattaaaatcgtaaaaaggaccactcttggaaaagtaagagtgatcctttttaaaatcagttagttattatttccgatttcgttttgatatgcaggtaacatcgccttgtacgattggtacagtgcgatattggtatcgacatcattcatcagtgactcgtacattgtgaatagagcagtgttgagatcgtcttcatctgttttagattccagcatgatcaaaacgcgctgttttagaatcttaaatttttcatcatttcggatgagtactaattgtgcgtccttgtaggcttcggccattttttcgactaagggtgcttctaagttttcaaaacgactggactgaatgagggcaacctcatcttccgtaaatctatccgcatccaaaagggctaaatacgtgtcttcgtgacttttaaatgcttttgcatactcgaccaaatgcatgctttcacctcatttattattctagttactaatatagcgaaaactggcacgaatagctagtttttaattgactgaacggtgatttttaggtgacgtcaccatgtctaactttagcacattgtgacgggaaagataatccctttttggacgatccttaataaaaaaaccgtctgaagtagaagacggtttcaatgcatttatttgtcttggtgaatatgttgttgctgcaggtgacgctggttacgttttcgggcggtattattttgtgcatccagcttttgttgttgttctgcttgctttttttgcgcaatggcagccgccctttgttgcttttcttgtaaatagttttcggagattgattgccagttagcatctgaatcctggtggagggcttgaataaaacgttgaatggtgtgcttatctcgaagatctattggaatggcctcatacgcagcttggcactgatcgacaattgcttgttgggcgagataaggtcgttgaactttttgaaaagcaggatcgtcatccttaaaggtgacgctaaatggcgcaatattctcagcatattgctcattaatttgggatttaagatgagttagtttttcttgagtgggtgccagttcggtaatcttctttttggcgtaggtaatgagagcggccttgtactttttccaataaaagtagcgatagatcacgtaggcgatagcaaagaaggtggctacggtgtacaccatcgtgatggtccgttgtggcgtggtgtctttgggaaagtcaagtgtcttaccggtaataaaagcaatgattgcaattaccactaaaataacggtgaaaagaatggtttgtcggtcattctttttcttaatcggaactggattttcagcgagccgaagccgatcgtttgcacgatcaatctcagcctgaagctttgtgatttcaggatcttttagtgcggcctgttgttgattatgagcaaagatgccgtcgttcgttttttcaaatgctggtgcaagataacaatttcgcgcatcacgcaaggggatgagcttttggtactcctcatcataagacattgcctgccggaatgttttttcaagttctgagcgatccatggttgttagatccatcttgttgcctcccaaatgatatgttacctagtagtatagcgaattctgggagattaaaaaagggggcaaaccgtcaggcttgtccccaaaaataatcattaaacttctaagtcaataaagcgctgctgatcaaaatcgtagagtccttgatcagtgagcttaatggatggaataacgggaagtgtcaaaaatgaaagggtgataaagggattgaattcacggtttgtactgatctgttggtaggctgccgtgattgcagttaaatcttgtgctgcactctgataatcttttgcagacatgagaccggcaattgccaacggcattgtcgccagtactttttcatcgtcgacaacggtaatgccacctcccgcttgagtgacctcttcgacagcccgaaacatggctgtatcgctagttccgacaacgacgaggttatgagagtcatgagcaatggttgtcgcaatggcaccatgctgtaattcaaatcccttaaccagtccgaggccaacggttccaagatggtgatggcgctcaataacggccatctttaagatgtcgttattaagatcagcctgaaactgaccgttttcggttggaacatgtgttttgatgtgatcagtgacgatgtggtttggctgaatcccaatcacgtggcaatagtcactacttaatggtagtgccaaatcctgcaattgaagttgatggtgaacggtattgacaccaatttcagcgggatgactggtttgttccttgatccaatggccatttttcattactgcgtcgattttgacgttatggggatcgttaaggaaaactaggtctgcttggtaaccagacgccagtgcaccggtatgagctaaattatgagccattgcagcattgtaacttgccatcgtataagcgagttcaggacgaatgccaagttggatggccaatttgatacagtaatcaatcgatccttcactcattagatcatcaatcagtttatcatcagtacaaaatgaaaaatcttgagcgttactttcgttgacagcctgaatggtgtttgcaatatcacgttctacggttccttcacgaagaaatattgaaaagccagttgcgagtcgatcgttgatttcggcgacgtttcccgcctcatggtctgtgtgaatccctgcttgtcgataaacgtccagttgttcaactgataggccggcagcatgaccgtcagcatgataaccagcatcattagcatcttggattttagcaagtgtttcgggatctttggccagtactgaaggataatccatcacctcagcgagtccgtgaacctcggggtactgatatagtggctttagatcagccgctttgagtgtcgcaccggcgtgttcaaatggggtacaaggaacggaagagggaagcatgaaaaagacgtccatgggcgtttgacgagcatctttaatcatgtattcaatgcccgcctttcccatgacgtttgcaatttcgtgaggatcagtcacaattgcggtgaccccatgtttcaagagaactttaccgacttcactcggagtaaccatggaactttcaatgtgcacgtgggcgtcaatgaaacccggaacgatatatttatcacgggcatcaattatttttctagccgcgaaatcagtggttccaacggcaacaatggtttcatggtcgagccaaagatcgtgttgctcaaattgacgtttgaaaacatttagcacttgaccattcttgatacaggtatcgacagtacgcataatcattcttcctccaaagatattaagcattgatcaaatattatttgtcactttgagttgaatgtcaagcatctttaagttatatacattcgaaataggttattttaaaaatgaatatttaatcgtattttaggaatgaaagcaatactgcatattacgaatgactaatacagataaaagatagctaaaaaaagaaataaagcaaagctaaaacaaataatttatttgtaatattggcattaaaagtcgtaatttagcagtgttaaagtctgattacgaacctgtcgtatttttgtaacattttaacttgaaacggtattataacagcacttttaagagatatatgatgctttgacacattgggaaagttaagttatcttaacaactgttgatggtcttaattattgcttagaaactcaagttataatttcatttcgtagtacataaaattaaatggatcatttactgaaaggacaaacttatgaagcaaattggtgaagaaaagtatcattataaaatgtataaacaagggcgaaaatggatatttgcaagtattgctgccttatcgattggtgtgacggcatcggtcacggttgctcatgcggatactactgttagtgagttgggggcaacagctaatgcggttgcgacaaccagcagggcggccagcacatctgacgagcagcaagtgacgctcagcgctagtagcacggtgaattcaagtgcagcttctactgtgagtgtgagttcgacatcaagtagtactgcgacttcgactgccgatacgagtagcgcagcgactgacaccaatgatcaagccgccagtgtggcgagctcatcttcagcaactttgagtgccgcgagtgaaacggtgacaagcgcggctaatagtgtcgcaagtagtgtctcatcaagcacgagttcaagtgcggctagtgcatcaacgacggctgagagtgcctcatcctctgccactcaaacgacgacgctagtttcagaagacagtgcggctgtcgaaaccgcaaaatctgctgccgctgccgcctatgaggcaacgggagaggcgcaaacggttgttgcaacagcagctagttcagtaatggaacaaccaacgtacagttcgaatgctacgcagcaggcgttcattgaaagcttacaagatggcgcaattgctggttgggatgaatatggtgttttgccatcagtgacggttgcccaagcaattctcgaaagtggatggggcaagtcgacattgtcaactgaagctcataatctatttggtattaagggaacgtataatgggaattacgttaattatccaaccaaggaatatgtgaacggaagttacgtgacggtctatgccgaatttcgcgcctatgataataattctgaaagtgtcgaagatcacggctatttcctgtattcaaattcacgttacagtaacttactaggtgttacaaattacgaaacggttgctgaagatttacaatcagatgggtacgcgactgacccaagctatgcaagttcgttaattaaaattattgaagagtataatttaacacagttggatcaaattgcgttagcaggaacagccattgcatcggatagtacgacgagttcaacctcgacggctacggcgactggatcggagtactatacagttaagagcggtgatacactatcaaaaattgcgacaacctatggcaccacaaccgctaacttagtgtttttgaaccagattagtaatgccaacttgatttacgttggtgagcaattattagttagttctactgctagtgccgccagcgcagccgccagttctacggctactaccggtactgtaacgacttatacggttaaaagtggtgacacattatctgcgattgccagcaaatatggaacgacaaccgcggcattaaaatcattgaataatatcagtaacatcaacttgattaacgtgggacaggtgcttacgattactgcagccgcggccacaacggcttcaagtgccagtgcaacgaccacgacttatacagttaaaagtggcgatacgctatccgcgattgccgctaagtatgatacgactgtcagctcacttgtcagcgctaatcagattacaaacgccaatgcaatttacgtcggtgaaacgataaccctcagcacaacggccacaagttcttcaaccacgacgggaacaacgaattcaacgacgacctatacagtcacgagcggcgatacattgtccgcaattgctgctaaatacggaacaacggttagcacgctggtcagcaataacaatctcacaaatgctaatatgatttacgtgggacaaacattaacgcttagtgggagtaccaacaaaacgacctccagcacaaacacatcgacgagtaagacctatacagttaagagtggcgacactttatcaggaatcggtagccggtacggggtaagttggacgacattggcccagcttaacaacatttctagtccgtacaccatttatagtggtcaaataattaaattatagatagtggttcctatcattttttgttatttataaaaaaattgcggaaagtggttgcgcttacatttggttagtcatatactcactttatatccacttcaggatagtgggtatatctcttgtttggtatctgatggtactaacacttgtacttgtaaactccattcaaagcattcctttcggtcgaggaatgcttttttgtaaccagcaaaaaaaagccgatcgaagttgaccgactttaattaaggattaatgttattgaggtgctccttgattttgagcaggctgtttaggatatcttgatgttcagattttgtgagaggttcattgattaatgtatttagatcaataaagatcttttgaatatctgtaaccaatttttcaccagccgtggtaagaaagagattcttctgtcgctcgttgtcggcttgaatctttcttagaaggtaaccacgatcttccaatagttttaaaatattggtgacagtggcctgctttttgccgagatagtctgacaatgagcgctggatagttccagggtgaaggctaatgtagttgagactgcgggcttgtagcgtgttgagctgtagtgatttcaaccgatgggcgatatagttatgttgtagtgtgctaagagtgtaaattagctcacttgtatcatcctgttcaaacttcattaaatcaaattcctccctatttttcatgattcagtttaaaggagatcgagtgatttgacaatgggttgtataaaatgtattctgcaaatagttaaaattacaactatttgaaaggcggaatcaaaaatgtcgctaacggtcgcggaaaaaagagtaaccaaaaaagaactgcaacggaacttaatcctaagtggattaagcgaagaacaggttgcccgagatttaaaaacatccccgaaaacaattcaaaatatcctccaattaaaagtcacacacattgaagatccgtggattttgaaaagctatctagaggaacaaattctggaccaacaaaaaaatccccttccatttacggctttgaaaggagattatcaccaatattggtttttagatagtcgtcggattgaacggcgtcggttaggatagtcgcctagcgacgaagcaatttgtagtgcgcagtgatattacccgtgatgataaagatgatactgtcgattaataacaaggttacgatgacgttccgaccagcaaagaaggcaagaatgaggaccagtactaggataacgacggcaatgattgttagccattttgaaatagattttaaatgatagtaagttccgaggttttctttgagaatcgcctttttgctagcgcgctcatctttttgatctcggtaactcatgaatcctgcaaaaccaatgcagaatataaatagtaatacagcaaatagcatattcatagttaatcagtcgaacgtggcaatctaaagccatgttcatcctccatatagtcttattagtacctaatatatcatgaaattaagatttattcgaacaaatttgggagtcttattcaagacgatcttgaacctgtgtcgcaaatttgcgaattagggaagcatttgagctactgaacgtgaagacacgaccatcgaattcaaagcttagttggttagtatcattggtctgcagatgggtgatggcggctagtgggaaaagtagcacgtcatcaggggtaagttgaataattttttcgaatgtcagtgcaaggattgccgtttgcggaccatcattaacggtcaaggcgttaagaatggtttcatgctttttgagtgtgagactgatattagcgatcttttcagacggaaattggtcaatatcggcggttgatacgccaaatttaacaagcgcgtcgcgaattttattagattttttgtttgccatttttttgaatttatcgatatcacgaatctgctttttgatttgatcggcagataataaaatccggcccagcttcatttgatcggcctgaatttgagctttctggtagcattctttgcagatgatttctttatttgcaatacggtatctggcatgtggtggtcgaacgtttgttccacatacggcgcaagtctgtgttcctaaaattcccatgattgagtcactccattagttaactagtttagaaaacgctatcttttttaatcatggtgataatgataatacgaaaacgggatcagagctagcaaataaactagtttttgtaaataaatctaagaagatggcgaattttgtgatcttatccgttaattcagaggcgaataactaatacatgacgctaattgtgactaatcagtttgtagatataaacagccggacaaaaagagtagtttttgtccggctgtttaaaattaaaatgtgttatccgcaatggcggctagtactgactttgaagggatgaagaagacctcaccagagaccggcgttgaaaaatcgagaagtcggtcggattttgtaaacattccttctaacatccgcttggtgacctgccagtggcgagcgtaaccaatgaaataagtgccattttccttttcactggggtttgagaaggggacgttcatgcgaacaattttatgttcaatgccgtctttattatcttgagaaacaacgttgtgcgcgttagctgctttttgatcatcatcaagttcaatgtcattgaacttctttcgaccaattgcggcttcttgttgttcgacctttaatttattccaagcgtccatgttgtgcatgtatttttgagcaaaagcataggaaccgttaataaattgtggatcctcatccccaatgatggcatattcaggggtgtccaatgcactgggattttcagtgccatccacaaacccaatgattgcgcgaccttcgaagtaacggaacccatgagtttcatcgacaaccgtcacatggtctcccaaaatcgtcataatttcggacatgagttcgaatggaattgcggagttgcgggcccgaatatggaaaaaaagatcagccggtgtggcaggagcagtatatttaggtcccgtaataggggcaaatgcttctagttcggcaggccgcggtgcatctggaaataaataatcccaggcacggcgcgaaaaaccaaaagcaacggctaatttagcatctggataacggacatttaaactattgatgaatgcgggtaagtgttcagctaagttagcgattatttcctgatcatgggttaaatcatcgcgtttaagcataagtgttgaaaaaataatattttcaccggcatctttgtaaacgtcttggacgtctttaaggtcgattgacataaactatcgtctccctagttttgattgattctaaactagtttcagtttaacataggtcgattcagatcgaaaatgatttgataaaaaaagaccggcaaaggtggccggtcaaaaggttacttggtggattgtgcctcaagctggtctaacagctgtgagtaataattgtgtgataagacgacaacgtcatcgtccagttcttctgattgctgaatgcggaccatcttgttggtctgaacaatgttctcgatgatggagtcttgtttacactgaaaatctttggctgaatatgtctgcatagaattcacactccccgctaatagatttctttgttaaaggttattatggacctacttgggggtaaatgtaaattaaaattggtaattttatgaaaccggtaccacaaacgctggtaagccgttgataatttcaaatgtgacacgaaaaaggccttaaacttagtctttcaggaagtcagatagacagtcaacaattaattgatgatcttcttccgatagcataccagaaactgcaatcgtgccaactaacccagttccgatgacattaattggaaaggcgcctccggccgcagcatagtctttggcaggaagtaaactggcttcctcaagtgatcgatgctcttgttcacatttaagctgtaaggcgagactactttgaccaaagtggtagaccgtgttgattttacgctgtaaccactgatcgttgtcgatggcggtgccaggtagcgcagcatggaaaagctgttgatggcaacgcgtaatatcgatcgtcacagcggctcttttcgcttgtgcacgggcaacgagttggttgcccagcacccaagcatcgtcatttgtgaagtggttaaattgaagggttgtttcctgttttgcgacatcagtaatcgtgagcatttgtatcagctcctttatttgagttggaatgaatctggtgtgtactgcataaattcaatttgattgccatcgggatcttctgaccagagttgataagatttgtctgggccaaacttgatctcactattcaccggcaatcccttagcctccagttcagatttaacagcttcaagatcatcaacttctagactgaggtgcagatagccatttaaatcataaccatgggttgcctttggtaggccttcggaatcatagaagagttccaaaaactggccaggttgaatttctaagtagttaatccaaggctttccattttcatcgggaagctcaaatttttgagtgaagccgagtccatcgcagtagtaggctaatgcttgtttcatgtcggttactttaaacgatgcgtgtgcaattcgattgattttcatttgaattcctccagttgtatgactgagttaaaagataagggcactttcttctgttggtccccagaatccgttatctaggtaaccggttggaagcggggccggcttctcgaacgtagattgaagttcgtagatctggctttgattggcactaatgtacataccatgaataagctcgaatacatggtatgccatttccatgctggcccgatgtggtcgctgtttggtaattgaccaggccatctccgcagctccgaggccgcgtgagttttcacgatagccgtgtgagaatggaaaattgacggggtcattattaggcttctgtagaatatttggtgagtcaaaattattcggatcaccaagtttaagcgttccctcatccccaaatagtgtgaggacgggatcttcggcaagaatattttcagagttaaaatgcaccgtacataacgtgccattttcatattcaacgatggcagtaacaatgttttgggcttcaacggtacttgattcgccaaaccatgggcgatcagtacgtttaccaagtcgttcgggacgataccgacggccaaaggcactaacgcgtactgctggcccaagaatgctggccagagcagtcatgtagtagcagccagtgtcaaatggcaaggtcccaccaacttgattcatatggggaaaaatatcagcgtatacgtcaaagtcacggtttaaagaaacaattgcggaaagtgggtgaccaattagtcccttatcgacgatgtagcgggcggtttggataccagcacccaaaaaagtatcgggagccacgccgagacgaacatgattttccttagccaactggcagagttcctgcccgtcctcaagattaacggcaatcattttttccgagaatacgtgtttatggtgttcaagggcctgtttgatgacgtcataatgtgctttgggatttgtcaggttgatgatcatttgaatttgatcatcagcgagaatcgcctcgtaggacattgcacgaagatgatagttatttgcggtattagccattttgtcttcattaagatcgaagcaggcaaccacatcaataattttaaatttattttggagcgactgaatgtagatatcgctaatcacaccacaaccaataatggcggcgcgaagtggggtaatgttcataggtcagggacctcctaatttttaaaatggtgacggcaaaattgctaagggctcaggcagataaaaggtgttatcagtcagcgtcagtcttccggtgtgggcatctcgtttgaagatactgagagagtcggagcgctgatttgcaaccaataggtattgatcctgagccgttaagcgaatgtcccatggaaaatcaccatcaactttaatattttggattgcagataattggccatcggtttggattgcaaaaacggcaatactgttataacctcggtttgaaacgtataagaaccggttgtcgctagaaatgcggatcgcagctgcaccgttatgcgccgtccacgtggtggggatggtatgatcaatagcaagggtggtgaattggccggtgccagcatcataagacagggtcgcaacctgactactgagttcaccgaccacgtacgcaatggataagtcgtggttaaagcgaagatggcgggggccaaaaccagccggtaagaaatggcgtgcgactaagtgaaagtgatgggtctcagtgacgttgtacgtaaaaattgtgtcgaccccgagatcacagacgactagacggtgatctggtgtttggttgatgaagtggggatgagggccatcgcgttgttcgatttgggggccgttggtaccggtgtcagcaatgcgatcaacgagtttcaattgatactgcttaacttcatagatactgagctcgtttaaatcgtaatttgcaagataaaccagctggcggtttgaatcataagcaagataggttcctgaggcagatgagtcaaaactctgtcccagtgtctggtactgatcgttcaggcattgaacgcctcctggctgtgcttgatttagttggcgatcgatgcacagcagtgtgtgatcgggtccagcagccagataaaagggatcaccacttggtattaccaagcgtaattgctgcgcagttccgctacgtgagtcaaaattaaaagaatagacgccttggctgacgcggcgggtataggttccaagaaaaaatgtttccatatgattcacctcaattcatatatgaaaccgttatcatatattgtactcaaggctaacgtaattgaaatagcagaaagtgtctattttttgtcaaatcattactaaaattggtatgactaaaataattgtttccacaggctgattgttctatactgaatcggataaataagcagggagtgttcatattttgtactcacaaaatgaaaaatttgatcagttagaaactaaattacgagcagaaaagggtcagaatcagcagcaaatttgtcaggtaatggctaaaattgaaggtcaaccactggcacaatggtttgatattttatctggggcattcattgttgcagccagtcaaggtattaagcaggcgacaacggaccaattgacccggtctaagcaaaagcacgatgatgatcgcattgatcagattactaatagtttattcaagcgattttgtgacgcggccgcggatcctaagcaacggatcgcacggtaccttaatgatgatatttccaatattttggagcgctctgccaatgtcaaaacgtgggaggcatatgttaaaagtgagcacaagcaattgttgcttgctcaactactctatatttggtatctcggttggcagcgtggatacgcgtttaccgttgaaattgatatgttggtggcaaagaagcaaagtaatgatcctcgatttgataaaatgggggatgcgcaaattaaggctgccagcactaaaatttcagaaactgaaagtacgcgtgttttagcagaaatattccatgatgcgcaagcacaagaacgcatttatttgatgattctcgcgtacttagaaacaggggaaaaataaccaagatttgatgagatacatgaggtcaggcaagttgtctggcttttttgtatcccgtcaattcttggttataaaatgacattaattgttaaaaataggcggtgtagaataggtatccggcaagtccaaatgccgcaaaggcaacgatgattcgcagtggacgtactgggacgtgacgaattaaaacgggtccgagatagccgcccaaaaacattccggcacccatggggagaaccatccaccagtagacctttgttgtaaacgcgtagatggcgagtgagagggtattggtgacaaaagtggtaaagtttttaatcgcgttagtgaccgcgaatgatttatttaaagttaccattagaattgatagtaagatcataccagccgaggccccgaaatagccaatgtacacaccaactagaaagatggcaacgtatttaagaaatgtgatgatggggcgttcgctcgtgtgcgttggagttgtcggtcgtttgtggaactgagagtacagcatcagaatgccagatccaaaaatcaaaaaaggcacaatcttttcaaaagtcgaagctggcgcgtaagcgaggataatactaccaaagataccaccgacgagggcgactgcagcaacgtgccaagtcgtttgtcgatccgtcttcaactcttttgtggaagacattagtgagccaacaccggtgaatactagagctgccgtgttggtggtattagcactaaccggtggcaccccaagtgctagtagtactggatatgatacaagtgatgccagaccagcgactgcggcaagaaaaccagcggcaagacccgcaagaaatagaataatgatcattgataatagggacaagacaaagaactcctttagttaatttgtgatcgagcataaattatgtaaatcggcaatacacgtatcaaggccatgagattggtggatctcatggccttgagtataagaaatgaggtttaatgaatgatcgtggaatagttgagttgcactaacgatggtgttgaaattaatagaacgtttttcgttgtaagcagaatcggtggtgtgtaactgagctgtggatacgagcgattggtgatctgcaatatcggttcagtcatcataattcactcctttgcaggactaaagtgactaaaaagaaaatcggtgttacaaaagaatatacgcaaacgacatctcctaatgtaacccctatcatagcacaaaaattaaatgaagggctaaaatatgaaatgcgaatttgataaaaatttaattcaatatttcctgatttacttatcgattgaatagaattaatcgaatccaataaattagtgaaaaagctaaaatttattggaaataaattttcaaaatcgctcgctttttcatcaagaatatagttgatgctataaacttgataagtgactataagaaatagataaatattacaataatatttttacttgaaatagttacttggtttgttatgattagaataatctcatttaaaggagtgactaattatgtacttagtgaaagtcggatataaatggattggtaaacccaataagaaaggtcattttagcttagttgacaatgtgaagcacgcattcaattttaagaactatgatcatgcggctaagtattcagaattggttgctggaaaagtacaattagccggataatgatcacactatgaaaatagttaaattttactatgattgtgaaaatcaaatggcgattgtggatcgaagtggtatactcgtaacgtgaatgaagaagtcacggtctttattcactcccttgagataactcagggcaaaccaacgaaggattcctactcgggaatccttttttattgaaaaaataagagctgccacgttttttacgcgggagctcttattttggtggatattaactattttttgcgacggagaccgccaagaacaagtgcacttgatgccagcatcatgccgatcaatgctaatagaccggagtttttggcatcactagtttgcggaagaatagacgatgttgctttatccgctgattgttgaagcttgtcggtactggtttgcgcggtggcattgttttgtgctgttggcatggcaatgcgcttcgttgccgttttggtgaccacattaccatccgtgctaatcatctcgttttgggaggcagctgaacgggcagcctgtttagttgatgaatgagtattagaagcgggagctgtagtagttgttgactgtttagttgtcgaacccgttgctgaggatgcagttgtggtcgattttgctacggatgagttgactactgttgtcggtgctgagatatcaactagtgcattttcggcaatatcgttgttttgggcggtagcatcggaagactgcgtattatcataataatcagtttgagtgacaaatacaggagccacgcttgtcttcttaatggcgggtgtagttgtatcagtggctatatctggaactacggttgctgcggtgttttcttcgttgtcactagtaacttgtgaagacgtcgctgttgtggcactagttgttgaagaattgaccggctgtgtggtagccgtacttgccgcagtgcttgcttgtttaattgtggtattaaccgcttcaagagtggctaatttagtttgtgcattcgttaatgctaattcagcgcgctgctgatttgtacgtgcaactgccagctgtgtttgggcagcctgattggtcgccgtaagtttggccagattctcctgggccgcggttaaattagcttgagcggcagttactgcagcttgcgcattggcgacggattcagcatatgatgaaaggtcaatagttgtcacctgatgtgctgcttgggcgactgtggaagtgaggagatcactattggtttgtgcttgcgcgtattcttggctatttttggctttgaggttgctatcgatataaggggcagggctagtgtcaccacttaattggtatagttgcgcaaggacagtattagcttgcttaattgagacgaggtcaacgttaccagcaaccatagtacttagaatgttcttggcagtttggatagcagcggtcagctcagtgctcgggttagttttagtagatgcgtggttgacttcggtttgtagggccgagcgaagcgtccgccattgattatagttttcgttagagtactgggccttggtaggtgctgtggtgtagccgttatattgttcgaacagagattgactgccgttggcagcggctaaattatcttgataaacaatacgtgagattttaacagttgcttgttcgtatgctgagtagtggacattgttagcactaatgttgggaacggtagcgctcataatatcgtcgttatcactatcgtgcatgataccgagtgtatgtcccagttcatggatgagcacggtagcggcatcataaccgtacgcttcaatggcagaattattgagatttagtgtgccgtcagtggattgggtagctaaaatgttggctaaatcattgttaaaatcggtaatgatcaatgtcgctggatgagcggtgctggcagcggcaaagagcgtcatgccagagttggtattccaccagttagccgcttgagacaccgcgttagcatattgtgtttgtgacgcatcatagtacacagttccgtccatggcatatctagttgcggtactgttcgtgctgcccgcattggaaagtgatgtattggctgacgctgcctgcatatcctgtgaagtttgcgcattgacactggttgcacggacggcttctgaactattttcggatgccaaggttgctttctgagcactggaagcagctacttgaacagccgttgctgaagatacagccgatgtttgagcagattgtgcggttgccaacttttgattggctgttgccagcgtggtgctagcttctgagaccgcactttgagcagtgataacttcgttactagtctgagccgcggtactttgtgcggcagctactgattggctagcactggctacttcggtttgtgcagaagacactgttgattgggcattctccacggcaacagtgtcggctgtagaagctgtcgacgaaatagttgcaacgctggtagtggcgatactatctgcgctagcattttgtggggtaccaacggcaacaattcccaaggttgttgcagccagtccagcaataatccacttcttgccatccttatacattttgaaccgattaacttgattatccatattaatgctacttctccatttcctgttgtaattataatgagcgactaatgaaatttgatcggataaagagcagacaaaaaacgatattggtttttgttataactacgcaaatcagaggattgtacgacacctaaaagaattattatcgttataatacgtaactacgtatacacgtaatacgagggttgtacatgataaaaagataagatttaagagcggttaataaaaaaataacccttaaatctaatttttgtataacccgaaaaccgtggctaactcctttaaccaattgacttcacgagtataaactggaataaaatgaagtcaataaaaaaataaaatgaaagcgaaaatatagttaaaaaattaaaaatcaatgagaatacgcatgtatacttctggatgatccttgaaaattcctaataattattaagtcattaattttgaatgctttttaagtgaaatttataataaaatgatgaaatccattagattatgttaaatgaaaaataagttaacttgctttttacaatgaaaaattcattcgaatggtcactttaaaaaaacaggattaataataagacttgctctcaagtgcacttgagggtttagattttaatttaaagggaggaaaaaataatgaaaaaaattattgtaactggcggatcaggatatgttgcggagtgggttatcagcgatttgctgaaccatgattatcgggtacacgcgagtttgagaagtatacaaaaagaagcaagggttcggactgcaattagtagtctggttgatactgaaaagatgaaacagttatcgttttttcaagcagatttaactcgtgcgaatggttgggcaaatgaaatggtgggtgctgattcagtttttcatattgcatcaccgttaggaactggtactgaaacggaagcagaacttgtgagcattgccaaaaatggcacgctaaatgtgttgagaggtgctaaaattgcgggtgtaaaaaggatcatcatgattagttcgcaggctgccgcaactgctcgacgatcagtgggtaaacttaagctcgacgataactattggactgatatgagcaatcctgaacttgttccctattatatttcgaaggtagaagctgaaaaagctgcatggaaatttgccaagcaaaatggtctcgatcttacaacgctattaccaggtggaatttttggaccgttattggattcacatgttcaaagtagtaatgcattggtcagtgaattgattaaaatgtcactggtacctaaagccaacattgaggtaacggatgttcgtgatctggtggctgcaatgcgcttagcattaaacacaccagctgcaattaataagcgatataatgtaggtaccactcccacaacctttctcaaaatagtgcatacttttcagcaggatggtattcggtctaaaaaacttacactagcgattcctaatggggtggttaagtttgcgtccaagtttcagccatcgttacgccagcttctgccacaactaggagttaaatattggcatgacagtacacgcgcacatgatgagctgcactggcacaatcgttgttggcaagagactatggaagatagtgcgactagtcttaaggaatgggggatcattgagacgaggagataactttatgtgtgagagtattcaacaaatatcgaaaagatatgatgtttcagtagcaaccttgcgttattacgataaaattgggttgttaccacggctaactcgtgataacagtggctaccggcaatttacaaaagatgactgtagtgacctagaaatggtaatttgttttcgtaatttaggcgtcggtgttaaggaaattgcggcagtgatggctccggtaacaaatgtaaatactcggtctcgtaaactatccttaattgaaaagcaaaagaatcgtctgttggtacaggcggttaacatacagatgggattactcatgattgccattaaacaacaaatttatcaaaaccccgaagttccctcaaagcagcatgcacggcaggtgatccgcgactatgttgaaaaaaagttacttagcacagcacctgagaacgcactggaaatgacattagccaatgatgaaaataatgattggtttgccacagcagatagaccccttatttcacgtgcaatacggttatacatgacggttcaggactgaatttaagcacactagtttcagtgaaatggatcgtgagttaagtttttagattggtcagtaaatctaattgagaaatgctaactgaccacattttttaaaaatgttatttatttgtaaaggagagtaaatagcatggtggaattggttgtaataaactcagcgatggttgggataaaccaaagctcaataacgggagttgcatggatagatacgtttctagataacttttttttcaaaaggttaaaaaagggatgtgaaatgtatcatttggatttaatcatgtttaatcgatttgatgatgatttactattagatagtgataaaaattatttgataaattcaagtttgatagatgtaattggtaaagataaactagcgaaaataaactatttagtttatgatactggtacaattttttctaaagatggtgtcaatagaatttgtgaacaactcaataatcactttaatttagtgcattaatagcaacctaaataaaatatgtacttgtggtcataacttgcttaaatttgataacggttcggcaatttgttttctcggcaatgctcaaaattaaatctcccttatgaagtatggtgaatacgtgataagaatttcgaatgtattcacgaacaagttctgcaaaaatggactaccaaaaacggaagagaggtatgtccattttgtgtgggttattgaagaaagttcacataacaaaaagcagagtcccttgaaaatcaattcaagagattctgcttattttttttacttattagtcctatagcttattcaccagtaaacttagcatgccgtttttcaagaaatgcttgcataccttcagtttgatctttagtggcaaacgtttgagcccacatctgagtttcaaacgaaatggcggtgttgagctcaaggtcggctccttgatcaatcacgtatttagccattcgtacggcaactggtccatttttcatgatcttatgagcgatttcattaactttatccatgagttggtcaagttcgacaacttcttcaaccgcgccgattgcgtgtgcttctttggccgtaatttggctacctgttgcaataatttcttttgcctttccacgaccaactagtcgggtaagccgttgagtgccgccaaatcccggtacaatacctaaaccgacttcgggttggccgaacttagcactagtggctgcaacacggatgtcacaggagttggctaactcaaaaccaccaccgaggcagtatccattaacggcagcaatggtaatttgtggcaaggactcgattgtacggaaggcattatgtgccaattcggatagggcagcagcttcaatcgagttcatcgagaccatttgcgaaatgtctgcaccggcgacgaatgctttttgacctgatccggtgatgacgagtactttgacggttggatcggtcttaatttctgcgagtgcttcgccaatttcggcaagcgtatccgaattaagcgcattaagtgacttaggtcgattaatcgttagtgtgccgattccatctgcaacagtaaacaataagttttgatattctttcatgattaacatcctttcgggagacgtgaatcataaacactttccaactttatgatatctatttcacaatcatttgtatagaccgaaaatttgtttttatgagtgatatatgagttttaaatatagggaaatggctttatattaaggctattttgcgtttataacataatgttatggattgcatgaattaaaatacagatttacgtgcgatggtgaatcatgataagttgcatgtgcaaatagttgcaaaatatcagaaggagggatttcaatgtcgggcgatttggagatgagactagcagcggaattttttggaacgatgatattgattgtatttggaaatggcgcggtcgctaacatggccctggagacaactaccggacggcacgatggtggttggttattcgtggcactagggtatggatttggggttatgattccagcatttatgttcggttcaatttcaggtaatcatctaaatcctgcaattacaattgcgtttgctagcgtggggttatttccatggaacgaggtaatcggctacattagtgctcagtttgcgggcgcaattgtgggacaattgattgtcattagttgttactggccgttttatcgacgaactcatgacgaagccgcggttttaatgacgtttgcaacaggagacggcgccgatagtgcgactaacggatttgtgaacgaagctttagggacattatttttagtattcggtgcactaggtgcttatcacggaatgtttgttaaaacgaacatcgacttagccaatattgcggttgggttattgattatgacactagtgatttcgatgggcggtgccacgggaccagcgctgaatccagcacgggatctggggccacggatggtgcatgcactattaccaattccaaataaggggacatcaaattggcggtatagttgggtgccagtcgtcgcaccaattgtcggtggaattctcggtgctattttattcgtgatctttttccctgttaaataaactttgtgaaaaatatacgttaaaatctggcccaatgcttgataattcaagctcataacatatggttatcgacgatatgaaaattgagtatttgtgaaaaatatagaaagcggttacatttagagcagagataattatctaagaacaacagacaagcttgtttgattactgtcacttgtgaatgctcgaattaaggcggcgaatctcatggaaaagtaccatacaattacagaagacgagattgaagttgggatgacaagtgaattttgtaaggaggtaactcaagagaatatcgaacgatttgcacagattacgggcgatgagaatccgcttcatatggatgatgaatttgcgagtcaaacccagtttggtggccgaattgcacacggaatgtattctgcatcactgatttcggcagtgattggaatgaagatgcccggaccgggtgcagtgtatcttggtcagacgctgaatttcaaggcaccagttcattttggagatgtactggttgcacaagcgacagtcgcaaaaattgttacaaaagccaagtttaaaattgttgagattgagacaaaggttacaaatcaaaatggaacgattgttaccgatggacaggcaactgtcattcctgcaaaaaaataaactaactcgtttaagatggttcataaacactttccagtttaaaaaccacagtctaaaacaaaggggtaatcagcatgtcaggaaaaatggttaaaatcaatcaaaaattcatgggaaatgtcgctcggagtgttaatccttatgggtgtcgtcaagagattctcaaccaaatcagttatgttgagaataaggggcactacgatggtgcgaagaaggcgttaatcattggtggttcatctagctacggccttgccagtcgaattacacaagcctttggatctggtgcagataccattagcgtagcctttgaacggccggtcaaagatgaaacaatgcttgggacagctggttggtggaataatatctatttcaagcaggaagccgagaaggcggggttaattgcgaagaacttcaatggagattgctttactaaggacatgaaacaacaggtgacagactatattaagtcagaatttggtggaaaaattgatttactcgtttattctgtcgcggcaccaaaacgaacgaatccggagaaccccgatgaagtatggcgctcacagattaagcccgtgggcaagacggtgacgggctataacgttaatcttgaaaaaaatgaactatttgaacaaagtattgaaggcgcaacccaggatgaaattgatgcaacgattcacgtgatgggtggtgaagattgggaactttgggttcaatttttgaaggatgcaggtgtattggccgacgggtttaaaaccattttgtattcgtacattggctctcccgttacgtatgaattttaccacgaaggtaccttaggaaaggcgaaggatgctgctgaagcatcatcacacaagattcaaaaaatgattgatgatattcatggaaagtcgttaattagtgtctcaaaagctgtgacaacgaaagcttcggttgtgattccaatcttcccagtgtactgcattgcactatataaagtaatgcttgaaaaaggcacccatgagacaccgatcatgcataaggatcgtttatttagagatatggtttatggagacaagcctgaaattgatgatcgtggccgactccgtccagatgcttgggaacaagatgcggatacccaagccaaaacagtagcattaatgaaacagatcacacctgagaacttcaacacggatttgacagcttacgatacgtttagaaaagaattcatgcaaatcaatggatttgaagttgagggtgcggacaacgacagtgttgactacgatgaaattacgcaattacggccataggagatgttcaatatgtcagtgaaatttgttaatagtaaagcagtcattagtgaaattcctgacggtgcaaccatcgctctggaaggatttctaggatcagatgtaccggaagaaattctggaaaacttacatcaaacctatcttgaaactggacatccgcgtaatttgacggtgtatcatgcctctgggattggcgatgggaagaatcggggaactaataatctagcagagccagggatgattaaacggatcgttggcggacattgggcactcgcacctaaactagaaccgctcgtcgaagaaaataaaattgaagcgtactgcttcccccagggagttctctcacagatttttcgggactctgcggcgcacaagccactgcatattacccgtgttggattaggtacctttattgatcctgatttacaagggggcaaacttaataccgcggctaaagaagatctagtctccaaaatgattatcaagggtaaggcgtatttggcatatgaagtaccacgccccaacgtagccttactcagaggatcgtacgctgatgaggatggcaatattacctttgaagatgaaccattaacattggaatcgacggcaatcgcaatggccgctcacaataacggtggtaaggtgatcgtgtctgtgaaacggatagttaaacggggatcaatggcgccaaaggacattcgaattcccgggttactggtggattgtgtctgtgaaacgaatgatgaaacgatgacacagcaaagcacggctaccaattataatccagattttgttaaggcatccgttattaaggcggctggagcaattaatgtaccattagatgttaaaaaggtgattgcacggcgggcagcaatgtttttacagcctgaagatcgcgtcgtgaactatgggattggtaagtatccagaaacggtatctttagtactcaaggaagaaaatgccgccaaccatattattacgacagttgagcctgggacctttggtggggtgccacttggtggcggtgacttcgggtgtgcgatttcaccgcagtcaacaattgatcagccatatatgttcgatttctatgatggtgggggaattgatatcacattcttggggctagccgagttagatcagcatggcaacatcaatgtatcaaaatttggtcctaaaattgccggagttggtggatttgtcaatattacacaaaacaccaaaacgaccgtgtacacggggaccttcactgcgggcggattctgcgcaacagttgcggatggccaactaaagatcacgcaggaaggtaagaaagataaactggttcaggacgttgaacaaattacgtttagcggtcatgttgcctatgagaacggacaaaatgtctactatgtgactgaaagagccgtatttaaactggttgcggatggtatcgaattgattgaaattgcaccgggagttgatttgtaccgtgatgtgctaaatcatatggcgtttaagccattaattagcgacgaccttaagtacatggacaagcgtattttcgaaccagcaaaaatgggaagtgttgtgaatgaggcgacacaatccgtggctgtgacaaattagtgtttatctgaatgcataaaaaagttatggaaccattcctgggtgaagtcaacaacgggttcgtgtttggcattatccagggtacataggctgatattccacgggaagaacggtttaacctgacggtgttcaatgtctgtgccggcaaaattacgaccaattggcgaggccattaaggtcacaacgtttagtttctcacacatattgagaattaaatcccatgaacctgattggaagaaaaagtgtggttcaatttgaagtttacgtaaccgctgtttccattgataggtcaccatgaagctgtcatcgagggacacaattttttctttagcaatttcttcaaaggggatcgatccagcaaaatcatggaatcgatggtgtttattaaaccaaactgaaactgaatcgcgcacaataatgtcttcgtggatgccaggataggtggccggtgaaactaggaccgcgatatcaatatcttgtaacatgagcattttttgaagttcataagcaccagtttcgataactttgagatcgattaacggattttcttgaataaagtgtggaatagcttcattgaagagcgtggaaataatgacgggggcaatcccgattcgaacggtaccttgattttcctgagcggtggaatggaatgccgccagcatttggttaaattcgtggtcaagttttcgaccacgatcaatgagttcttcaccggagtcggttaagccaataatgcggttgcgttttcgggtaaaaacggccttatcttctgttcgctcaagttcactgataaatttactaagtgctggttgtgaaatgtgtaaacgagttgctgcctttgttaaattgtaaccgctatcaacgatgcagattaaatactcgatatgcttaatatccatgatggcctccatgtctttttcgaagggatgcgtgtctaattatgaaacagttagaatccatttattataacgatttactcgcctctattatacatgatcaaacagctacaaaccctataattattggtatatcgggcaacgtggcagttggaaaatcaacatttgccaaacgattagtgagacgattacaacagacgctgaccgataaaaaagttgagttaatctgtaccgatgattttttgtttgccaatcaagttttgagacaaaaagcgttgtttgaccggaagggatttccagaaagctatgatttgaagttagttgatgattttattgaagcattggcaactcatcaatcgattgtgctaccgatttacgatcaccgaattaacgatgttagtgctcgtcttacttacattaattgtcccgatattgtggtggtggaggggctaatggcgatgcaggcgcccttttatgaattgctggatgttggtgtttttttagaagctgcagctgatgatacctaccagtggtatcaagaacgttgtcaaaaagctcatatggatgaatggcaatctaagaactttcagcaaatggttgcgactgcatgggcggaagtggatgttcctaattatcagcaatatgtagcacctaccaaacaatatgcggatgttgtactaacttttgatcgcgatcaccaattaatcgatatgtgtcggcaacagccgatgaaaggaggacattgtgatgcagtttataactagtgatggggtgtcattggagtatacagatcaagggcacggaatgccggttgtgatcacgaccggctatgcgggctttaaagaaatatgggcgcaacaagttaaatgcctgttgacgcacggctatcgggttattaacttagatcgacggaatcacggacgctcgcagccaacgtctaagggattgcggatgagccgtcagggaaaggatattcaggaattattaagttatcttagaatttcacgctttaacgcgatgggaaattctatgggtgctgcagctttttgggcatattgttccttatttggtgatcaaaaactcaataaaatgatctccgtggatcaatcaccaaaaatgattacggatagtagttggccctatggccttctcgacttaacttggcaaaattttccacgcgcatctgaaaaaatgtatggcgtaaaaacaactgtgaaacgaatcgatgacgatacttatcgaacactcaaacgtgcacaacgtggctatcaatttgattatgatttaaatcggccactgctgtatgaccatgcatttcaggattggcgagatgtgattagtgaaataacctgtccgctgctctttgtggcaggtgcacaaagcccattttggtcaagtgatcatgcgcaggccgcggcggatttaagtttaagaggccaagccgtagtggtggaacatgcaggccatattgtgatggctgaacagacgcgccaatttaatgaattgatgattaatttttttgatgagcaataatttgaacacacttctaaaattcgtgagaatcgaagaagtgttttttattgattgtcacagcggtagaaagtgaggccatgatggtctgaattaaaggcgatgaaagtgtcagattaaaaatgagtactattcatatacggatgaacggagtaaaatactatagtatttacacagctatacatacattaattaaatgaaacatatttgagggtaaaaaatgtatcgatatttcattcaaccgcaactgaataaatttaataattcgattattggctatgaattgctcattcgagagttgattgatgatcgatggaagctaccacagtatttttctgatattccgactgacattatggtggatacgttattgaaaacgaccgcgtccctagcgctaaaagttggtgcagtgtcctttaacttgaaccgaactcaaatcatgaacgaggcagttgatgatgccttaatgcgatgtcaagatcgactgagacccctgaaactaattattgaggtgacagaagaaccaggggatgaaaagatctctaatcaggaattattaggcatgttgagccggttttgggaacacggaatggatatttcacttgatgacgttggcactggtgaaaatagttatgagcatattaaagattttttgccaattactgcggaattaaaatttgcattacagaattttgatgaacatatccaagatcgttcactacagcgccggattaggcgatggcaaaaaattgctcatgataatcggcagcgattcattattgaaggaattgaggatcgcactgacgatcaagttgctgatcaattggagattaaataccggcagggatattactatggcaaaccacacttattaaaaattgaaaaaacggaccatgaatgaagatttgaggataaagtagttatgagagttgcaattattggatgtacacatgcggggctatccgccgcaattcagattttgactgagcaaccaagtgctcaggtaacggtatatgaaagaaatgataatgtttcttttttgtcatgcggcatcgccctttatttaagccagcaagtagcagagcttcaagatatgatgtatttttcaccagagcagctgagtgaattaggggcccgagtgaaaattcgacacgacgtcttaaaagttaatacgaagcgaaaagtactgctttgtcaggatatgacgacgaaggtcatctttcaggaccattatgataagctgattattgcaaccggttcatatgtgaatgtaccaccgattattggtgttgacgattcacgggttctgttttgtaagggctatgaacaggcgcaaagaatcaaacgccaagctgaaaaaagtcataccattgccgtaattggtggtggatattcgggtgttgaaatcgctgaaagcttcgcaaccacgggacatgacgtgatcctgattcaaggcaatgatcaattacttaataattatgttgatccttttttatcacaagaggtggtaacgctactacgtgaacatcaagtgaaggttttgatcaatgatcgtgttaatgcatttatcagtgatggtgatcaggttggcattcaaacacagcatgaattactccgcgccgatttggcaattgtatgtaccggatttagtgcgaatacggaactagttagtgatcaggttgaagttgatcgacatgatgcgatcattaccaatcgctatatgcaaacgtctgatccagatgtatatgcagcgggtgatgcttgtgtgactcactataatcccacgaatgcagatgcctacatcccactggcaaccaatgctgttcgatctggtattttagctgggcataatgtgcttggtaatcggcggcagtcgatgggaactcaagctacagcagcgttgaaaatttttgattatcatattgcaacgaccggcattaccttaaaaaatgctcaaaagatcaatgatcacgttgcgtctgtttgttatcaaggcaactatcgttatagttttatgggaacaccaacaaaaattaccatcgtattagtgtatgatcgtcagaatcgagaagtattgggtgcccagctattcagtcgtcatgaaattgcacagtctgccaatacaatttcattagccattcaaaatcataatacaattgacgagttggcctttgtggatatgttatttaatccaaattatgatcaagcgtttaactatttaaatttagtcgcacaattggcaatcaaacaggaacagacgcctaataaataaactcgtacccatgatatgagggtacgagctttttagcattaataactatgagtggccaagcatgctttgctgaacgattaaactggcaaaaataactaatacgaccaccaacgcggcaaaccagtaccattctttgggctgtagcatcggaagcttttccaggcgtgctttgtaccgctgatgtttcaaaaccatcaaaattaattcatttaaaaaaatgaagatgattggtaatatgaacaggtagctacgattaccaaatgcatcgacgtgtcccaaatcgtcgatgtgggtcgcaactaatgccggcgcctgaaagaaaacgacaagcgcaacgacaaataaaataatacttagactacggatgaggattgttaactttttcatcaaatcacctctgataagcatattataatataaaaattagatttatcaaaggctaatattgaaatgatcaaagggttacgatctcatgtgtattggaggctatcatgttatttggaagtattgaagcaggtggtacaaagtttgtgtgtgccgtggggaatgctcagtttgaaatagttgatcggattcagtttcctacaactaccccagctgaaaccctgcaacgagcagtcgcatatttcaaacagtttgaggaggttgttgcactatcggtagcctcctttggcccaattgaaattcgaccatcagccgcacggtacggatatattactgagaccccgaaagtaggctggtccaatattgattttctagggtttttaaagcaaaactttgaattccccatttattggacgactgatgtggatggttcggcctatggtgaatactggtttgcgcaacataccggccattcggttgattcactggtttatttcacaattggtactggtgtgggtgcggggatgattagcgctggccattttttaggtagccaagggcatcctgaagtcggtcatgttcgattgaaacgccatcctgatgatttggcatttgacggcatctgcccgtatcatcgagactgtcttgagggcctagttgctggtccgacctttgaagcgcggactggtcataaggggatggatgtgccgatgagtgaccatgtttgggatattatggcctattacgttgcacaagcagcacttcaatcgacacttttcctgcggccaacgcgaattatatttggtggcggggttgttagcgaacccttcctggtcaaggttcgtgtcgcatttcatcagttgatgaatgattatatcgatgttggcgcactcaaagattatattgtgatgccatcgattacgggcaacggctctgcaacggtggggaactttgctttggctgctcgtcagctggattagttgtcggttttctaataatgctggtaaaatgattgctgaggaggtggttctggtggagcaggagtctttattttctgatcaggtgcaaaatacgccacttgcaaaccgggttcggccacagacattagatgaatttgtcggtcagtctaacttgattgcgccgggcaaaattttacgtgagattattgattcggaccagctttcatcaatgatcttttgggggccaccaggagttggtaagacaagcttggcaaaaattattgctaatcaaactcggtctcattttgtgacgtttagtgccgttacaagcggtatcaaggaaattcgtcaaattatggaggaggccgaagataaccgcaaatttggagaacggacacttgtttttgtggatgaaattcatcgatttaacaaggcacagcaggatgcttttttgccatttgtcgagaagggaagcattatcctgattggggccaccacagaaaatccgtcatttcagattaacgcggcccttctctcaaggtgcaaagtttttgtattgcaccaattgagtacctcagaaattattcaattattgcagcaggctttaaaacatccgaatggttttccaaatttggatgttcaaattgatactgatgcaatcacaatgatcgccgaatttgcaaatggggatgccagagtcgcactcaatacactggagatggcggtgctcaatagtgatcatcagcaagcacaggtcacgatccataccgcaacgttgaatcaattaattaatacgaagtcgctacgttacgataaaaatggtgaagaacattataatttaatttctgcgttgcataaggccatgcgcaacagtgatgccaacgctgctatttattggctctcgcgaatgcttgatggtggcgaagatccgatttatattgcccggcggttggttcgatttgccagtgaagatattggattggcagatacgcgggccctttccttaacaatcgatgtatttcaagcgtgtcagctaattggcatgcctgagtgtgatgtgcatttgactgaggcggttgtttatctgtcgcttgcgccaaagtcaaatgcaatttacaaggcgcgattagcggctaaaagtgatattaagaaaacgggaaatttgcccgtaccattgcaaatcagaaatgcaccgactaagttgatgaaagatttagattacggcaaggactatcagtatgcacacgagacagacgataaattaacaaccatgcaaacgatgccctctgaattggctaaaagtgagtactatcagcccactgaacaaggaaatgagaagcggtttaagcaacggctcgcttatatcaagcagtggcatgaagcccatgatcagaaagatcagtaaaagggctttttcattgaatcttggcatggtatcattaactggaaccgattacaataattcgcggggagtaatttaacaatggcacacaaagcaacaattaaggaactggccgaggcagctggagtatctgttacaacggtttctcagatcctaaacggtaagggtgaccgctttagctcggatactcgtaaaaaggttagagattatcaaaaaaagctcaattatgttccaaactttaatgcccgcaatttaattttaaacaatgccaaaacgattggtgtattggtacccaatattggtaatccattttttagtagttttattgctggtattcaacgggtatcccgtgagtttgagtacttgccattcaacttcagtggcagtaatgatccggaactagaaaattattatatgaagcggctaattagtcgtggtgcggatgggatgattattgccagttcgacaattacttcggaaacattgaatgatacgctcaagaaaaatgcgatcccgtacttgctgatggaccagagtccgttatcggatggggatcaagtgcgtacaaatgatacgctaggtggcaagttagtcgccgatcatttacttgagttgggccatcgcaatattacgattgtaatgcctgaaaatgcgacggataatatcttgtaccgggtcaaaggattcaaggcagagattgttgcccaagatacgcagaaagtgtgtcacgtgacgaccatttaccgaccattaactaaaaaaggtggttttgaaagtgcgcaagctgttgtcgatagtcaggcgacagcggtgtttgccatcaatgatgagatggccatcggattataccgggggttaacacaattggggtatcaaattccaaccgacgtgtcagtgattggttatgatggaattgatttggatgagtatgtttcaccagcattgacaacaattcaacaacccatttcacgaatgggtgagttagcgactgaactactaattaaccgaattaacaatcctagaattgagcaacaagtggtagaattacctgtacggttaattcagagaagtagtacgacggctcccaaaatatagcaaagtagttgtaaacggttactgattatggtaaccttataattgtaataaagcacaactgctttatgggtgtagtaaaacgttttactataaaaataagtgaggagaatttaattatgacaaataaagtaacagttcttggtagtttgaatgttgacacaacagtaaccatcaaaagaattccccaaccaggcgaaacaatcgcttcggaaaataagagtagtgctgctggtggtaaaggggctaaccaagcaattgctgctgttcgtgctggggccgatgtgagtttcattggtcgagttggtgaagatgacgaaggcaagttcatgattgaatgtttaaaggaagatcatgttgatacaacacatgtctcggtcgacccactaatcggtacgggatctgcaattattttgttggacgaaaagggacaaaatagtatagtaatctatggcggttcaaaccaaaaacttacacccaaggaagttgcagctgctcacgaacagattaaacaatcagattttattgtatcgcaatttgaaacgccacaagatgcgaccttagcagcctttaagtttgcaaaggaaaatggcgttcaaactattttaaatcctgcaccagcggcgtcaattaacccagaattgcttcaatacacagatattttagtacctaatgaaactgaaagtgccagtttgacgggtattgaagttacagatgaacagtcaatgttagataattttgcggccttcaagaagatgggggttaagaatttaattattacggttgggagtaaaggggcgttctttgccaacgatcgtgagcattcattcatcccagcctttaaggttaaagcagtggatacgacggctgctggggatacattcattggggcactaagttcacaattaaaacaggatatgagtaacctaacggaagcaatcacatttgcacagcgcgctagctcgattaccgttcagggattaggggctatgccatcaattcctaggttagcggatattatcgctgcaagtaaaaagtaggctacggaggtagatcatggatcaaaatgcattaaaacaaatggttggacaagaagccgtaaagtacgtggaagatggcatgattgttggactgggtagtggttcaacagttcaatacatggtagatgcactgggaaaacgagtgcaagaagaacagatggatatcgtctgtgttgcgacttctaacaaaaccgaagatcaagcacgtgcccttggaatgactgttaagtcaattgatgaggtcgaccagattgatctgacaatcgacggtgctgatgaaattagtaaagattttaatggaattaaaggtggcggtgccgcccatctgtgggaaaaaattgtagcaatcaattctcgccggaatatgtggatagttgatgagagcaagatggttgatcagttgggagcatttccacttccattagaagtgattccattcggttctagccatgtttttgaaaaattagaacaacttgggtttcatcccgaatttagaatgcatgatggcaaacatgtattaacggattctaaaaactatctgattgacctgcacttaggcaagatcgatcatccggaaacattggctaaacagttagattcaatggttggtgtggtagaacatggattatttcttgggatcgttgatttagttattgtgggaactcagcacggtgttaagacggttaaaaaatgatgagaatagcacagcatctaacgtgggggacatccacgagggactgtgctatttttgatttagtttcttagaaagttatgataattaatgaaaacaccttgtaaaagcgctttcattatgtcataatatttatgttctgaggtactcaattcgtctcaaacatataagagaaattcttgtagtgaaaaataagaaagttatttttagacatcagtcgtgtgggcctggtgtttttttgtttactttcataatcatagtaaaattagatgagtgttattcatatcattatgtttataaaagaatacctgttaaaataaagacaacgatagctaccattgttttatgaaataggaggcaactactatgaaagcatataagaagataatggtcggaattgatggctcagatcagtccaaattagcgttggaacgtggcgtagaattggcaaaactttatcgagcagaactattgttggtcacaatcgaggatgatggtcgctttgtaccattggtaactggcagtgttgtatcatcacagcttgatgccaatctgatccgtggagtacgcgataaaattcaaacaatcatgaatgagtcggttgcgtatgccaagtcagaaggcgtgatggctgaatcaatgatttattatggtaatgcgcggacggaattagcagatcgactaccaaaggaaaaacaggtggatttgatcgtgatgggtgcaaccgggttgaaccgatttgagcgaatgattgtcggatctaattcaaactatgttgttcaaaatgcgccttgtgatgttattttagtaagagaataataatggaccacgaagaattttaaggttacagtcccccacaatgattagatccaaggtctagtgattgtgggggatttcattcttcgtggtccctttatatgtgatgtgtgattaatggtcagctaacttagctaggtcatcgatcttatcaaagaattgttcagcgtgaacattggtaacaaaggtaatgtcgcgtccttgatcagtgatgaatgtccgaccttgtgcggcgccggtactgattacgtcacttttaacgttaattgaatcaactaagtccgggtaattgctgacaagtgttgtcagcacatcccacaagtagtaagtcgagttggcttcaaacgaatggacgagtgagtatccctgaccaatgagatctagggctgggtgttttctttggcgtgcccagcgactccgcaattcacgcgtgagcggtacttgatccgtactgtcgagaccaaccatggtgatgttgatcggtgagtcccaaacagttttgacggcttcggcatcccagtaggcgttccattccattgttccatcctgtccgggctcggcgacgtttccctgactattcatcgcaccacccatccagtagagtgcatcaatgttattgacaatggtgggatcagcttggagggcccttgctaaatcagtaagtggtcccgtcatgacaagcttaactttttgatcggattggttaattttttcgaccatatctaggtgagcagggagttgggcaagtggtgtttcgggttgaccatgttcgttaagaattggaaagtcatcgaatgaaaaggcacttaagcgccactccttgggaaattgatgtgctgcacgtgaattcgattttgcaatggctgctggttggcgatcagggtgaccaaaacgatcgacaattttgcgggatgctgatgatgcgggatcaacatagccgtctgcatcgatcacgccgactccaagaaggttaacatcaggcatttgtagtagtaatagtagtgagacgagatcatcgacgttaccgtcatggttaaaataaacgttttgcatggcaaaacctccaagtatttttgaaaaatgataaagggttttcacacaatagtcaacagatggcggatcggtttaactaaattatcatttaagagtgatcaaaggcgcaaattcaaggaaattaagttgaaatttttgtttatgcatgcgttttagcgatataatgaaggcgtaaacatgtgaataaaggaggataaagttatggatgaacaaacaatgcagaaacaggcaaagttttggggaaccttttatcctgctctagtgattgtctttggaatcgtatcgttgattgcatttggtgcgatgaacattagtgctggagtagccttaatattcttgatcctatggctggttgtgatgggattattgacgtattacctaaacagaaccgttcggtatagcttctatgaatttcagaaaaatcggcgtaaataaaaaatcctgaaaaaccaggatttttttatttggccaaattgattgcgattttagtcttctcaattgattgcgcccagagattgataatcagtgcgatgaacattaaaactaacgacactagcatgatgttttgcaggccagcatgtaagataacacgcatttgcggaatcaattgggtgggcagtgaggctagattggttgcatcactgagtttattcatcattgcaatggtgattttaccatttgcggctgcaacaccatctcggagggcatggttcatgatgatgccaaagatggaagccataaatgtttggctcagcattcgaattaaaaagctaaatgaggttgccacggggatgtcatccacggccgcatcctgctgaactttgacttgtagctcattaaagcaggcaccgttgccaaatccttcaaatgctgcagcaatcaggattaaccagtagggtgttttaattcccattacaagcagtaaaacgaatgaaacgatcaaggtaataatcccaatcgcgatcactttttgtggggtaaaatatttacgcatgggggcgacggaccccgaacctaagaagtctgttacggagctgggaatctgggtggcaccaccaatgagtgccgtagtgccaagtaacccttgtgcccacatcggactgtatatcagaaaaccgataaaggccccccagatcaatgcaaacagactgaagtcaattactaaggaacgatttttgaacagacggccggggatgatcggatcaggtacatgctgttcaaagtgatgcattgcaataaagcagatgatggtcacgataagggtcagggcaattaaatgccaactcgcaatgccaatcagttcaatgccggccaacagactaacaagaccaatcgtcattagtgtagcccccacgtaatcgatggggctcgtcttacggacttccttagcaccccggtagtacagtttcacgaggagcgctgaaagaagcccaatcggcacattcaaaaagaaaatccagtgccaactgaatgcatcgacaataaagccccccactaacgggccaataattgttgccgtactatagctggcagaaacgaagccgaggacttgcatccttttacgagggtttttatacatcgttgcgtaaataatatagggtaacgagatcatgccaccatttccaatgccggcaatggtccgcgtaataattaaaaatgtaatatttgtcgatagtccttgtagtaatgatccgacgacaaaaaggagggcagcaatttgatagctgacctgattgccaaggtgttcaccgagtttgctccaaaggggcgtactaaccgcagttcctaagagaaaaacggcaacgatccaccccatgagctcgatcccgtgaaggtcggatataattgcggggagcgcggtgttgatgatcgtactatccaacccactcatggcgttggatagtaacagggcacaggtgacaatcaaaatgttgtgtttagacaatgtattctcttcttcctcaaataagttaccgtttaacatggtacaactaaatgggaagatttaacaataaacttttggttagtgtcgttttcgctcgcccttggggaccggatagtaattctcaagtaaaatgtgatcgtagatgtgccgtagtagctgtggatcgtcggcgatgtctgcggcccgctgacgagtaaccccatactttgcttgaaagtctgagtcgttcaggttagtgagactcgaaaggtcggtgacgatagcctgttgcagaattttgagatagtatttatcgacagctccaataatttcggcgccggtaaaaattcgagtttccgaatccgtatttgagtatgattgaatgttagcaaaaatgatggtatcaaacacgtcaggatcaatatcaagaatggtgcaggccttggtacgagtgtagaaccgctttggttcgagcagtgaaagatcaaagtaagggtgtgcttgcatattgaagttcctttcttgtgaaaatcagtgaactaagttcaagatcatcatagcacaagcaaaacaaatggctgggagtttttcccagccactaaatttcattattgacgtgctgctaaactttcataaaaaatagccgtacagtttggcccagtatgactggccaaggtaatgccaatcggcgtgatcgcaatttttgcatctggtagctgggcaagaataagttgcttcaactgctcagcgacttgttgatcatcactggtggcaattaatagttgggctggcctgtcagaacgaatttcggctaaggcctgatccgccattgattgcaggctttttttcattgaccgtgttttgcgaagcggttcaattttaccgtctgggttaattcccaatatcggctgaatatgaagtaattggcccatcatggcactcgatttagagagccgaccaccgcgaacgagatagtccaagttactaagggtgaagaggtgattaaacattagccgatgctcagtcagccaatctgcagtggcttttaaggattggccgttggcacgcatctgacaggcacgcataaccatcaaccccatggccccacatgccgctcgtgaatcaacgagttcaatttcagcttgtggatttttagcgaggacgagttcgcgcgcggcaaccgcactactaaaggtgccgctcatggctgatgaaaagcctaagtatagcaacttttgctggcctttgagagcttccgtgaaacaagcaacaaactcaccaacattaatttgcgaggtggttgcaggactgccagcctgcaactgtttataaaaatcgctaacttgttgggcgttttttgtatcctcaagggtctgcccgtgaatggtaatatgtaacggaataagttgtaactgctctgctgcgatgagctccgttggtacgtcgcaagcagaatcggtaataattttaaacatgatgattccccacttcattcatattttgaggcctaagtttaataaacgaggccttcgctgtaataaaaccactaatttccatagtccatttgatcattttaaaccgtagctgtcaattgtttggtactgaacagagtcgataaagtgcaattaaatacaaaattgacaacgcttaccaagatgcttatactaagcgcaaacaagttaggaaaccggtttccttaattttaaacttttatttgggagatggcaatatgatggatatattgactggttgtttattacttatcagttttatctttttcatcatttttatcataaagggtggtaatttaacgattggatttatcggaatggcaattttatggacggtcatcgggcaaattccaattactaaagcaattaacacaatttttgcgcaaccagctttaaactatgggccaacgattatatacattgtatttggttcttggtttggtcgcgtactggttgatagtggtattgcggggagtattagtcaccagacacaacgggtggggcgtaaacggcccattttggcggccatcttggtctgcttggtcacaatgctgatttttgtgagcgcttacggtgtcggatcagtcattgcaattggtgtgattttgattccaattttattttcacttggcctacctaaacatattgcggttgtcgcatttacactgtcaattggcgcacccatgtatattaatgtggtgctatttaatcaaattaaaactttctttccagcggttagttatgggcctcgatacttaaaatttggctggatcggaatgggcgtacagttgatcgctgttattctttttttgctctggcatgccaaagacatccataacaatgaaatttcacaaattaacaatgagtcttcacaggcggcgaatctggtgatcacacatcggttgcaatatataacgtacataataccgttggtgccagtgttattaaatatgctgttccattgggatgcggttccggctttgattctgtcaactgtgttagcgatgttgttaaccggccatttagctcatgggcgacaaggattgacctttatgaatcagacaatgaaacgggcggttgcggatattgtggatttaatttttttcttactagcactagcaatgtttaccgcgtcggcaacggccaacacaccacggtttaaatcaatttttgaattgttgttgccgcatcaaacgttgtggctagcagttggtcttggcatattggcccccttggcacttttccgaggaccgcttcatgtgtggggtgcaggtgctgccacagccgcagtactgactgctaccggattgttttcgcaatggtttttactgccggttttatacgtgccaacattattggccgtggccatagatgtcacccagtcctggaatatttgggcattaacctataccaaggtcgacaatcgactcttcatgaagactggcctaccagttgtttggttagtggcgattattaacgaactcattgcgtggaaaatgtttggctaaatccatgaagtctctttcaccacttgtcgggaacgcgtaaaatgaaggtatcataaccaaaacggaaaggatattcctcatgaaaaaaatgacgattgaccaagtagcgactgctgccggtgtttctaaatcaacagtatcgagatatctgaatggtaactttcaaaagatgtctgatagcactcgtgagcgaatccaagcaacaattcgggatttgaattatcatcccaaccgccaagcacagacgttaaaaaccaaaaaaacagggttaattggtgttgtcgtggctgatatggcaaatttgtattcggctaagatgattagtggtgcagggaaagttgcacgagtgtaccagtatcaattgttgattatggattcgaataattcattcgagcaagagcatgagtcgctcagacaattgcaggatcagtcattagagggtcttattattcaaccgatgagtcggaagagcgccgactatcaaaaaattattggagaattgccaacagtgtttgttgatcgagtgacggattctaaccaatggccatttgtgggtgttgataattatgaagcaacgcgacatttaggaagtttgattgcgaaaaggggttatcagcgaattttgatcatttcagaacccattgatgtgtctcaggcacgatttgatcgggttcggggcgttaaagaaattgctcgtcgcaacaaaattcaatgtgaattgctagagattaccgaatctgtatcgccagaaatacgccatgaaatcaaacaaaagattggcacactgacacaaaatcaggaaccggcagtgatttttgctagtaatagtcgactactaatgcaggtgatgcagttgattaatgatttgcaattacgaattccggcggatattggcctatgtgggtttgatgattggcattggacggcccttactaatccgccaattgcaagcattgagcaagatgcggttggagtagggcaagcagcgatgacaacggtgatcaaccaactggaacgccctgatcaagtggtcaaagatcaaattatcgcttcaacacttaacgttcgtgcttcaatctagtgagaaatggagactgagatgcaatcaaaactggaattaattctttttgatgtcgatggtacgttgatagatagtttcgatgcttatcaaaaaattatgcaaacagttttaccgtcctatgggattcgtgtttctttaccaatgttgcggcaatcgtttgcgatgccagtcaaccaagccttaacgtttttacaagtttctccagataaatttcaagctgttgagcaggcgtatggagagttggcaggcactcctcaattttcagaaccgttgtttccaggaatcctgcgtgtgcttcagcagtgttatgaggccggcataccattaggaattgtaacgtcgcgaagtcggtcggatttgaaaagtgtggatccagcgattttgcggatgatgacagtcgttgtaacggcggatgaaacgcacatgcataaaccagatcctgctccgctgaatttagcgatagctaaggctgacagcgctcgtcgaaaaacagtatatattggtgatgatcgcgtcgatgagcaggcagcccgtgcagccggaattcaatttaaggcggcggtgtggggtgcaaaagatctaagagaattcgatcaatcaacgaccattttaaagcacccagccgagttggtggccttactttaggtgtaactttgttctactttatgttatataaatgattatttttagagaataatgatgttttaattaaaaatccattgacaaaatgccatgtaaaattcataatggtcacattaaattaaaagatgagtattaatatttcgctagatacagagagccattaactgctgagagatggacgtgttgagtattaagaatatggtcttaatgaaaatatcatgttggcgagcctccggtgagctaatgtcggttttctaaccgttaccttagaattgagtgggtgcagacgtgcactcagtaaggtggtaccacggctctgtcgtcctttatcagtaatgataaagggcgattttttaatttaaggaatagaaagcatattggaaaaggggagttacgttatgagaagaaatacaaagtggttattgggattaggtgtgattattgttttatttgtggcaatttttgggattacacgattaaactcgtctaattcaaacgctaagttgaaggatgttacgattggggtagcaccaggaccttatggtgatatggcaaaagacgtgatggggccgctattaaaagaaaagggttataacgttaaaatcaaagaatttaatgattatgttcaaccaaataaatcattatcttcaggagaaattgatgccaacttgttccagcacactgcttatttgaagactttctcaaaggcgaaccacttaaagctgacagcattgggtgaaacaccaaccttgggaatgggaatctactctaagaaaattaaatccttaagcgatttgaaagacggcgacaaagtttcgttggctaatgatccatccaacttagcgcgttcgttgcaattattgcaagctaacaaactcattacgctgaaagcaaatgtcgatgtttctaaggccagcttgtcagacattgcgtctaacccaaagaatctgcaattcaagactttggatgcggcccaattaccacaatctcgtgacaacgtgacaattgcattaattcctggtaactactcatggaatgctaaaatcaagccaagttcagcattggcacttgaaaaactgcaagaagattataaggaagtctttgttgtaaagactagtcaaaagaattccaaatttgccaaggccgttaaatcagttttgaagagtgacaaatttaagaaagcaatcaatgattccaagtttaaagactttgacaagccagcatcttggaactaggaggtaaactatgagccaaattgaactcaaaaatgtttcagttacttttgaacaaaaaaggacgacgattaatgctgttaaggacgtatcgttaagtatcgaaaagggtgaaatcttcggtattgtgggattatccggtgctggtaaatcaacgctggtacgaacaattaacggacttcaacagccgacgaccggggaagtaactgtgaacggagttgaaatcaataaggccaacaagtcacaacttgcccaagcccggaagaaaattggctttatttttcaaaactttaatctcattaacaatcgaacaattgcccaaaacattgggtttgcgttgactgctggaggatatccggagaaacaacaacctgaaaaaattgatcagttgttggccttagtcggtttacaggatcggaagactaattatcctgctcaactttctggtggtcaaaaacaacgggtgggcattgcacgggcgctagccaatgatcccgatattttgttgtgtgatgaggccacaagtgcgttggatctcgaaactgccgaagaaatcattacgattttaaaggatattaatgaacgattgcatatcacaattgttttcattacccaccagttggaggtcgctaagaacctgtttgatcgggtggcagtgatggaaaacggcgagttagttgaacagacaaccgcctacaaactatttgcagacccacaatcagatatggcaaaacggttggtcaatcgcttcttagatgatgaactacccgatgaggtgcgctttaaactacgaaaatcaaacggacgtttcctatcattgaagtatcacggggatgactcgttggatcccgtaattactgagattgctggaacagccggagttgatattagtattttgcaagggcggattgagtttattcaatcaaacgctattgggacgctggggatttttattaccggggaaccacaggcgatcaatcaagcggttcggctatttcatgaaaaggttgatggtgttgaggaggacgaacaatgagcgaaacaattacaattttacaagagaaccttggccaagcgctctgggaaacgtttgagatggtcgtgatttctgggatcattggggttgttttgggaacccttctcgggttagtgttgtactactactctaatcctttgttctcaccacgggcagccgtgaacaatgttgttgggtttatcatcaacgctgtccgatcattcccgttcttgatcctgatgattgttttgatcccgttcgccaaactagtggctggtgatccatatacgccaatggggggtgctgtgtcattatccgttgctgcggttccattctttgcccgcattgcggaaagctcatttgccgagattgatcaaggggtgatcgaagcggcgcgttcaacgggtgctggatttttcctcattttttccgatgttttattcccagaagcgctgccttcattaattcggggaattgttttaacaattattagtttgattggttattcagccatggtcggaacgattggggctggtggaattggtaatctcgccattcaatttgggtataatcgctatgaaacaggtgttttaatcagcgtaatcgtcattttagtgattattgtgcaaattattcagtggattggtgaccgtttagcggtacactatacccggggttaggttttgatttaagaactttaaattttagtaggagatgacgtgatgatggcagatattagtgaattgtcattaaaggatggtcggataattaccgactcagaaacattagcaaaatttgggaaagatgattccacgcaagaggtggttaaagtatataagccgctcgcagtggttgaagctcacagtgttgaggatgttcaggcaacgctaagatttgcaaatcatcacaagatcccggtgacagcatggggagctggtagttctattgtgaacagttctgcagggctggatgacggtatcgttttggatttatcgcaattaaatcaaattttagaaattaatattcctaatcagtacgcagtggtgcaggcgggcgtcttgaatgctgatctggataaggaagtgcgtaagcaaggctatttctttgcaccagatccaggctcaaaaccaattagttccattggtggaaatattgccactaacgctggtggcatgagttcattaaagtatggcacaactaagcagtctgtgattggcttacaaattgtattggccgatggtacgctaattaatacgggaagtaagacgtttaaagataatgttgggtacgatttaaccgatctgcttgtggggtcagaaggcacgttagcagtaattgttgcagccactgttaagttattgccgattccgtttggtaaacctgtcactggcttagctacttttgctgacatgaagcaattgagcattggcgttcaaaaaatttcagccagcgggctgtatccatcgatgatggaagctttaaatgatacttcgattgaagcgctggaccgtttggagaaaacggatctaggcaatggtggtgttgcgaaggccctcttgatcttcaaacttgaaggagcgcccgcaggggccgtagaagcgttgcaggaaattttaggtgacgcaggcgcattgcacgtttcagtgactgatgatgcggaatacgcacaaaagattattcaaattcgccaggactactatcgtgctgaggcggcatatggtcggttaatcgttgaggatgtagccgttccattgtcaaaattaccagatctagccgattttgtggaacagctaacgtttactaccgatgtgacggcatttttgggtggtcatgctggcgacggtaactttcatcccaacattgcgattccacgagattcggactcgataccagctgacgtgcaggatgcaatttcaaaaattttcaagtatgttcagtccattgagggcacgatttcggccgaacatggaattggtgaaattaaaaagcaatgggttttgccgcaattaggacaggagcttgttgatctacaaagacgagttaagttaacgtttgatccgaataacattttaaatccgggtcgtaaaatttagttcttaaattttggcgatgcagtgaaaaactgcatcgcctttttttatgtccgcgggtgacagaaccatgtttggtaatatttaatacatgctgctgatagaaaagtataaaaattggtcatttttgcttttcctaatgtagaatgttttaaaaagtgataacatattttttaaatattgtaagcgattccgaacaatatttaatttattaagtttgatagcaagttggaattaatatgagagtcacacttaaaattatgaagaattattaatatttgatgagagaaataaaagtataatgattgtttcccttgttaaatcaaggaattataaattttaacgaaaaatatatttttagaattctctaatatgatataattttaataatttgaattggaaggatgatgtgtagatgtcagaagcaaaagaatatttagctaacgtacgtgcgtcacttgtaaagagagatcctaatcaaccagagtttttagaagccgtggataactttttccacacaatcactccggttttagaaaaacatcccgaatacattcaggccaacttaatcgaacggctgattgaaccagaacgggcctttcaattccgtgttccatgggtcgatgatgaaggtaacgttcaagtaaatcgtggattccgtgtacaatttagcgctgcaatcggaccttacaaaggtggactgcggttccatcccagtgttaacttatcaattgtcaagttcttaggatttgaacaaatctttaaaaacagcttaaccggcctcccaattggtggtggtaaaggtggaagtgactttaaccctaaggggaagtcagacggcgaagttatgcgcttcgctcaaagtttcatgactgaattacaacgtcatattggaccagatattgatgtccctgctggtgatattggtgttggtggtcgtgaaattggttatctatacggccagtaccggaagattcgtggctaccaggctggtgtgttgactggtaaaggcctgagttatggtggtagtttggctcgaaccgaagcaacagggttcgggttactctactttacgcaagcattacttgctgatcagggtgagtcattagacggtaagaagatcaaagtttctggggccggaaatgttgctatttacgccattcaaaaggccgctgagctgggagccactgttttaacagcttcagattcaaatggatttgtgtacgatccaaatggtatcgactacaagattgtgcaacaaattaaagaagtggaacgcggtcgaattaaagattatgctgaccgtgttgatacggctgaataccacgaaggctcagtttgggactttgatttagactacgatattgctttgccatgtgcgacccaaaatgaaattgacggtggccgggctgcacggattgcacaaaatggtgcgacagttgtcaactgtggatccaacatgccatgtactccggaagctgttgaaattttccataaatccgatgttttactgggaccagccaaagccgctaatgccggtggggttgccgtttcagcattggaaatgagtcaaaatggtgaacgcctgtcatggacgtttgaagaagttgatcagcgattagaaaaaattatgcaaaatatttacaccgaatcggctgaagccgctaaacaatatggctttggtaaagactacttagcaggtgccaatattgccggctttaagaaagttgccgatgccatgttggctcaaggtgtaatttaattaaattgatcaaaagaagggaatcctcgggattctcttttttgatctttttaaagttggagactaggaataggatttttagagtgaaaacgtgtacaatatacgtaacatggaggtgatgcaatgaaagcatttggataccaatcgtttggtaaaccggacgtttttgaagaattagaagttgatcaaccaaagattacgggtcagaatcaggtaattgttgaaacattggctgttggaattaacaactttgaacgcattcagcgaatgggggttattggtggggatcattttccagtgattccgggccgtgatattgtggggcgagtggttgctaaaagtgatgacgtgacgacgattcaactcgatgacgtgattattggccatgcaggacctgcatacgcccaatttgcaaaactctcggttaatcgattaatcaaaaagccacaaaatgtctcgcttgagcaggctgcagctattattacaccaggtattacggcatataatgctgtgaccgaatttactcatgtgcgagctggcgatcgggttctagttaacggagcaaccggcggcgttggtatgattgcagcgcaagtcgccaaacaccttggcgcctatgttgtcggtgtgggatcatcaaagaatcgcaccacactccaatcattagcactggatcagctcgcattttatgatcaagaagatattaatgagaagtttgccgatcaatttgatgttgtgattaacgcggcaatgaacggcaataatgaagcgctaatcagtgccgttattcgtgatggtggtcgagctgcttccgttggtgaagctaataatttgcaggacaaacctcaagtcctgttcgaacatattcgcccactagatgcgcaacatgatcgaatcgcccttcaaaaactggccacgatgttatctgataaaacgttgcaagtaccaatttttaagacgttaccactgacattgcaaggtgtagtgaaaggccatgacttactcgaacaaaggcatgcgccgggtcggataattttaatgaagtaaaatgatagcgtggtccaatgagtggcggtaagtgccaaattggatcacgctatttatgaggagaagttgccgaactaattgggaacttattggaaagaagagagttaaatgaaaattggcagaaaacagggatcaccgtttttaattttggatgccgaccatggacgtccgattcttaattgtaacagtgtcgtagcggccgctttgatgtccgagccagagctgaagctgggaccaattgaaacctttcaaatggctacattacagcaaccaatcaagcaaccacatcaaattttagcggtgggaatgaactatcttgatcattcgaaagaaatccatttagcactgccacaaacgccgagtaccttcaccaaattttcaagttcactaactgggccaacaactacgattcgccgtcatgggccacgcaccgactgggaaactgaattagtagtggtggttggcaaggctggtcgcaacatttcgaccgccgatgctgcaaatcatattgcagggtacatggttggggaagatttgtcggatcgcgacgtgcagtttgcaaattcgcccgcgcaattttcacttggaaagtcatttgaacattattcaccaattgggccgtacttgacgacaccagatgaaattgatgatttaggttatcaagaaattcgaaccttggtgaatgatcgagaggtgcagcgggcgcagctaaagcagatgatttttgatccagcagcactgattcattatttttcatcaattattgagttacaagcaggagacttaatttttactgggactcccagtggcacaggtgtcggacgtgaaccagaacaatatttaaagaagggcgatcatttgcgtgccgaaattaccaatttaggccgcctcgatattgacgtcattgcgtagtgaaactattgttttttgccaagtaatttcgaacagtgctataattaatccaacatttgggtgtctttacacctgctgaggaggattcattttgaggaatttggcattattaactgatttatacgagtattctatggccaatggttttttgcagcagttaccaaaggaccgggctacttttgatatctttttccgacgggttcctgatgagggcagttttgtgatcgcggctggaatacagcaagtagtgggggaactgcaaaaattacattttgatgcgtcagatattgcctattttaaacagttgaagctttacgatgaggcttttattgactacttggcgaattttaaattggactgtgaaattacagcggttccagaagggacgccaatctttccacgcgaaccgttgatgacgattgaaggcccgttggttcaagtgcaaatgttagaaaccctagttttaaatatccttaaccatcaatctttgattgcgactaaagcacggcgcattaactatgctgccgctggacggccggtaatggaatttggtgcgcgccgtgctcagggaccagatagtgcgacatacggtgctcgagcagcgattattggtggttgcagtagtacatcgaatgttttagccgccaagcaatttcagattccagccgctggcaccatggcgcatagctgggtagaagcatttgatgatgaattgacagcctttcaaaagtgggctgaaatatatccagataatagtgcgttactagtcgatacctatgatgtgctcaaatcaggaattccaaatgcaatcaaagtatttcagcagttggttgctaccggtcatcaaccggtgggcattcgaattgattccggtgatattggttatctgaccaaaaaagcgcgtcagatgctggaccaagcaggctttatgcaggctaaaattacggtatcgaatgctttagatgaaaatgtgattacggcattacttcaagaacaggcgccgattgataactttggcattggcgagaagctgatcacaagttcgtcgtctccggtattgagtggtgtgtataaaatggctgcaatcgaacgtgacgggagaataattccgaagattaaaattagcggtagtcgcgagaagataacgctaccaggtcgtaagcggacgtatcgcttattttatcccggaacggataaagcctttgcggatgtgattgccttggccgatgagcgtattgatggccaaccactggaagtcatcaacagtgatccactgagtgttaaaaacccgacagtcatccaagattttgatgcacgcaagttgcaacaaacggttaatttagagcagtcaaccgataaaagtgtttttgaaattcagcgcttttcaaaaagccggttggcgcagttaccagacgaaacgcaacggttaaccaatccagaccgttatatggtgtttatgagtaaatcattggccgacttacaacaagctctgttggatcaacgactataggaattcttcataaaacgatttcatgaatcgtgatacaataagggaaacttgtaaagaagatgagcagatgcaaacgtatgaaggtgaaccactgaatattttgcatacaatcggactcgacattttatatccggttgtacgagtggagatgcaaattaagccacaactagatttgccgcgctttaaaaccgctttgaccgctgtgagccagattgtaccggagttactgtgtcgttacgagatgaagactaatcagtgggttcaggttacggatgatgtgaccgatttaatttttccggcaattaaggatgttgatcaagatgcccagaattgggatctgatgcgtgaaccacaattgcgggtgtattggaatgatactggcaatgcaacaaagttgacgctatacattagtcatattttgacggatggtgctggtagtaaacagttgctctatcttattgctcaggcctattcagctggaccatctgcagttgagtctgtgactaatagtcaaaatttagattggcttgagacactggtgcgtgattatcatccagcagctgcacaacaaactgatcatccagacgaggcactaaaattaccgcgattgaaatcagatgatggatcgcaatatcaagtcgggcgggtgcagttagctttacttgaaacgaaacggctccttcgggcaactcatcaacagcacgtaacggttaatgatgttgtgatggcggcgtttggtcgcgtaatgcaaagcttttcaggaacgcattcaattgcattagcgtgcccaacggatatgcgtcaatttacgacttgtccagagcagacggtgcaaatcgctaatatgacatcccgctataatttgtcacttgtgactgagctagatgaaccgttcaccacgctggtggaacgattccatcaagccatgattacgcgtaaacaagaaatgcagtgcttagattcggtagcgggtctgctgaaacaataccagcacgaaccgttagcaaaactgcagcaaatcgtggaagacaactatcatgtgcgagaagttgcttacacaaatttcggcgtcattgatgatcagcgattaaagtttaccggtcatcacattacgtcatttgttatgacgggtggatttcgtcaggcaccaatgtatcaaattgccgctgggacgtttggtaatcggttaacattggcgttcaatatgaatggtacgcaaaccgagtatacgtttggcatggccttagccagagcaacagcggaattaattaatcggtttgcgctggaagctttatctgaataatgtcgtacccgtcttaattggacgggtattttttggattgaagtggtggctggaagtgacttaatggtaaaataatagctattaagttgtaattatttaagtgttaggtaggcaattttatggaaaatggaaaagttagacaagaaaaaattaaaagcactttgttatccgctaaaaaggcagttagtgcaactcattttgccaaggagtttggtgtgagtcgtcaaactattgtgggcgatattgcactgcttcgtgcgggtggtgaggatatcttagcgacaccgatggggtatgaatatgccgaaccagtagaaccgctgcaatttacggttgtttgtcagcatacgttggcccagactgaacaagaactgctattgattattcatgctggtgggactgtgttaaatgtggctgttgatcatccgatatacggacaacttagtggacagctgacaatccggaatgaatccgatgttcaccagtttatgtatcacctacaacgctttaagggccatctcctgtctgagttaacagatggtgttcatagtcatttgattgcggtgcaacaagcttcacaaatggatgaaattagacagaaattaagagataacgaaattttatatgaataattaggattgacaagacacccccaagcaaagtaggatatgagttgcacctatggtgtcaagacacatgtgaaatgtgatcaatataaaaatttgggggagattctaattaaaaaggttggtcaaaacaagttacttgccgcgtcgggatttgcgtggctgtttgatgcgatggatgtggggatgctgtccttcgtgattgccgcggtcgcacctcagtggcatttgacgagtgttcagatgggctggataggcagcgttagttccattggcatggcagtcggagctgttttatttggtgcactagcagatcggtttggccgtaaggatatcttgatcctaacgttactgatcttttcggttggaagtgggctgtccgcattagctactagctatctgatctttattatcattcgttttattgttggaatgggccttggcggagaattgcctgtcgcatctacgctcgtgtctgaaagtgtggacgtacaagagcggggccggattgttgttttgctagagagcttttgggccggcggctggctcattgcggcggttatttcgtactttgtgattccacgatggggctggcgtgtcgcactaattggcgcctctttgacggccctttatgcgttttatttacgctacagtattcatgattccttaaatgaagttcggcaggaggctaaacaacggccaggatttgggcaacgtgttaaggctatctggcgaccggagaatgccaaatccacgctgatgctatggatcgtttggttcatggttgtgttttcatattacgggatgtttctttggttaccgagcgtgatggttttaaaagggtacagcgttgtgaatagttttggctatgtattgattatgaccttggctcagttacctggatactttgttgccgcatggttgattgaacgttggggccgtaaaactgtgttggcgttatttttaacggggactgcaattagcgcgctgggatttggaaatgcggctggcttgccgatgttattaacgacgggcatactgttgtcgtttttcaatttaggtgcttggggaacgttgtacgcttattcaccggaacagtacactgcaagtgtccggggaaccggaacaggtttggcagccggtgtcggacgtctcggtggaattgtgggtccgttactagttggtcagctaatcgcacaaaaagttagtttgacgttaattttcggcatctttttcggtgcgattttaatcgccgtaatcgctattttggtattaggacaagaaacaatgggtaaggtactcgatcgtacgacggcaccacaaagataacagatgattagtgagcgagggtgctcactatttttttgccgaattagtgaaattatgctaaataactggctttttaatgtgtcagatagtaaagtaaatgttaattgaataagtatttgaatcatcaaggggattgagtatataatgatttatacttgtaccgtttggggacggagtacgggatatcaaatacatacagttgactgttgttgaatggagattatattatggattactatgataatgcgaataagttcatgggggtataccaggggcatgaacatgagttcgcagcgattttaaaggatgatggcttttcaatgggcgatatcagcatgatgaaaaaagcgcccagcgtttggcaaatgcctactgatctggtgattaaggtggccaaggaatatgtttattacttggcggagcaggctgcaaaggatccggaatttattacggtccttaataagattaagagtacattgagttctggtgaagaagaaccatatgcaagtacggcacatgcctatcgacaattgttagacaataaccttgatgtctatgcccaactttatgaagtctatctaaaacataaataaaacgacaaatggttttggatgacacattcgaaaccatttttcttattaattttgaccgttgtattatataattgaagcatgaattaatgaccgcaattcagaagggaattagattgtcatggatgatgaattaaaaaaatggagcgctcggttcgagagtaaaaatggccgtcagccaactgacgaagaatttgaaagcgctaaaaaaagaatcgaaagaaacgttgaggctcaacgtcagcgtcaaacacagtcgaatccacgaccagccgtgaagcatgacagtaatctatcgcagcaaaatccgaatgccaactacgcttctgccaaggaagcgaattcggaaaagcaaccaccacgccatgactggggctttttgtgggtactgcttttagctgctttgtttattattggtggtatcattgcatttaagattggtactgcgcacgggacttcgttatggtagatgccgtttaaaagactcgttacctgacaccgaaaagataaggtggcaggcaacgagtctttttagttggcaaattggggtaattttgtgtcaatgtattgttgacgatcgaatttagttttgaaatcaagtgtgagatcctgatagttttcaaagtgtaatacaagcgaataaggtaactcggtgtcttgattgataattggccgaatggattcaggtagcgtatccgtacattggttaataaaaattggcttctgagcggcgaaattttttacagcactggctaattcgcgttcaacgggttcaacatgacgatcatcagtcgtgagggtaaatcgagttgtgacatgaccatcatgattaataactgagaaggttggctgggctccacgttgaacggaaatgtatgccatcttgctatctaaaaatggatgaaaggcgacatccagcgcgttaagggcagtgactttaataatcacacgagtgtcggaaaagtcgattatttcgaataaggtattttccatgataatccctccaattaattttaactttataactaatgattagcataagtatatcatgtcaaaaagtacttgtcactattttcttgttaaaaaatacacaaatgaaatttttgcaaataaatcaattaataaataattaagatttgagttaacgaacggttaatagttattggttatgattaggatgaaagttgaggcgagcattatggatagtgttttggaattacggaatgttagaaaatcctttggaaaacaggtcgttttggatgatataaatttaaccattcatcagggtgacatttacggattaatcggtcggaatggcgcaggaaaaacgactattttgaaaacaattgtcagtttgattcatcaagataagggagaaatcttgctatttggtcgagctcatggtgaagggtatatgaaacaactgacacgaacggggagcgttattgaaaccccggttgctaataatgaattgactgcacgtcaaaatttgaagtattactgtaaggttaaaggaatcgttaatcgtaatgccgtggatgaagcattagactttgtgggactgtcggatactaaaaataaaaagtttaaaaatttttcgcttggtatgcgacagaaattaggactagcaatcgcattattgaatcagcctgattttttaattttggatgaaccaattaatggtttagatccgattgcgatcgttgagttccgcaatttactgatcaggctgaaccaaacaaggcaaattacaattttaatttcgagtcatattttgggcgaactttatcaaatggtgacaaagtttggcattcttaatcacggtaaaattattaaagaacttacaaaagaggaatttgagattcagagtcgagagtttattcagttggatgtagatcagccacaactggcaacaacggttttggatcggttagggattcaccaatttaaggtggttggggatcacgaaattgcgatctatgagctcaacgtttcaaatgcgcaaattgttaatgaacttgtcgcaaccaatgttcaaattgaaacgattattcgtaaacataccaaccttgaaaattatttcaaaacaatgattgaagatggggatgaatcttaaatgtttaatatgctacgggctgatacctatcgactacttcactcaagaggtttttatattactcaatttgtcatgattggcttagttgtggtttctgttgctactgattcactgagcatgatgattggttccgaaggcttgtccagttttcagaatcaagcctcgcacgtaacttggacagcggttaattccgtcaagttgatgtccagtatggccagtcttttactctatattttattaccgttgtttattatgagtattgggtttgatttttcgcgtaaaatttacaaaaatccgctaagcagtggtatgacgcgtcttaactactttatttctaaatattttgtgtttgttttgataacggttggacaactattattctattacggtgttatctttctttccacgggaattaagtcaggttttggaaagttgaccgttttgttggttaagaaatgggtgcaagtatttagtctgcaactattggaattgaatgcaatttttgcaatttcagttttggtgatttatttatccttttcaacaattgccgctgttattacaacggtcgtgacaccggtactaattccagtactactacaactgtttacgaaggcccattggttacgcaactttgattttcagagccgagtggattcggcatattttacccagtatcgcgggacggatttgtccggtttgatgattgcatcgtttgggatgattctgggctgtttgttagtggcatacattagttttagaaaacgagaactttaaaaaatagccccaccaaattaagtttaagaatttggtggggctatttttaccagatcaatttaatagaaaaggtcaaatcatgtgtttcgatcgtcactttggcatgcatacgtttagctaattcggtgacaatgtatagtccaagtccggcattttgacttttacgagataggtcttcagtgtaaaatcgatctagcaatttttggggatgctcaatgggtgcagcgagggaattagtgacatcaaggactaaccgagattgttcgtgatgaagccggattgtcgcgtcttgggtaccatgttcaatgatgttcgccataatattttgaataattctgcggaatgcttcttcgtccagtgaccaaataatgtgaggtgaaatttcgagatgtagtgaaatcttctgtttttgaaatgcatcataaaaactgaggcattgctgctgtagctgttcggatacgtcaatggggacgatttgaatctgaattcggttttcaataattcgattgtatagcagcagtaaatccagatgctttgataaaattgttaaattcttgttgagttgttggacaggccgttgattaatagagttggctgttgtttgtttaagcagcacttgagcgtagccgcttgaaattgtgagtggtgttcgtaagtcgtgtgcaatgttatggatagcaagatctaattgtaattttgaggtgaggtagtgttgatttgtttgttgttgggcgataatcaattgattgatattttgtgcaaggattttaagcagaaaactttgggattttaacgtaatttgtgaattggtagtttcttgattgatttgctccagttgctgattaatcgattgaacattatagataagccacagtaaataacatgtgataccaaagagaacaactgcaacaacggttaaaatcagctctaatattgtcatgataatcgaactccaattccccagatggtttcaatatactcgtgcgttggatctagttgatttagtttatgtcttaaattacttagatgaacattgatcgtattttcgttatccaagaatggttcgttccagataatttcgtagaggtgttcctttgtgaaaatagtattgggatgtgaaaaaagaagttgaatgattgcaagttcttttttctttaaggagcactgatgctgcccattagaaatgatgaactgggcagaattgagtgtgatttttcgataagtaagaactttggactgttgcggcgcggtatttcttagttgaacggtaattctggcacttagttcatcaatattaaatggtttcgtaatataatcattggcaccagcaagaagaaattgtgcgatttcgctggcatcgtcaagggccgttagaataataacgggaatctgcgatgttagtcggatagcagccagtacctctgcaccactttttccggggagcattcgatctaggatgattagcgaaaagggaacttggttgaacagaagtaggccctcggtgccggaataggcacttgtaatttgatattttggtgataatagattgacaagcatttcctgcatatcactactgtcttcaatgactaatattttttccatagcaatcccttcttatgtgccatctataagcttacttttattatagagtatctgaaatgttaaatgaagagaccataattttaaattcaatctaatggtcataaaaaagaaaacggaacttaaacacgaaaaaataatttaactgcttagatttacctattaataaatagacgaattttatataattattaactttctgattaaaaatgcataattatttaagaaataatgaatttattgaattttttgtgactttgttacaaacactgtcccgttatcatgcacttttgaacttgattttgagttctgttgtaatatttgtaaaaatatgtaatcaggatggcatttaaatgaaatctaacagcgctaacatgatcccatcaactgagtacgttcggttggactaaatataaaaatattcttaggagtgatttattattaactcagcagtcaaaaaaacaatggtcgggaccttgggcgcagcagcattattggtggctggcacacaagttgcacatgctgactcattacaaattcaaaagggagatactgtttggggctattcacaaaagtatcacgtctcaattgatgacattgtaaaatctaacaaattagctgatgctaacttaatcattgcaggtcaaacaattaatattccaggtgtatctaccggttcaagcgcagcgacaacgtcgaccgctgcaacaacatcgaccgttagtggaacctcatcggcaacggttgcagcctcaagtgctactagtgttagcgctgcgagttcatcagtagccagttctgcggtggccaccagtgcagcctcaagtttagctacggctaccagttcaacggcagcgacaagctcaagcgttgcatcatcagcaactagcagcgctgtttcagctagctcagcaaccacttcaagtactacgaccagttcaacgacggcaactgctaccagtgctagtgcagtaagcagtactagtgcaacgacgacaactaccactacaagtagtagttcatcatcttctaccaccacaacgaccagtactggtagcatggctcgtggcggcggtgtgtctgcagccttagcaattgctaatggtggtattgggtatctttatggtggaagttcgttatcgactgggtttgactgctcgggctttgttcaatatgtgtacggcttgagttccagctaccggacaacctaccaacaagctaccttagggactcatcatactgatgtggcgaacgcaccatacggttcattgttgttctggggcagtgatagtgcaccatatcacgtggctatttcattaggtaacggctcatacgttgccgctgaaaattcaagtactgggattggtgtctttacgcaatcatggagtacccctgacttctacatcaattattaagctttattttacgtagggagtatcagatactaatttgatactcccttttttgtgtaaaaatgtgtaaaatgatgattgaagtctaaatataaaggtgagaataagtggcaaagattttaatgatccatacaggtggcacgattgcaatgaaaaccaatgatgatggggacattgcggatactgaacaaaatccacttgttcaattagttcaaacattcaaagatttaacgatcgaacaagtcgaattatttaatattccatcaccgcatatgacgtatcggttaatgtggcagttaagtcgtaaaattaatgaggtagctgatcaatatgatggcgtggtcgtcacacatgggacggataccttggaagaaacagcctattttcttgatttaacggtgcatgtgaagtgtgcagtagttgtcactggggcgatgaaatcaaccgatcaaattggcacggatgcattggcaaatatagcagcatctttggcggttgcacgggatgcaaaatcgcaaaatcaaggcgttttggttgtattgaatgaccaaatttttccagcacgatatgtgactaaatcgcatacaacgaatttagccacatttcaagcgccgatgactggaccaattgggatggttcaccagtcgcaggtgtcatttttgatggcgctaaatcaacagcgcacgctagacatgcataaattaattgatcgcgtatatttatttaaagcgtacgccggaatggacgggcagttgttccaattgttgactcccgagacgactgatggtgtcgtaattgaaggaatgggagctggcaatttgccgcctcagacgttaccagcaattcagaaattaattgcacagaatataccggttgtattagtttcacggtgttttaatggtagtgtagcgccggtatattcatatgtcggtgggggcgtcaacctgcaaaaaatggggctgcttctttgccacggcttaaatggtcagaaggcaatggttcgattggtgattggattaagcgccggtttggaccactcagaattagggcgcttcatgagtaatgataattgaatatgtgatttagtaatcgtttaagggagtatttaattttgggagtgagtgaattagtgatgaacaggttgaaagggttattggggcaaccacaaaaaaagatattattgatcgtgatgataattggtatgatatgggcgtggatgactgtatgtagcagatcagtttgggctgatgaagttgacgcagaaagtagcgccgaagtgacaaatagccaaagtgaatcaatggcaagcagtcaatcagaaccgggaattcgaattagaattcgtgtggacggtgcgataagcgttacgaaggccgggtactataatcatttgccaaatgcgacacaggatcctaatgtggccttaagtaaaacagtccagtcgagtagtacgtcttctcaagtaagcactactcagctgaaacaaccagcaactcctgctgagcgtcccacaccggatcatactgatgatacgcaaactagtaacgtgaaggaaacgcgaattccagcgcttaagaattctaatttaaaggcagataagcaggttactactagccaacttgtgcaaaccagtggtaacaagaaaagtgcaggtacaagtgcgaattctagaaaaagatatgaaagtgtgattgtcactcaaaagcaacatttgtcttccgatcgtgggagtacccgccatttgtatgcaccgcaaaaccaattaccaaaaacgggccacacacaacaatctactttaatgaccggagtgggagccattataattgtggcaggtgtaggtgttgtaatcaaaacgcgcaaacattaaagaccagactgggaaaatatagaaaattttctcaatctggtctttattttttttagttgttctaaaatatatatggaatgtgatctgatcaacaggacctttaaaaatattgcggaatgatgatgcaaattagaattaaacgggcaagaatacaggaaatgcttacattttaggtaaacaatagaacattaaaaaaataaaaaatcaaatattacaaaaatataaaatttaaaaaaataattcagataaataatgggttttaaacagaattaatcatttatcaatcgatatattaattgcaaaaataagatcaaattagcgctatattaatatgtaagtcatgtaaaatcctgggtagtatttgataataatcaacatgatttgcaagaaatagtctaattattggaatgaaattatatttttttagaacataaacgtgaatatcagttgattaacaggagtaatttaagtttactaaaaataaaaaacaaaaactaattttcagtaattaatagaattaacttatgatttgatcaagtaaaaattcatctaaagtagttgaaaaacgcaacgatatagtatatcattctacattgaatgtaagcgaaatggttactaattaaattgagtaaataaactacggctccaaatgttagagctgagaatttaatttgaaaagattgatacataatcttcgtaaacttagctgataaacattaaccaagagggggaaccagaaatgactaaagcaatcgacctatccggccagagattcggtagattagtcgcaattaagccacagggaaaaagcacgaacggcaatttacgctggctatgccgttgtgattgtggaaactacactgaagttgatggcgtacaactcagaagaggcgacagtaaaagctgtggctgcctacggcgtgaagtgatgcggaaacaatatcgtgaaaatccagcaatggatgtttaccgtggaaagtctgatagcttctacaataaggatggggtttcctatgcttcgattaaacgttctaagcggaaccgttctgggattattggagtttcttatgatgaaaagacggatcgctggttggcacggttaatgttccatggtaagtatgttttgttgaagagctttgaaaccttcgatgaagctgctgaagcccgtcaacaagctgaagcaaagtacctgaagaaaaatcgcggtacaaaacaaacaagcaagaactaaaaaagaagacggttagtcttcttttttttgattataattttgaattgcttcagtgatgacttgctcaacaaattctgatcgatgtaagccaagtcccttagcaacggtatcaatttcttcggacaaatctgctggtaaggcgattgctgtatacgcttttttgactgtcattgaaagcccctccaattaaacattttaaaggaattataccatgaaatagaatttcttgtgtttaaatttgaattgattaaaataaatatagatcaatgaatgatagtgaggtattcgcggatatgatttatggctttttaacgacccagcaatcgcacaaattagaacagttagtagccacaattgatggcgatcagttgtctgaggcttcggttgttgaagtaaaacagtttattgcaatgtttataaacaaggcgctgccattatttgatccgattaactggatgctgaatcaagaaaagcaagaagcaattactgatttgctggttacattcttgtatgaacattataatctgccgttttctaatgagtttgttaatcaatacatcaattatacggatcttgttgatcaaatttgtacagagtataaaaagtcagttatcgatcatgacttgactgaaggtaattggcagttagctgctgaacgatcgccacacgccaatgcatctgtgccggtaaaattgcacgtcttaatcagccatcaagttagcctcaagcgatatcagtcactaaaagcggctggaaaacaggtggtaccagataacttgacacgctatcaggcagcacggagctattatcgaaacgtgcttggaaaaagtatggaacaacaacagtatttgaaacataatgttaaccaattaatcgatcaatggcacaaaatacaacaggaatttcaacgagatgtgagtaatgggcgttgtctcgaatgcgatgccatgttaacgcaggctgaaaaagcgattgaaagtgaacttagtgaaattctgattagtgatattgtcgattgatggcgctgattggggggctctgattgcgacatgaccaattagtacaagcaaaaaaacacatccaaaccaaactggctatctggattgtgatgacggttagtttttatattttacaattgttaatgccatggtcaattctgacgtatgtcgcgtggctatcatcaggatactgcgtcgtattgttttgcatatttggaacgcttagctggcggctaattcatcattcgaaataactatttagggagaaagataatgcatattctaatagttaacggttctacaccttatcccgatgcgaagggcgcgttgacggctgcgttagtacaacagtaccaacaatgttgcgaacaacgaggatggtctgttgaaacaagtttgaccggttcatttgatattgcagaagaacaagctaaaataacgcgtgcagatttgatcatttttcagtttccggtctattggtatcaggtgccatcgagattgaaacgctatttagatgagattttaacgatggattttgcgtattatgcgagtgaagaatatgcccatggtcctgcgttaactggtaaacgctatttaatctccacaacatgggcggcacctgaaacagccactaaagcgggtggatttcttgcgcggcattcgttagaggaaattttcttacctttggcgttaacaatgaagttttgcgggatagaaaaagtacaagaaagcccagttggtttttggggagtgcatgataagaccgtgaaaacagattatgaggccgtaattaaaggggtaattggatcaattgaccctgagtaatgtcattctcgaagaatgagagcttcatcttgtaggtacaagtttactgcgttatgataaatgaaatagcgcttacataaacttaattcagatggaggctcacaatggaaattacacaatcgtttttgaaccaacttcccttacaagataaggcggcaatcgtttgcggacatcatttttggtttactcatgaaaatttaaagtatggtataaaaaaagtgatgatgacggatggcccttcaggactccgtaagcaatcgagtagtggggatgcgttaggcattaataatagtgtccaagccgttagtttcccggcttcggcactgacggcatgttcatttgatcgccgttcgattgaagcgttaggtgaacatttaggacaagcggctcgggcagaacagatcagtctgttattaggaccgggagttaatattaagcgaggcccgttggccggtcgaaacttcgaatatttttcggaagatccttatttgactggtgagatgggtgtcgcctatgtaaacggtgtgcagtcacaacatgttggtgttagtgtgaagcattttgctgcgaataatcgcgaaaatcagcggtttacggcttcttcggatgttgacgaacggtcattgcgagagatttacttggcagcctttgaaaaaattgttaaaaaagccgctccagctaccttaatgtgctcatacaatgctttgaatggtacccttaattcgcagaatcattggttactgacggatgttttgagacaggagtggggctttgacggactggtcatgtctgactggggagccgttgcagatcacacggcggcaattaaggcggggcttgatttagagatgccgggaaaaggagctgagtccgaacaagaaattattgatgccgttcatgatgggacgttagatgaacatcagctagataattcagttcgacgagtgctacgaactgtgcaccaatggccagcacctgaatcatccatggattatgatttggaagagcaacatcaatttgcccgtcaattggcagctaacagtatggtgttacttaaaaataaaaatcagacgttgccaattgaccgaaatgaaactgtggctgttttaggagaattagctgttaaaccacgtttccaaggtggtggtagttcacacgtcaatgcttaccgagtttcaataccgtatgaagaaattagtcaacgatcgaatgcaatttatgggcagggatatcaattggcggacgaaacgactcatgaagcacttattgagcaagctcttgaagtggctaaagatgcagataaggttattatttttgccggatatcccgagtcgtatgaatctgagggatttgataaacaaaaaatgacactgcctactaatcaaattgagttgattaaggcggtgtcgcaaatgggtaagccggttgttgtggttctgcagaatggctcggcagtcgaaatgccgtggatcgatcaagtctccgcggtacttgaaacttatcttgccggagagaccgttggagaagcaactgcggatgttttatacggggacgtcaatccatctggtaagcttgctgaaacatttccgcttaggttggaggataacccgacctttggcacatttgggacggatcacgatcatgaacgctatcatgaaggaatttatgtcgggtatcggtattacgatgtgaagcaaaaaaatgttctatttccatttggctatggcttgagttatacaaagtttgattaccaaaacttacgtattcgagtaacgggaaatcgtgtcagagttcagtttgatgtcactaatgttggcgaccaatctggccaagcagttgctgaaatttacgttgccaaccaggttagcgaagttgaaaaaccaattcgagagttgaaaaactttgacaaggtcgatttggcaccaggagaaacacgaacagtgaccgttgttctgacggatcgagatctaagttggtataaccaagatcagggacgatggcagtgtgatgcaggaaattatgccattcagattgggacttcgtcacgaaattgggtgctgtctcaggttattaaatttacgccaatcaggcagtcacacgttcaaattaccgaaaatacgtatgttggagaactccaaaaatatcccgaattgcaatcggcactgattgattcaggactggacgcggtaatccagcgggtggcacaggaaagtgatagtgcacgtttgcttgaaaacatgccactccgagcaggtgtgatgattggtattgatcgtgcaatggtgagtcgctttttacaactggcaaatcaaaataacggttataatggctaaagttaacatgtttgagtatatggtgtataagttcattaaagaggtcggaagaaatttcttctgatctctttaatttggattggttatcgagagggcgatcatcatggttttatggctttgataaatgatataatagtcgggacgatgatgtagggggagaagacgttgaatattaaaagtattgcacagaagacggggtattctgaatcgacagtttctagagcgttgaataatgatccgcgaattagcgaccgaacaacgaaactcattcaagaaatggcgactaagctaaactaccaaaaggattttgctgctatgaatttaaatcatcaggaatcaaatatcctggccgtgatttttcccccggaagattatatgaacattaataatccattttacattgagattatcaagcaggcatcctatgtggccgctaaatataactatatgatttctgttattttggcacaaaatccagatgaactgggacaaaaaattgacatgatgatggctcaggggaaggttcgcaaatttatcatgttgtataatttaccgaatgatccgttgattggtaaatttgatcggcaagatgtcaacttggttgtcattgggaatccattaaatgaccaagttgtgtttgttgacaatgataattatcaagttggtcgggcagtagcacagacgctgttgcaagacaaacagcagacgccggtttatatcatgtcgcaacgtaaatggaaatttgaaatggaccgtcaacggggcattatttcttatttgcaggaccacaattgtcagttgcaaacaatcgagtttgacgaaaccagttctgctgtgacgtcccagctgaaacagttggggcacgagaaccgacctatcattgtttccagtgatgatttattggcaaaactatatggaattttaaacttcaatgctgaacaaacaattattagttttaacaattccatctttattcaaccaatcagtcaaaatattaagtcggttgacctccacccccatgaaatgggaagcaaagcggctgaacttctctttgaaggggagtttgcacaggttaaaaaggctaactacgttggattcacaatttaagttgtgagtctttttttataaaatttgtgcaaccggttgcattgtgtggaagcgtttactataataagggacgtcgacaggttttacttttggtaaaatggaaagggacgtgagttatgatggaaaaaaaggggttaccaacactacccgcaagtaaaatttggctaatgaattttggctttttgggtgttcaagttgcgtttacgttgcagagttcgcaaatgagtcgtatttttcaaacaattggtgcgaatccaaataatttaggctggttctttattttaccaccgttagctggtttgctcgtgcagccaattgtggggacatattctgatcgtacgtgggcaccaaaacttggcggtagaagactaccttatcttttaatcggtgcattagtggccgtaattgttatgctattattaccaaattctggtagtttgggttttggttatgcttcttttgcagcactattgttcggtgccattaccgtggcatttttggatgtttcttcaaatatggcgatgcaaccatttaagatgatggttggtgatatggtgaatgaacagcaaaaggattatgcttatggtattcaaagtttcctttcaaatgctggttctgtgattgctgcaatttttccgtttgtgttaactgcagttggtgtttctaacatcgctgaaaaaggtgttgttcctgattctgtggtttggtcgttttacatcggtgcggctttactgatctttacaagtttatttagtgttttcaaagttcaggaatacgatccacaaacgtatgctttgtttcatggaatttctgaagacgataataaatcaggtggcaactggtttacgctcttgaaacaagcaccaaagacattttggaaagtttcattggttcagttcttttgctggatggcttttcaatatctctggacgtattcagcaggggcaattgcacaaaatgtttggcataccaccaatgccagttcagctggctatcaagcggccggtaactggtacggtattcttgccgcaattcaagcgttagccgctgttgcgtggtcatatttgttggcaaaattaccgcctaaaatggcgaagatcgcctatgccggaagcctactattaggagcgatcggatttatttccgtcttctttattcacacggaatatccactgattctatcatttgttttaattggtttcgcttgggcagcaactaacacctatccgttggcaatggtgacgaacgcactttcaggggcccatatgggtacttacttaggtctatttaatggttcaatttgtttaccacaaatcgttgcctcggtggcttcatttgcacttttcccactgttgggatcgtcacaactgaacatgttcatattggcggccgtgattatggcgtttggtgcactatcagtaagttgggtaaacgacaagaaggaggaaaaaattaatggctagcacacgatggtggaaaaacgaggtagtgtaccaagtttatccacgttcatttcaagatacgaataatgatggtatcggtgatttaaatgggatcacagcgcatctagattatttgaaggacttaggggtaaccactatttgggtttctcccgtttacaaatccccgatggtcgatatggggtatgatatttcggattatcaagcaatcgacccacaattcggcacaatggcggatttcgatcacttattggcagaagccaagaagcgtggaatgaagattattatggacctagtcgtcaaccatacttcagaccagcacgattggttccaacaagcattagcggatccgcagagtaaatatcgtgattattacatttttaaacattctgacgatggtcaggtgccaaataattggcgttccatttttggtggctcaacgtggacagaggttccaagtgagcccggaacgtactactttcacacgtttgcaccacagcaacccgatctgaactgggaaaacccggtattacgtgaagaaatttataccatgattaactggtggttggcaaaaggaatttcagggttccgaattgatgctattacgcatcttaaaaaggatctagactgggctagtattgaaccagatggtgaagatggattagctaatgttgtgaaaaaagggcagaaccgtccggggcttggcgctttcttaactgaattaaaggcgaaaacatttgataaatacaatgccatgacggttggtgaagcatatggggtcccagcgacagatatgcctaaatttatcggacctgacggctatttctccatgatcttcgatttttcatattttaatatcgaagtgaacaatgtggatgaatggtatcgtggccgctcaaattggcaagtaaaagatttgaaacaactgttgtttgaaagtcagcggtcaatcaagacagccgatggttggacggccaatgtgattgaaaatcatgaccagtctcgtgcggtttcaaagtggatcaaaaatccacagtatcagacaccgctagcggctaaagcccttgccacaatgtactactttttgcgggggattccgttcatctatcaaggtcaggaactaggtgccaaaaactttaagcggacaaacatcaatcaatttaatgacttatcttctgttaataattacaagatggggcttaagttggggatggatccggagcaggtgctagatttggttaactttaaatcacgtgataatgcgcgtgtaccaatgcaatggaccggtgaccagtttggtggcttttcagaccatgaaccatggttagcaatgggcaatgatcgtgaagcaatcaatgtgatggatgaaaataaagacgaaaactcagtgcttaattattatcgcaaactcaatcaaatgcgccaaaatgagcgttatcaagatgttattgtgaatggtgagttggaacaactgaagacaccggataacgtcgttggctaccaacgactgacagatgatcaagaactagtagtctttgtaaatttgggcgaagaaacagaaacaattaactacacaggtaattatgagcttgttttaactaactcaagagaatttatttcaatgaagccagaacaattggaattacgaccttatgaagcagttgtattatttaatcagggtaaataatacagcgtaaatgaattaatattcaaaaaacgttgacagtatttaatattgtgaatataatacaagtacattaatcgtcatcggtatttctatcaccgggtagaaattactttgggcatctgtactgtaaaccgcaggtacggcgtgtacgagcgccataagggttacagtatgggtgcttttgtattgaaaagggtaccaatgtacgatttattagaattacagggggaggtagcgtaattggaaattaaagagtttggcgtcgaacaatggatgaatgactatgaagatgatgcacagttcaatttgggtgaaacctgtgtctcaccactatcgcttcatgatttgttgatggtgacgcatgttgatgagccaaaatttatgcatgaattgttgcataaacggcttacctatggggatattttcggtaatgttgaactgaagcaaaacattgcgcgattgtatcaaacggcgctgaaaccggaccaaattgtgacgacgcatggcgcaattggggctaataatttggtcctaaattctcttgtcgcaccggatgatgaggtagtggttgtggcgccaacttaccagcaaatgcaatccatcccagaggcattgggggctaccgttaaattgttacaattaacggcggagcacaactatttgccggatattaatgagttgcgtcagctagttagttcaaagaccaagttaattattttgaataatcctaataatccttccggtgccttaatgtcagaagaagtgttacgggatattgttgtggttgcgcaaaaagttgatgcatacgttatgtgtgacgaagtgtaccggcatttaacgcaagatgatcagtactcaccgtcgatcgtcgatctatatgaacatggtattgcgacaagtagcatgtcgaaggtcttttctcttgctggtttacggttgggctggatcgtaacgcgtgatgcagaagtgatggccacgattcacagccatcgtgattacgatacgattagtagtggtgtcttaaatgagatgattgccaatgtcgcactatcacacgcggaaatcattattgagcgaaatcgcaagattattcgtcaaaatttagtagttttagaagagtgggttaaaacgcagcctcatatttcatgggttaaaccagcggctgggacaacggcattgttgcactatgatttcacaacgaatagtgagccgttttgtgatcagttatatcaacaaaaatgggtattgctggtcccaggggcagaatttgacattgaacacgcggttcgaattgggtatgcgtttgaaacagcgcaattaagaaatggacttgctgaagtggctgcattcatttcagaaaatcaggcatcattataattatggggagagttttaaaatgaaaaagcattttttggtattattaagtgttatggcagcactgacaattgtgttagctggttgtggcaataaaaaggatactagtgttcaaaaggttcaagacaagaaaactttggtcgtgggaacctctgctgactacgcaccatttgaatttccaatcatgcaaaatgggaaaaagcaaattgttgggtttgatattttgctggcgaaacaaattggtaaagaattgggtgtaaaagtgaaaatcgttaatactgactaccctgatttgctaccagaactaaagaataataaggttgatttggtaattgccggaatgacacctactgcacagcggcgtaagtcgattgctttctcgaaaccttactactacaccagtaacacgttattagttcggaaagcggatgccaataaattcaatacaattgcagatttaaagggtaagtccgtgggggcacaacagagttccacacaagaaacaattgcgaagaaacagttgaagaatagcaacgttgtgactgaaagtttggtaactggaatgactaccgaattacagaacggtaaattggacggcgtcgtggtggaaaaggctatttcagataattacgtacgcaagtatccagaaaaatatgcgattgcaaaggttaaactgacaacacctaaacaagcaagtcagatttgtgtcgccggccgcaagggtgataaggctttgatgaagaagactaacaaggtaattacccatttggataagactggaaaactggataagatgtttgaccaagcagaagcaattcaagttaaatataataagtaaaaaaattgaatcgttacaaaagagatcgatacagacatatagatgtttgtgtcgatctcttttggtataggcatgttaattaggacagatgatgaaaaattccctgcatattttgttcaatttggtttaattcttcggaataggaccgtagctgttcgccatatttatcgacgagggtcgggttggcttttgttttataacgtagtttatgttcaagacttgcccacatatccatgccaacggttctaatttgcacctcaacaggtgtattttgaacgccatgagtttcaaatacgggaacggaaacgacaatgtgcagactgcgatagccacttgctttagggttcttgatataatctcggcggcgaatcaactcgacgtcgctttgctgaagcagcattttttcaacagaataaacatcatcaagatagttagtaattacacggatgccagcaatatcataaatattatcttgaacactctgagcgcttaggtcataccctttgcgcttgattttttcaaaaagactcggcacttctttgatgcgttcttccatgtggtggattggattgtgatcatatttaaactggaattcactgtctaaattttccaattttgtgccaatttcgttcgcgccctctgtgcataggtggtagtaactaataaaatcttcaaagtctttaaaatcatgatcatccaaaatttgtcgaatttcagatgacgattttttcaagttgaagaagttgtctcgttctagtatcataatttcctccgtcgttaatgttacatctatcataccctatttgaatatgtaagtaaggtttctttactaattgttaacgctttactaataaagttgaaaacggtttaaaacagtgtagaatttataataagtgttaaagaagtcgatgaagggggttaaaatttgggcaataaactgtatggcacggttcttctaaaagcagataaaatattggatgttttgagtgatggcaaaagtaaatcgctgcaacaaatcgcgactagcacaggtatttcagcctcaacagtttctaaaattttaacgacattaagccacatgcattatgtgactaaaagcgatacgaataaacgatttcacctcggcgcaaaattaattcagtttggacaagttcagactggggcaacggacttgattgaactgacacatcttgatctcgatcggttacaggccaagattgacgagacaattcacctatcagttttggagaacaataaggcggtttatgttcgaaaaatggaaccgcagcatcaaaatatttttatgacatccaaagttgggattgccagagaattatatagctcggggatggggaaggcaatgcttacgaccttcgacgagacggcgttggcacattatttaagtgtaacgaaattagtaccatttactgactttacaattacggatgaaatgcagttgcggcgctctgttcatcaagcacagttgattggatacgcaattgacgatgaagaacaggagaaagattgtttttgtgttgcgactaccttatgtgaaaatgatcaactactgggggcaatgagtattagtgtccccaaatttcgagttacgccacagtatcgcaacttaatcattcaagaattaatgaaagccaaacaacgaattgaaggacgactaagcaaaaacaagtaacaaagtattttaaaagagttgcatttttgatgtaagcgttctattctataaccgtaaaaaagaaatttgaatttccatataagaaaatggaggaattaataatgtcatttagcatggttacgaagtatgcacatagtcctgaggatattgatcattacaatacggatcaaatgagacaagaatttttgatggaaaaaattttcaatcctggcgatattctgttgacctatacctataatgatcggatgatttttggtggtgtcacgccggttacccaaccgttggagattattttagataaagacttgggtgttgattatttcctgcaacgtcgtgaattaggtttcattaatgttggcggtcaaggaattgtcaccattgatggggatcgccaggcaattgaaccgcatgatggctattacgttggaatgggaacgaagcacgtctgttttgaatcggtcgatcaagcacatccagccaaattttacgttgtatccacaccggcacataaaacgtatccgaccaagaaattagcctataaggattcaattgcgatgccgatgggggatcaagaacatatgaataagcggacgattcataaatatattgatgcttcgatcatggatacttgtcaacttcagatgggatatactgtgttggaacctggtaattcatggaatacgatgccagcacatactcatgcacgacggatggaaacctacttataccttgagtttggttcagccgatactcgggtctcgcactttatgggaaccccagaaaatacgaagcatatttggttggaaccggaacaagctgtcgttaatccaagctattccattcattgcggggttggtacgactaactatgcgtttatttgggcaatgtgcggcgaaaatcaaacatacgatgatatggatgccgtggatatgcatgatcttcgctagactaagggtgatgggagttgaagaaaatggcacaatcgcaagaagaaattaatcataattcagaggcacttcaacagtttaaaatggactggttcagtttaaaaggtaaggttgcgatcgtgactggtggtaatactggacttggacaaggctatgctgtcgcgctggccgaagctgggactgatattttagtggttaaccacggaacacagggtcgtgatgaaaccagaaagttgattgaagaaaaagggcagcgagttgaattttatcaagctgatttaacggaagatggcattgcccccaaggttgttgcaaaagcactagaactatttggtcatctcgacattctggtcaacaatgccggaatgattaagcgaaatccaattttggagtctaaggatgaagactgggatcgtgtcattgcaattaacttgtcggcggtttaccggttgtctttggcggcatccaaagtctttgcgaaacaaaagtctggtaagattatcaacattggttcaatgctttctttccaggggggtaagtttattccatcctataccgcagccaagcacggtgttgcgggattgacgaaggcgtttgccagtgaaatggcagcctacaatgtgcaggttaatgcaattgcacctggatatattaagacggcgaatacggcgccaattcgggctgatgagtctagaaataatgaaattcttggccggattgccgctggacactggggtgaaccatacgaactgatgggcattgccgtttatctggcaagtaatgcgtctaactacattaatggtgcggtaattccagttgatggtggctatctagtaaggtaagatcatatcagagactttatagactaaagcgagggaaagacgtgactgaattattaacgattggggagccaatggtcctctttgcgtcagatgaagaggatgtaacgcttgatcaagcaacacatttttcaaaatattcggcaggtgcagaactgaatgtcgcgattggggttgcacgattagcacaccgtgttgagtacgtatctgcggtgggggatgacccattcggtaaatatcttagtcgagaaattaaagataacggaatcgctacgacctatttattgacggatcccgatcactggacgggattttatttaaaacaattagttagtcacggtgatccagaaattgcctattttcggcgtgattcagctgcggcccatttttcgtcgtcggtactggacaacattaatttcaatgacctgcgattggcccacttatcggggatctttgcggcgttgtccgaacatgatttagccgtttacaagcaattaaatcagctactgaatgaacatcaaattccagtgatctttgatcctaacttgcggcccacactgtggcaaagtactgaagatatgattcgggtgaccaataatttggccagtcaggcacaaattattatcccaggattaaatgaagctaaaattttaactggattaacggacccagccgaaattgctcaattttatttcaatcaaagtgtcgtaaccacaaccgtaatcattaagatgggacccagtggtgcggttgtcgttgatcgaaatggtgccggaatcaaagtgagtggctacccgattgaatcagttgtagacacagttggtgctggggatgggtttgcaacaggcgtgattacagcactattagagaatatgtcgatgatagatgctgtgaaacggggatgtgctattggggcgatggcggtcatgagccatggtgacaatgatggctatcccacaaaagaacagttggaaaatttttaccgacagcatgtcggtgggaggatcgccaaactatgaaaagagctaaattgctacaacgaatgattgatacaggtgtcatttgcgtcattcgtgctgataatgatccggaagcaattaagattgcagatgcagttatcgctggcgatgttactggtattgagctgacctacagcgtgccacgtgctgacgcggtaattgcacagttggtcgataaatatgctggaaccaacgtgttgataggtgcgggaacggtattggatgcaacatcggcgcgattagcaattattgcgggggcaaactttattgtgagtccggcttttgacaaggaagttgcgttgatgtgtaatctttatcaagtcccatacgttcctgggacgtatacgattactgaagtacaaacggcactgaaatatggttcggaaatggttaaactatttccgggtgaacttgcgggaccggcaacaattgcagcctaccatggaccatttccttatttaaacgtgatgccttccggaggtgttgatcttaaaaacatgggtcagtggtttcagtctggtgcgtcagtagttggtgcgggtcgtggaatcacagcacctgccgacatcggtgactatgctcaagtgactgagcgagcacatgattatattgcgaaataccgaacaattaaattaaattctgagcagtagggaagggactaacgtcctttctttttttgcttattttaaatacgaacaaatttatggttaacttcaaataaagttcgtgttatactagtgatgctttaaaaatttgttcgtgatggagaggaattcactataatgatctcacaggtaatcgaaggttcttactttacggcacgagattgtgatcaggttgactttaatcaagatgcacttatctgcattgattcggagggaattatcagtcgaatcgttaatcatgacgatccaaagtttggagaagttcgacgacaggcggaggcacaaaatatattaacgcggctctccgattctcaatatattttaccagggcttatcgacctacacgttcatgcgccacagtgggcacaagcaggactcgcattagatcgaccactgaatgagtggctaaatacatacacatttccactggaagcaaaatttagtgatgttaattttgccagacgagtctattcacaacttattatggaactgctggctaatgggacgacaaccgtcatgtttttcggcacaatttttaatgagtccaatttattactggccaagcagtgtgcacaactcggattacgaggatatattggcaaagtggcgatggataacccggatcagacaccggagtactatcgggatttgtccgcaaaacaagctctgctgaacactgaagaatttatttttgcgatccaagagctacaatctaaagtttgtggaaccttggttccggtaatcaccccaagatttgttcccagctgcaccgacgatttattggcgggactggggcgtttggcgcataaatatgatttgccgatccagtcacattgtagcgaaagtgattgggaacatggatacgcaatggcgcgcttcaaaatgacggatgctcaagtccttgaccattttggcctgttaacggagcgctctgtgatggctcatacgacaatgctcgatcatgatgatgttgatttgtttaaggctcggggtacggccatcgcccattgcccaatctctaacgcctttttcggtaatgcggtgttaccaacaaagcgaatcttgaaaaacggtaataaagtgggcttgggaaccgatatttctggcggttattcaccaagtttgtaccgtaatatgcagcaggcggtaatggcctcccaaatgctggaagatggtgttgatcaaaccattgctgcggatcatcgtggggttactgattcacgaatttcaattaaaaatgcgttttatctggcaacgttaggcggtgctaaagcgctacatttaaatgctggcgcgatcaaggtcggctgcaaagcagatatgcaggtcatcaataaacggactagtttaatcgaaacgcaagctgacgatatctttgaacagctaatttaccaaacggagcgtagtgatattaaacaagttttcattggtggaaccttggtatatcaaaattagggagagaattgacatggaagttgaaaacggaattttaattggaccagatgataaaatcaaaaccagtcaggctggcttgcttggcctgcagcatgtattggctatggatgtttatgtgccaccggtaattttggctggtgcgctatcaatgggggcggcagatacatcaggcttgctgcaatccaccttcttggcggccggaattgggacgattattcaaacatggctgtttatgaagatgccggtttctcagggaccgtcatttgtaccattgggggcggcagccggaatagtgttggcttctgggggtgttaatcaagggatgggaactttaatcggagcttccattattggtgcactgttattgatcgtgttagggcttagtggaatgttccagaaaattatttccgcgctcgtaccggcaattgttggcggtacgattattacatgcgtgggattatcattaattccatcagccctgaatgacaatgttttcgaagcaagtggcaatgttaatcaaaatattttgttagcttcaattacggctttgaccttgctggtggccgtggcaattagtattcgctttccacagcttcaacgagttttcaaaacgggttctattatattagcgttgttggttggctctggtgtcgccgctttgatgggccggtttgattggcagaccgtcagctcagccccttggtttggcctaccaagctgtacgatttttcattacggtgtccatttttcgttatccgcaacccttaccttcattattatctatgcaattttaacgacagaaacgaccggaacttggtttgcaatgggcgcggttattgatcataagattactgataagcagtggaaccgcgggattattggtgaaggaattagttgtttggttgcggcactgtctggaacaacacctgttacgggttattctactaacgctggtgtcatttcaattacgggaatcgccagtaaacgggttttcattgctgcaggactatggtttatcttactcggcttctttagtaaggtctctgcgtttctttcagcgattccagctgctgtgattggtggggtatttgcaatcatttgtgtcaccattatgcttaatgggttaaatgtgattcggcgcttgaaaactaacgaaagtgacctctacgtgattgggttaccaattattctgacgattgcgttagttttactaccatcaaaagtgatgaatgaggcaccccaaatggtacaatatttactgggttccccaattgcagtggcagcagttgctgcaattattctaaatttggtaatgcctaaacggcacccgttagtttaaaagctgataattaaataggtcaattcaatatcatgagaggttaaaaccctctcatttttattaactatagttatagagataattaattgatgatttaagttatttctaaagtaaaagggtgtctttactttaaatagttaagtaattaccgtgattagttttattttaaacattcgattataattaaaagtgatatgtaatcgttgtatttttacgattgtatcgaatcgtaaactgctttattaatcaaaatatgttaaacttttctctaatgtttttttaatgttgataaatgaggtgataacaattggacgaatataaattatatccagctggagactgtgcgattaatgttacgtttagcaatcgtgttgacccacaaattaatcgttcgattcagcaacttcaagaaaatttgcggtctatgcaacagactggaattactggatttgttccagcttttcgaacgttgacggtattttatgatccgatgctggtgacgtttgaacagttgaagcgtgtgattcatcaggcatcattgaaagcatccacgcttcaaacgcaggcaattcgtatcgtgcatattccagtttgttatgggaaagattttggtcctgatttgaagaatgttgctaatcatgccaaattgacaccgagagaagttgttaaacgtcattgccaacccaactatttgatttacatgctgggttttttacccgggtttgtctatctgggaggactagatccacaacttgcgacaccaagattagcaacgcccagattgaaaattgaacccggtgctgtcggaattgcaggggagcagacgggaatttacccgattgaatctccaggcggctggcaaattattgggcaaactccattaagattatttcagcctgatcaagatgagccattttactatcacgctggggattatatccactttgatccagtttctgattttgagtatcagcagataaagaaaatggtggacgaagggcactatcaagtatatatcgagacgaggaaggtgactgaagatggggattcgagtgacacagccgggattactgacgacggttcaggatctgggaagaactaaaggccttgcgcaaggcttttcaccatctggtgtcatggatcagtggtccgcgatccaggggaacttgctcgttaataacgttgaaaatgaagccgtccttgaatatagcattctaggaccaactgtgacattttcaacaccggccgtcattgctgtgacgggtggtgtggttaatgccaaactaaatggtactcagattcatgaaaatcaggcgattgaggttaattcggaggatgttttagaaattggtcctttgacggagggacgctatgggtatttggcggtttcgggtggacttcaagtagattcaattttagccagtaaggcaactagcttgcgctacggactgggtggatttaagggccgcgcacttaaaacgggggattttctagtaacggtagagccgaagcctgtgattgcggaaccggaaaagcgaaaaattgctgttagctcacacgatacagatcaaacggttttaattcgtgtgacagaaggaccgcagtttgctcagtttgaggctgaaacaatcacagcatttacaaaacaacagtttaaaatttcaaagaatgcggatcgaatggggttacggttagagggtcaaccattatcagtggctaatgtgccagagatgctgtccgaagcaacggtggctggcggcattcaggttcctaagaacggtcaaccgatcgttttgatggcggatcggcaaacgactggtgggtatcccgtcattggcgttgtcgcatctgtcgatttaccaacgatagctcagctggtaccaggtcaggtagttcgattcaaaatgattagtttgacgcagagtcaacaagcactagccgaccagaaagcgcaactcaagcagatcaaacaaacgtttgacgccttaaacccaaaagtaagtcgaaaaacagccactaagattagtagactgtttagataaaataggaggagatacgatgaaccttgatgaaataaaggctgtaatggcgttaatgaagcaaaatgatgtgacagagtttgaatacgaaaatgacgaacaacgctataaactgaagcgtggtagcacgcaaggggtcccaactacgcaacaacccgttgcgccagttcaagaggcggtgacaccggtggctgatgaaccaacgaccattaacgcaacaatggttggcatcttttatgaggcacctagtccggacgagaaagcttttgtgaaggttggagatcaagttgaaaaggggcagacgattggtgtcattgaagcgatgaaaatgatgcatgatgtcgtcgctgatcacgccggaaagattaccaaggtattggtagccaacgaagaaaacgtagaatttgaccaaccgttatttgaaatcgaaatcgattagataaggaacgtgatcacatgcataaaattttgattgctaaccgtggtgaaattgcggttcgaattattcgtgcttgtcatgaaattggcttgcgcacggttgcggtgtattcaaccgttgatcgagatgcactacatgttaagatggctgatcaggcggtttgtattggaccagctaatccgcaggcaagttatcttaatcaaaccaatattatcgaggctgctcgacggacaggggctgacgcaattcatcccggatacggttttttatccgaaaacgcggaatttgcaaaattgtgtgagactcagggaattacatttattgggccacattcagagacaattgcgttattaggtgataaagctcgtgcgcgtgaggtgatgcaaaatgcggatgtaccagttattccgggaagtgcagaaggattcaccgagcttggtactgccctgtatcaagccaatgaaattggctatccagtgatgctaaaagctgctgcgggaggcggtggtaaaggaatgcggttgattcatagtgaagcacaacttaaacatgaatttacgatggcccaaggggaagcgcaaaaggcatttggcaatcccgaaatgtacttagagaagtttattgttcgtcctagacacattgaagtgcagattttagcggacagctttggtaatactgtatcgcttggggaacgggactgttctttacagcaatatcatcaaaaagtgatggaagaagcaccgagcgcaattgatcacaaaacgcgctatgaaatgttatcgaccgctcgtcgggctgctaaggcgctaaactttttgggcgctggaacgatcgagtttttatatgctggccccagtcaattttattttatggaaatgaacacacgaattcaggtggaacatccgattaccgagtttattactggagtagatctcgttcggggccaactgagaattgctgcgggaatggcgctgggaattagtcaggagaaagttaccttaaacgggtatgcccttgagtgtcggattaccgcaaccgttccgggaaccgttaaggggcttcacttaccaggtggcaatggtgttcgagttgatacagcactatatcaaggctatcaagtaccggcaaactatgatgcactgctcgcaaaaattattacctatgcaccgaccagagagattgcggtaaaaaagatgcaagttgcgatcgatgaaaccgtaattgaaggggttggtaccaacttagatttcttataccggttacttaataaccaggatgttttagataataagtttgatattgaatttattgatcgattgataaaggaggatgtccatgactgaattcatcacgccaaaacagattcgacaacaagcacgaactggtgccttcacgggacaaacaagtggcatgtgcccgggctacacacaagctaacttagtcattttaccgaaaaaagaagcatacgactttttgttatttgcacaacgaaatcccaaaccctgtccgattttggaagttgcggatgcgggatctaaacgactccaaacgttcgcacaggatgttgatctggcaacggattttccaaagtatcgcgtttaccaaaatggtgaattagtgtctgagcctactgatgtcaccgatatttggcgtggtgatcttgttagtttcctgattggatgcagtttttcgttcgaagcagcactcattgcagctggaattgaaatgcggcatattactatgaagcgaaatgtaccaatgtataaaactaacataaaggctaaatctgctggtcaatttcatggtaattatgttgtcagtatgcgaccaattcccgaagaacaggttgttaaagcgatcacgattacagagcggctgccacaagtccatgggaccccaattcaaattggtgatcccgaacgtatcgggattcaaaatcttgatcaaccagattttggggatgctgttgaaatttaccccggggaagtgccagtattttgggcctgcggggtgacacctcaagcggtggtgatggagagtaagcctgaatttgtgattacacatgcaccaggacatatgttagtaacagatattcgtgataatcaattggcagatattttgtagggaggtaatcagatggcaaaaatcgacttgaattgtgatcttggtgaaagttttggacgttacaagctgggattggatgaggacgtattaccgtacatcacgtcagctaatatcgcttgcggattccatgctggcgatcctgaagtgatggcacaaacagtcacattggcaaccaaggatcacgttgcgttgggggcgcatcctggattacatgatttggagggcttcggtcgccgaagaatgcaaattagcgcgctggctgcaaaagctgatgttcaatatcaagtgggtgcattacaggctttcaccccagatgggaaactccatcatgtgaagccacatggtgcattgtacaacatggcagcggctaaccacgagctggcacgggccatttgtgaaggcatttatgccgttgatccgactttgattttggttggactagcaaatagtgagttaataagtgccgctcaggaaattgggttgccatacgcgcaagaagtgtttgccgatcgccaatatgaaccagatggtagcttagtttcacgaacgaaacctaatgcggtgattactgacgaggatgtggctgttaaacgcgttattcaaatggtagaagaacaccaaattaaagcagttgatggttctattttgacaattcacccggatacggtatgtgttcacggggatggcattaaagcggtggcctttgtcaaaaaaattcattctgcattagatcaagaaggaatagaagtgaaatcgatgtaggcttgaggaggcatttgagagatggaaaagaaaacaaaaaaacgatcaccgtttaacgtagcgatgggtgccgcatttatgatggcgatggccgcggttggtccaggatttttgacccaaacagcaaccttcaccagtaagatgggggcagattttggatttgcaattttaatttgtatcttagttgatatcgtggttcagttaaatatttggagaattattatcgtttcagggcgccacgcacaggttttggcaaatgaagttgtgccgggattgggttatgttttatccgctttgattgtgatcggaggctttttcttcaatattggtaatattgggggtgctggattagggttgaatgtactctttggtatctcaccagagaacggtgcgttaattgcagcagccgttgcaatcgtgctatttttagtacgcaatgctatgttggttgttgatcgaacggttcaacttttagccgttgttaaagtgctgattttgatttatattttggcagtcacaaccgttcctcttcaaagtgcggttcaccatacctttatgcccacatccatcgatttctactcgattgtcacgattgttggtggtacggtcggcggctatatttcattttctggtggtcaccgactacttgaaggcggtgtccgtggcattaataacattaagtatgtaaatgaaggtgctttaactggaattggtgtggcgtcagtaattcgagtaatgttgttcttagctagtttagccgttgttttggctggacaccagttggatccaactaacccggctgctacgatctttaaagtggctgctggcaattttgggtataaattcttcgggctattgctgtttgctgcagggatgacctcaacgcttggatctacgtttacgtcgatttcatttttggattacaatgtgaacaaggaaggccacgaaagctggcgtccgtggattattgtcggattcatcgcactttcaacaattattttctactttatcggtagtcccgctaaggtcttagtcattgttggtgcgttgaacggtctgattttgccaatcgcccttgccatcttactgattgcagctacacgtcataaaatcatgggggcgcaataccggcaccctcggtggctgttagtgacaggctggattgttgttttatttatggcctacgctggtgttcgaacattattaacaattcaattttaaataaaatccaagtcatctattgcagatggctttttttatgtgcaataataggacggtctagtataattctgcgcttaagctatttttttgatgatcgttagatgctatcatgatgttataaggattatacaatagttaactgggtaaattttaagttaacacagaaagagaaggtgacaggatgaatattaataatattttgttgtcttcacaggacaatgaaaaaattcaactgctagtttttctgaaagaaaatcccagtagtagtttatataatttcttcctcgctaaagatttgccatacaataaagtgttgtatatctatcataaattgattgcagatttacgagaattcgaagatgatgatttaactattgcggagctgattgcggatgccgattttgatcagtactcacatatcattatgaaccggcaagttggatataaaatgctaatgtctctcattacacagactgatcgcacgactaacgaatttttagaacggcaacagatttcaagaaccaagttataccgattaacctctgatttacgaaaatacatcgggcaatttggggtgacagttaatttatctgaattttgtttgaccggaaacgagacgttaattcaaaattttctactggcgtttttgaatgaaacgggtaccaacattagtgattttctggatgaccgctggcagtccttggttagtcatttaaccgatggctttttgacaccaatggcgtttaaaaatagtattttagttgcacaacggcgacgatttgtgggtattgcacttttacgactttcgcaggggcatcgatatcagattgcccatccaattgatcaacactttgggctcaaatttattaacggtagcgatggtgtcgttaaagactacattaaggttagttgtgatctaacggatgttgaggcccagaaccaatttaatttattaaagtttagcctcaagtttgggcctaattttatcattgaaattagtgatgatgagaaacggatgatcgatgattggttgaaatcatcgccgcaatggcagcagttttggcggcgaattgaaaccggtacacccacaggcctaacagcgaaaatgaagttgcgattagtgggatgtattatttcattggattattttggtaattttccgatttcacgtaataattatgtgaatgattatctgcaaaaggtaagtgattcgcgaatttcaaagtattatgatcaagttaacacgatgatcaaagaactacagttggaaatcacgaccgttgatgggattaattcattagcaaaactatttgaggcactggagcaggtgattgatgacgtttcacataagattaccgtctatgtgaatgatgatgcatatgatgcacaaacggatattattagttacttatttcagggcgtcgtttctgttaaaatgatcaacgagtatgaaccggaagaagtggtatcaatattagtgtacaatcaacaaaatgacaaagtaaatcgtttcttagcggctcatccgaacatgattagtttaagatgggttcagcagcttccggcgactgaaaattactcaaggctattattattaatcaataaatatcgatataacgtgtttaaaaacttgtgaggagtggttacggtgaaagttgttattgttgggtgtacgcatgcaggaacgatggcggcacagcagattattgcagcgaatcctgatgcagaggtgacaatttatgaacgtgatactaacatttcatttctgtcatgtggcattgctctgtacctagatcagacggttaaacatctggaagatatgttttattcatctccagaagcccttgaaaaaatgggggtagctgttaaaactgaacataatgtactagagattgatgcggccaagaagcggttacgcattgttaatatgcgtactgatgaggtgttcgacgatcattacgacaagttaattatgaccaccggatcaaacgcgattgtaccaccattaagaggaattgatgcctcacgggtattgatgtgtaaaacatatgatcatgctaaggaaattaaacgatctgctgaagatgccgacaccattgccttaattggtggcggctatgtaggtgttgaactagccgaaagctatgctcgaacgggacaccgggtgttgctatttcaatcacacgatcaaatacttaaacattatattgatcgtgatggttctacacgattgatcgatttattacatcaacatggggttgaagtgtacttaaatcatcgtgttcgttccttcgagcagggcgacgagaatcaaattgcaattaatacaaatcacgaaaaatttgaagccgatattgcgattgtgacaactggttttatgccagtaaccgaattactggaatatcaggtggatatggaccgtcacggtgcgattttagttaacgagttttgtcaaacgtctaatccagacatctatgcagcgggagattgctgtgtcagtcattttaatccaacgggcgaatcagtgtatgctccgttagcgacgaatgcggtccgccaagggatgatcgttggtaataatgtggtagctgggaatacaatgccatacgtggggacacaggctacgtcagccatgtcgctatttggtgaaaccattgcatctactgggttaacgattgaatacgcgcgtaaaaatggatttgatgctgactgtgtccggtttgaaggaacttggcggccagaatacatgccaaccacggataaattgacgattactttagtatatgataaaaaaagtcgtcttatattaggtgctcagctttattgtcagcacgatgtatcgcagtctgcgaacgccatttcaattgcaattcaaaacaacaatacgattgatgatcttgcgtttgttgatatgctgtttcaaccacatttcgatgatccatttaattacttaaatttggtggcacagatggcagttgaaaaagaacgtcaagctggtaatcatcatccacgctatacggcacttggcaattttcacaactaaaaattaaataactaaattaaaaaatcccgatttttatggcacttaaccagaaaaatcgggatttatactatattactaaccgtaaaattgataagtagtggttattattttatagtaaactcattggaaaactacgcataacgaacatgcaattatgatttggtaggtgataaattttgtcaaaagcgattgatatggttggtaaacgctatggccggttggttgtattaaagcgtgatggcaacagctctaatggtggtgcaagatggttatgtcagtgtgattgtggggtcgtttgtacggtcgatggcacccgtttacgaagtgggattacaagtagctgtgggtgtttgcgggcggagattgcgcgagaaaggttcaagacagatcctaaaatttgtcggaacaaaggtcggcgggatcatttttatacggaaactggattaccttattcatcgttacgagcttctaaacgaaatcataccggtgtcgtaggagtgtcgttagatcgtaaaactggtaagtggtttgcacgcctgatgattcataatcggtacgtattattaaaaagttttgaccaatttgaagaggcagttgccgcacggaaaaccgccgaaaaaaaatatttatataagtagaactccggatattcttggttaataagaatatcttttttttaaagaaatttgcggttgtcgttaaaattcagtagtatgaggagttgaataattatccgtggaggtaaaaatgacaaagcgtttagttctggctgaaaagcccagtgttgccaaggatttagcccgaatattgaaggcaacacagcagcacaaaacctattttgaaggtgaccaatacattgtgacctgggcttttggtcacttgctgacccttaaaatgcccgaagatttaaatcaggactggcaacagtggcaaatggaacaattaccaatgattccaaaacaaattggaattaagccacttcctaaaactagaaaccaattaaaggctatcgcacaattatccaagcgatcggatgtaaccgaaggcattattgcaactgattctggccgggcaggtgaactattggcccgttggatattacaatgggttaaatttgataaaccgttgaaacgcctttggatttcgtcacagactgaacaagctgtgaaagctggatttgccaatctgaaaccagccaaagactacgataatttgtatcgttcagagttagctcgaaccaaggcggactggttaattgggttgaatgtgacccgagcactaacgttgaagtatgatgataatttaaattctggccgggttcagacgccgacactcagtttagtgaatcaggcacagataaaggtggaacagtttaagccacaggaattttatggggtatacatgctggtcgatggcgctcgtaccaaagtccagttgcaacatgcgttagaccttgatacgcgtgaaaaagcagaggatttgattaaacagcttaaatcgagtcaggcaattgtagaacatgtggtaacgaagcaaaaatctattcccgcaccactgccctacgatttaacggagattcaacgggtggcgaatgccaagtatcaatattcagctcataagacattgtctttgattcaaagtctttatgaaactcacaaggtcgtcagttacccacgaacggattctcggtatttatcaacagatttaaaggcaacaatgaaagatcgcttacgggtggtggccggttttaacgaggatgcacagcaaatgcttaagactggtgcccaaattcgactgacttcagtattcaacaatgaaaaggtcagtgaccattatgccttgataccgacagaggagcggccgcggtttgataaaatgtcgaccgatgaaacacgcatgtatcggttaatcgttgagcgctttttaggcttatttgctgagccagaacgttcggaaattacaaaaacaacgattaagactggccaataccaatttaattttcaatatcagcggatcgttgaacccggatggcaatttgaacagacggcacaaccgattgttaaaaaactgactgaaggtcaaacggttatgcctaagtatgaatttaaaaaggagtacaccaaagcaccaaacttaatcagtgaaggtgaactgttaagtcagatggatcaacatcatttggggacacctgcaacccgcgcggaaatcattgaaaagttaattaaatccgagctgatggaacgccaaggacgacaattacatgtgacccctaaaggccaacaactacttaaattagtgaatccgtcattagcgacgccagaattaacggctcgttgggagtctagtttagagaaaattgctcagggtgatcagtcaccagaaacatttatccaggggattgaggctgatactcgacagctggtgaaagaaattaagtcttcgacagcagcgtatcacgattatgcattgaccaataaaatttgcccagaatgtggtcaaaaattgcgtgaacggaatactcgagacggaaaaatctatatttgtagcaatcccgactgcaagtatcggcgacgaaaagatcccaaaacttcgaatcatcggtgccctaattgtcatcgtaaaatgcaaattattgacggtccaaaaggcgcgttctttcggtgtaagtacgatgggacgactgagaagatgatggataaaaagacccgtaagaagaaaatgggtaagcacgaaacccaacgattgatgaatcaaattaatcaagaagatgatgaggcagaaagtccattagcggcagctttgaaaaatttttatcagaattaataaaaaacacgtcaaatttgacgtgtttttctgtaggcttttatcgttgaaggttatttagtaaagtttgtatttttgaaatttgaaacgtagccgacggccttattgttttcaatttgaactttaaaggagactttatcaccagattgagttaaggccgaactcttgtagtcatcgctttgaaccgtgtagatggtctggtgagaatcatctttgagcgtaaagaggagcaatgatttattgtcactcgtagtgatttgggcacgatcaacggttcctgtgagtgttttcttagtgctgttagtggtgttggcagcactgctttcattgccatcaattaaggcctgattgtagttttccaaggcttcattggcggtgtcgccagtcgcatgaatggactgatcagcggcattaatgtagtaataatttcggaaggcgtgcgtattgtcaagaattgaaagcacccaagttggatgaccggaaatattataaataacgggcattgctgcagtccattgctgtgccttatagttattgttggcgttatcggcagcaccgtcagagtccatgataccgcttgtcttgtaatagcttagtttacccgtccgggcgttaatcattgaataaccaagcgcactatccgcttcggttttagggttggtaaaatcagtgaagtattcaacttcacccttattgttgaaagttgagataacattctttttggttggctgttggacaccttttttgaagaaggtgaagttaaaccagccatcttgatactcgccgaatgcttgattcattgaatcagctacttcagttgtgattccttcatcaatccatttaggaagatgcttgagttgataaagcttggccttaccagtcttggcgtttaagaccacgacgtgaagcttcgagtagttaacccgatgactgaggggaattggtttgtacatggtttgaacgtagtaaggggtgccgttttcatcgatttcaagctgtggctggctattatccgcaaccaaccagcttggaaagtgacggtacatgatccgttgggcattacggttgaagtaggaagtattagtatagtttagcttggttttcacaaatttaggttctgcagagagtgaagttgcatcgataatgaagtagccaggtgttgcttgtcctgctgaatagtacttgaagatggtgtcaaattccactggtgcaatatagactggcttaccatgataatattgggcctgaatctcaccgagatggtagtactgtgagttgggtactttactcatgttcttgttcatccggtttttaatcgtgctgggagctaacgcaacgggagtgacacccttcttgaaagtaggggcctgactacttttcttgatggttgactgaacgcttttggcaaccggtttgatgaaaaagtttgagtgccattcaccagcgacaaatacgatcaagatgatcaagagaattgcggccgctagtcgtggcacaactaatccttggtcgttaattacaagggtgagtgcactcatgattaatgtggttacgatccctaacatgagattgaccgttaaaatggagagtgcgtttcgtgacggtaattcaaagtaaatgaccacgcaataaacaatggcctcggcaactaaaataccaagaccgtatttggcgaatgtcttagtgacgcgcgagtgaaaaatgaaagtaagatacaccaaaatgggtgcgataaaactcagtagtagtatgtaaagcatgtaaatcctcccaatgtaaatgaatgcggtaccacggttcattataatagatcacggactgatatactactagagatcgattagatttggcggataactagcatgacttacgaaaagtacgtataatgaacgacatgaatataaaggacgtggaacaatgaaaattaaattaattgctgttgatatggatgggacatttttaagagatgataatagttacgataaacaacgatttggtcgccaactacaacagttggtagatcgaggcatccattttgttgctgccagtgggtcgcaattggaccggttaaaacaacaatttagtggatttgagggagctgttgattttatttccgaaaatggttcaattgttgcgaacggcgataaattattgtctgttaaagaaattcctataaacttactagaggaattactgaaaattatcaaaacgcattttaatattccaattgcatcaacgacaattactggtgagaaagcagcctatgttgatgatcaggaaccacaggcgtactttgatcttaaaaatcgctactactcaacgttaaagcgggttcctgaaatactagagtatgaggccgacaaatttgcagatcagttagttaaagtaggcctttcctttgcaccaggtgatgatgcaaagcagcaaattcagttattacgagatttattgcccagcggccttgcgagcttgaactcaggatttaataccgagttaatcggaccagcgggtgttaataaacgaactggattaaaaacgttgcaggctaagtaccacatcgccgaccaagaagtgatgacttttggggataacgaaaatgatttggcgatgttaacaatgacgccatacggatttgcgatggcaaatgcgaacgatagcatcaaaagcgctgtaacgcgtcaagcaccatccaataaccatgacggggttttgaccgtaatagatgaactgttaggtgggagccaatttaacgggtaatgattagttggggaatatgcttgtttttgaacgttaatttggtataataaatcgggtatgtaagtttcaagccagagaagtagtaggtgtcgaaatcgttttagcgaatctgtgatggtgaaaggcagataacgatctttaccgaagcgtgtctctgattaataactagttgaataatttaaagtggattaatttcaagtagagtggtaccgcgggaaatctcgtctctgataagttctaggacttattggggacttttttcgtctcatcacgattggaaaaacactaatttggaggaattacaatggatgcaaaacagcaggttgttcaggcactagcacaagcattgccggatgtagatgcacatgatattgaaacaaagattgagcggccaaaagatagtcaaaatggtgatttcgcttttccaactttctttttggcaaaaacgcaacataaagcgccacaaatgattgctgctgatttaattgaagcaatcgatcaaaatggatttgaaaaggtcgttgttgcaggaccatacgttaacttcttccttgataaaggacaaattgctgctgaaattttacaggcaattttggctgatccagaaaattatggtaactcggatctcggcaatgccggtaacgtaccaattgatatgtcatcaccaaacattgctaaaccaatgtcgatgggacatttacgctcaacagtaattggaaattcacttgctaaaattttaacgaaggtaaattataatccaattaaaattaaccatttaggagactggggaactcagtttggaaagttaatggctgcctacaagatgtggggaagcgaagaggaagtcaaagcggaccccatcaataccttacagaagtattatgttcgttttcatcaagaagataaggaaaacccagagcttgatgatgatgcgcgtgcatggtttaaaaaactggaagacggggatgaggaagcgactcatctttggaagtggttccgttctgaatcattaaaattgtttatgaagatttacgatcttcttggaattgattttgattcatacaatggtgaagcattctacaatgataagatggacgaagttgtacaaatgttggaagataaaggcttactccaagaaagcaagggtgccgaaattgttgaccttgaaaagtataatctgaatccagccttaattaagaaaactgatggtgctactttatatattacgcgagacttagcggcagctatttaccgaaaacggacctatgattttgttcaatcattatacgttgtaggaaatgaacaacaaaatcacttcaaacaattgaaggctgttctaaaggaattagggtttgactgggcagacgatattcatcacattccatttggtttgattacgcaaggtggccggaaactttcaactcgtgagggccgcgtgatcttactggagaatgtgctgaatgatgccatctcgttagcacgtaaacaaattgccgaaaagaatccagatcttaagaatgctgaggaagttgcccaacaagttggagtgggggccgttgtattccatgatcttaagaatgaacggcttaataattttgactttgatttagaagaagttgtgcgtttcgaaggtgaaacgggaccatatgttcagtatgcgcatgcacggtcacaaagtattttacgaaaagctgggaacccagatcttacaacggctaacttggcattgggggatcctgcagcttgggaaatcatcaagtctctaggacagtttggtgaaattatccaacgggccgcacgtgaatacgagccatcagtgattgcaaaatatgcattacaactggctaaagagtttaaccagtactacgcgcacactaagattttagttgaagatgatgaaaaaatggcacgcttggcactcgttgaagcagttagtgatgtgctgaaatcagcccttgaattgttgggagttcaagctcccgatgaaatgtaatttgtataaatattaatctatttgcttgattattcgtaaataatgtattattattcaactaataacttaatggacatgatttacggaggaattggttagaaatgaaaaaatcgactcgtcaagcaaaaattgagcaacttattagtcaatatacgattacaacgcaagaagaattaatgcaacgattgaaggataatgagattactgcgacccaagcgaccatttcacgagatattcgcgaaatgcaaattgtgaaagccgctgatggtaatggtaatttgcggtataccatttttaaagctggtaataaaagtgaagagttacggctatatgatacgattcatgaagtcgtgacaaatgtgtcgcaagttgagtttatgaatattattcggacgcttccgagtgacggtaatttacttgctgccattattgacgatttaaatttaccagaggtcgcaggaactttagcgggtcatgacacaatttttattgtgagtccaagtacggaaattgcgcaacaatttaatcaaaaaatcgttgaacatgtgaatgttgatctataccttgaaaaataaagctaaaaattgcaaaatgcaatttttagctttttgtatatagcaatttatttagttgctatatacaattttaaaaattaacgattttttcttaaattccactaaaaaaggtcatcaagaagtggcgtctaaagttattatgctaaaatggaaggtgattacttaagagatggggaatagagatatgaatgatcaaccatcacggtttaagcggtggcttcaagaattgagggactggtttgcccccttatggcaaaagttcaaacggttactgaaaaaaggatggcaccgattccaaataactaggtggatcattgttgtctgcttgacgttgtttttactagttagcgggtatcttacctttattgccaagacgtcgcacgtgagcaatttaaaggcgacactggaaacaccaacgatgatttacgatcgtcataataagtcagctggtagtttatactcacaaaaaggaacttatgtttcgctaaataaaatttcaaagaatattccgaatgctgtgctttcgacggaagaccgtgatttttatcatgaacatggtttttcggttaaggggattgcccgagcagccctgctatatgccaaaaataaagttttagggcgtaattacatttctggtggtgggagtacactaacccagcaacttgttaagaacgcttatctgactcagcaacagacctttacacgaaaggcaaaagaaatctttatttccattgaggtagaaaacgtctattccaagagtgatattttgacgatgtatttaaataatgcttactttggtaatggcgtttggggtgttcaagacgcgtctaaacgatattttgacaaggatgcaagtgatctgacagtgccagaggctgccatgttggcgggaatgctaacatcgccgagtggttatgatccagttgcccatccggcggcttccaaacagcgaagaaatgttgttctacaactaatggttgaaaatggtaaattaacgcaatcacaggctaaccgttacaagaagacagcactgaccgtctcgaacggctacaagcagaccaatacgtataagtatccgtatttctttgatgctgttatcagcgaggcaatcagtaaatatgggttaaccgaatctgaaattatgaataagggatataaaatctatacaacgctggatcaaacgcagcagacgatcatgcaaaatatctataaaaacgataataactttccaagtaatgcatctgacgggaccgaagtgcaatctgcttcgatcgctgtgaaccctaataatggcggcgttttagccgtggtgggtggccgtggtgcgcatgtgttccgaggatttaaccgcgcaacacagatgaaacgtcaaccagggtcatcgttgaaaccaatcgcagtctatgctccggcgttagaaaatgggtactactacgattcgattttacaggataaaaagcaatcgtatggcacgaatgactacacacctaaaaattacgatgacacatacagtggtaaagtgactatgtataaggcactggccgaaagcttgaatgccccgacggtctggctgttgaataaaattggtgttactaaaggctacgaatctgttaaaaaatttggattgccagtcaccaaaaaagataaaaatcttgctttagggttaggcggtttatcaagcggtgtttctcctcagcagatggcaggtgcctatactgcttttgccaacaatggtaagaagacgacgccacattacatcaccaaaattgtggacgcatctggtaaagtgattgttaataatactaatgtaaaacgaaagcaaatcatctctaagaaagttgcaaaggagatgacgagcatgatgcttggggtcttcaattacggtacgggtaagacggctaaaccatctggatattccgtggccgggaaaactggcagtactgaatctgacgttgtgaatggtcaaaattcagagcgtgataagtggattattggatacacccccgatatcgtagttgcaacttgggaagggtatgatagcacaaatgaaagtcataccttggcagaaacaacgtataccaacacaaacactttatttaaagatgaattgacacaaatgttgcctaacacaaagcaaaccagctttgataccaaagatgcagcaacacttgctggtaacaaatcatcaagttcttccaatatttgggacaatcttgaaaataatacatctgaatttggcgataaagttgcccaaggtgcgcaaagcatcaaacaaaaagcatcagaattatggagtaatgcgaagtcaattatcggacagtagataatatgctggatttcatggaatctatatctatttaagcggttactatgttagaatgatatataacaatttttgaggaggaacaacatggttgtcaatatttacgataccgctaaccaaatggagcgggatttacgcggaacacaagaatttaaggcgcttgaagaagcatatgcagaattaaagaaggatgatgaaacgtttaagttattcagacaattccaaaatctgcagatgcagttacaacaaaagcaatattccggtcaacaaccaacggacgatgaaattaaagaaatccaaggtgttgctgataaggttcgcgacgttaagtcaattcaaaacttaatggaaaaagaacgtggcattgatgaattactaagtggtattaacaatgtgattaccaagccaattcaagaattatataaagactaatacaaaagctgaggcgagaagtcgtgctcagcttttttgaactaataaagtggtgattttaatgaaatttattcatagcgcggatttacacttagatagtccatttttagggcttaaggatgttccccaagaatttgcgaaaacaatttatcaatcgacatttcaggcatttcaaaatttagtgaatgacgcgattcaatttaaggtggatttcatttgcatttccggtgatatttttgatcgtgatcagcatagcatcgcggcggaaagcttctttaatgagcagtgtttacgactcgaagaggctaggatcccagtatacttaagttttgggaatcatgattaccagaaggtcgacaatcagttgcaatttccagataatgtgactgtttttgataatcatgtggaaactaaagtgttggaattagctgacgggcagcgagttgcaatttcagggtttagctatgaaacacggtggatcaccgacgatcgcctttctgaatttccatcgagaaatcgtcaagtggattggcagattggtctgttgcatggtgcattaagcggactgaaaagtccccacgcaaattatgcgccgtttcagctaaaagaattattggcaaaaaaatatgattactgggcacttgggcatattcataaacgtcaggtactgaatcagcagccccctatcatatatagtggtaatacccagggacgtcataaaaatgaagctggtaaaaaaggctattacttggtgacgagtcaaggtgatacgctagtacctgaatttcatgagtgcgaggcggcaatttggcgatctatccaagtgatggttaggccaacagaaatggtgcccgatgttttaagcgacgtgcaatctgctgttgagacggatggtgtgtttcatgaattgagtttgatttctgtggtcctcaaggctgaggctctttcgcaagaggttcaaattcaacttgacaatgggacattgcttttgcggcttcaacggcaattaggcgctcagcacaaagaaatgtggccttacgaacttgttttggagacgccaccgaaaaaaatgaattttgatgattttgatcatgattcatggcagcaagctgaaacagagacatttaccaaggctcaggttgcgactgtggcagataaattatttgcatatgattttattgaatcatattttagttcgaatgaggcaattgaaaaagtccgacttgccgccattgaacaactaaatggaaaaaaatcgaagggattttgaaatgaaaattaaacaaattcatatcgatggttttggaaagtggcaaaatcgagattttaatctggactcaagtattacaatatttttgggaaataatgaagcgggcaaatcaacattagcaaaatttattgagagtatcttgtttggatttgcgaacggacatcagccttacgagcaatatttaccaaaaaatggtggccagtatggcggcttcctagttgttgaacaccgtaatcgacgctatgtcttaaggagaacacaaggaaaaaacggtggtcttctgacgattaccgatgagtcaggaaagcggatgcccaatcatttcttgaaaatgatgcttggcgaagtcgatcagggactatttcatgcgatctatcggatagatacgcaggaacttagtcaaatctttgcactttcaaaaaacgattttcagaatcaattgcagcactttggtgcggtaaatagtgatcgctggttggaaaaattaacggatctggataaggaagcagatggcctttacaaggtgcgggggcgaaatccagtcatcaatcaaaaactggaacaataccatgatttgaatgaacaaattgatcagcagtctgaaaaatatacacattatcgacatttgttggatgatgttcggcaaagtgatcgccaaatccaagagattcaacagcaattgcctcaaaaacgaaatgactggcatgatgcgcaggaactactacggttgtggcaaacgtatcaacgcttgcaaagtattgatacagaaaagtcatccacactaagcaataatgacgttgctgtaatccaatctttacgtgctaaacaagatgaatatcgtcgtcaactcacagatgttaacgcacgattgggcgtgattgatgcggaaccttccttgacagaccagcaagacttttatttccagaatcttgacagatttaccaagctgaaagacgatggaaccacacttacgttgcacttgaatcagtatgatcagcttgtttcacaactccaaagttggcaacaagaacgacgtgagctattgcaacgttatccagattcgcacttaccaagtgcactgtcttattctgaagaaaatcgactgcagcggttaattgatgatcgtcaacatgtggatcagtctcgtaccaagcggcagcaaacaacgcccaaacgtcctttattgcttatcatactgggtgtaatcggagttttattactcgtgactggcagtgcttggctcatgaagctattaggtttgattttaatggggtgtgcggcggttatctggtatcaagaacaaagtagtgggggtactttgcacaatgcagttcaaggaacatctgatgaagcgttgcgtcattttggaattgaacatgggtttaatcaatttccacagagtcagtggctccgaatgcagggagatttgcggcgattagaagagctaaatcggcaaattcagcagataacaactcagatcaaaactattgataatcagaccacacagtatcaagagcacgttcaatttgcggccgaggttattgatgtccagcagtcaccacaagcgttgattaagcatattaatatgtttatcgatcggcagcaaggcgccagagatgtctggcagcgtcaaagacaacaaaaacgattacttgaagatcaagcccagcaattgtcagataaactgaatgaggttattcaaaagaaagcaacgctgtatcaccgatatgacgttcaggatgatcatgaatttgaccaatattacgatagtgcgctgcgatcaatcgccaacgaggaacgatcgcaagtgctcggaagtcagctaacagacaagcagattagtgcactgaaaatggtgaactcgaatgatgacttaagacagcgagtgactaatttagcgaatgacgttaagcatttagaaattaggttgcagacacttcaacaaaaccaaacagctgcacaactggaaatcaaacagctttccgaaaatgggacgctgacaatgctaagacaacaacgtgctgaccttcagactgaaattttggaactggtacgagactggttaacgcataaactgagctatcattggattaatcgagccttacaattagcttcggcagatcgttttccgaagattattcaacaagcacaaaaatattttgaaacattaaccaaccatcgctatactaagattgagttcgagaatgatcgaatttccgtgattgctcaagatcgaagtgcttttcaagtcggagagttatctcagggaacggctcagcaattgtatgttgccttgaaattgagttttgtgacgtcgatcagtaatcaaaatgggattcagttaccagtactgattgatgatggcttcgttgattttgatgccgatcgtcgagcaaatgtgttacaactactagagttgcttggagaaaaacaacaggtgatctatttaacgactgatcgccagacattacaatattcaaatggaaccgttgttaatttaaatcaaatgtaggtgatagaaatgacacaggcaaagttatatgaatttaaggtagacgaagtgatggacatttatgtgttgatcaagggcgttgatgttcgggttgcgaaaaacggcaaacgatttttatcgcttgtttttgaggatcagtctggagaattaccggggatgtattgggatgcgagtgacgaggacgtcgcattatttgtccctggaaaagtggtgcgattatccgctaagcgagaaaattaccagggcaaaccacaagttaaaataatgggattgcgtcttgctaccgaaaatgaaccacatgatcccagttactttatgcagcatgctcctgaaaagcgcaacgatatcgaagatgaaattaaccagtatatttttgaaatcacgcaaccaacatgggcacgaatcgttcgaaatcttttacaaaagcatcgtgaagcattttttacgtatccggcagctaagacgaatcatcatgcatttgctggtggattgtcatttcatacgttatcgatgctgagactgggaaaagcggtggtccatcagtacgatggaattaatgcgccattactatatgcgggcacaattttgcatgatgtcggtaagacaaccgaactgtctggccctgtttcaaccagttatacggttgctggtaacctagttggtcatatttcgattgttgatggtgagattgtggctgcatgtcagacgctcaagattgatcctaatcaagaagatgtgctgatgctacgtcatatgattttatcccatcacggtttgttagaatatggctctcctgttcggccgagaatgctcgaggcagagatcctgcaccgattagacgaaatggatgcttcaattatgatggtcaaaggggcactggagcatactgagtctggtgagttttctgaacgaatttttggcatggatcaacgaagtttttataaacccgaagaaccgaatcaaaattaattagtatactaaaaaggacacgtccaacatatgacgtgtcctttttgatacctattcaattagtttgatgatgatgaactagttgttgtagttgtagtggttgagctgctgcttgatgaagtgaggtaatcgtcaagaatattcttaagatcgttatccttgatcgaaacgttccccttcttcaaaaccttcgaaacaacattgtgtaatacggtactgttactcatgtcagtttcaatgatttgttctttcaagtcggcaatgtgttgactcttagttcccttaccagggttcttaatcatgtaaataacttggtaaccactgctggtcttaacaggtgaggtagtatattcgtttgttttgagtgcgaaagcagccttcttgtaagacgaatctagcgaagagtcagtgttgtcaaaggccgataccttaccaccagtgctcttgttggttgtatcagttgacttgctcttagcgagtttcttaaatgtcttccagcgatcagcagatgaggcgctgttcaattgatcaataatgctttgagcagtggcctttttcgaaacaagaatttcagcagtttgaacctttggctgatacttcttccactgcttgttgatatccttagttgtaatggttgtatggtccttaacagcggccttcaaaagtaagttagaccgaatctcatcttttaattgagaggtagtcattccgttttgtgagagaacactgctaaatgatgaaccatattgactcttgtatgagttgtattcctttgtcactgctgacttagaaactttgctgccgtattgcttttccaaaactttgtttagaatcatttgttgcaatacttgtttaccacttgaagttccctttaagctactataataagcactttcagtaattttaccaccgctagttgtcgcaacggctttgctaccgcaggctgctagagggaccatcaaaacaatcccggctaatattgcaagccattttttcatgtattaaacacatccatttcttaaaatttgtatggtacctgtgaaactcaccaattcaatataccacaatctgctgaaaggttaaggcactaataacaaagtttacaaaaaattcaatgtttaataaaataaacgccttatcgttactcaaatttattaagttcgtcttgcattttagcctgcaattgctgaatatgctcaagtcggggttgtgtcttgaacttaaactcatcaatgctgtggttgattgcgtccacttgttcctgagaatctgcaagtgctttttgcaaccgagcgatactttcactcaggtcctgacccgcgttttgaactgaactgatatcttgaataaggtccttaacggtatttacaagcttgttcatattaatcacctaactgatcagtaattgatttttgaatcttttgatattgagctgtgtcatagttgccggaattatccttgaagatcattttaaagtcatcatcatcactgtaacgtggaattaagtggaaatgtgaatggaaaacagactggtaggctacttcgccattgttattgagaatattaagtccctgaatagcaggattagatgctttcagcgccttagcaatcttgggaatccgcgcaaacacttcactggctagttcagcatcatattcaaaaatattggcaacgtgttttttcggaattacaagggtgtgaccaggagttccttgagaaatatctaagaatgctttaacaacatcgtcttcataaaccgtgtaactgggaatttcacccgcgataattttacaaaaaatacaatcgtccattaataactccctctttcgtcgtaaatatactgttaagtatacaagacaagggggagattcgcatctttttgtcgcattaaatcgtatgatataatagacttgtttgaataattacgaaattaagaaggaatggatatgacattaaaagttgaacacctgattggtggctattcacaaattccagttttaaaagatgtcagttttgaggttagcgacggtgaactagtcggattaattgggcttaatggtgccggtaaatcaaccacgattaatcatgttattgggctgttgacgccttttagtggccaaataacgatcgacggtgttagtttgcaagaagatagtgaaacatataaatcacagattgcctatattcccgaaacgcctgttttgtacgaagaactcacactgaaagagcatcttgaactcactataatggcttatcatttggatgaacatgtggcatggaaaaaggcgcagcgattattaaaaattttccggttagataacaaactcgactggtttccgattaatttttctaaagggatgaaacaaaaagtaatgatttgcagtgcattaatgacgaatgcgaagctgtttatcattgatgaaccattttatggccttgatccgctcgctgtacatgacttgctttatgaaattgaactggtgaagaaaacgggggccgctgtcttgatgtctacccatgttttggatacggctgaaaaatattgcgaccgatttgttctactgaaggacggtcaagttcgtgctcaggggactttagcgcatcttcgcgaattgggagatggcccagatcaatcgttggatgagatatatttagcattagcaaaggaagaccgcgatgactcaactatttagtcgaagaagaggacaacattttctgttgcttctcaaatactggcgtctggtatttaacgatcattttgtgattgccttgtttttcatgtttggtgcactggcttggggttattctcaagcacttaaccaattgaattcacatctttggtggagtcggccggttgcaattatcgtgctattgataattttacaggttgggcgactggcaacattagttaagcccgcggatccggtatttctattgccacaagctaaaatgatgacgcactatttccatcaagctttgcattacagccttatactgggagaactgatgacactggcatttagtgcggtgttgataccgtttatcatggcgacgtcaacttacacagtagatactgttattgcaatcgcagttgtgatggtgacgctaaaagcgactgagatgaactggctgctgacccggctctttcggtttacatccaaaacggaaacagtgatcattttggttatattaccaggagttgtgctgataagcggattttatttaagctggattgttgcggggattattagtacaatcgttatggttgtctcatggcaagtgcaacgacgtgtaacacagcgcttgttaaattggcggttagctgtggcacaggagcagcagagaatgcttggaatatacagattttttaatctgtttacagatgttcctatggttcaaggcgtcgttcatcggcgtcggtaccttgattggctggtgaaacttatgagtcaatcgaaacaaccgttttcgtatttatatgcacgtggctttttaagagggactgaagtaagtggcttaattgttcgtctaaccgtcgttgggatggcaattttgttctttatcccaattttttggttgaatttattaattatggtattgttcatttaccttttaacggttcaactaattccattttactggcattttgacaaccatgtatttacgcatctttacccagtgagccaaattgatcagctcaaaaatttccagagcctaagtcaaaaaatcttatcaggggctacacttttgttgtggctagccagcactggaacgaccgtcaatatgccgcaacagggagccaaactacttgttggtgtgtgtgaaaccttgttactggtctacgggtacattaaatatcgaatccgacaaaaaaagtaagtcaaaaataaagtgaggtcattatgcgagttagaaataaaccttgggcacagccattgattgatgcccatcccgaaattattaccgaccatgcggagcaaaatattggtcattggcaggcacggtttgaaaaaccacaacctattcatgttgaagtgggaatgggaaagggccagtttattattggtatggctaaggctcatcctgaaataaattttattggtttagaagtgcagaagtccgttgcagcaacagcgcttcgttctgcactggaagaggaaccgttgactaatctgcaattaattgcgggtgcaggggaatcaattgaaacctattttgagccggcggaaattacgcaactttatctgaatttttccgacccgtggcctaagaaacgccatacaaaacgtcggttaacatacaagagttttctggcttcataccagaaagtattgatttctgatggtgtactggaacttaagacggataatcagggcttttttgagtattcattgatgagcatgaataattttggcttgatgtttgatggtgtttggctagatttgcataatagtgcggaaaatgtcggaaatgtgcaaactgaatatgaaagaaaattcagtgaaaagggccagcctatctataaggttgccgctcattttaccaagtaaatggaagtagctctccttaccggagtaattgcacaaaaaaagatatctcagtcgttaattcgtctgggatatctttttaaaaaatttatttattcgcttcaattcggctcatttttaaaattgaacccgtctcggcatctgctaaaaattcataggtagtccgttggttatcttccaagcgggagattccgccacgataaacacgtgttttataggcaaaacgttgaaatggaattgtcttactctcgatccatgaaccctcaagaggaccttctttttgaaagccgcgtttaactcgagttaggatttcgctaggagattgttgtcgatttttgagtttttgacctaaaaagaagcctaggactcctgaaacaccaagtgtaattgggagtgtccatgaattaagttgattttctgagttgttcatagctcatacctccaatatctaacgcgagtgtagcaaaatgtgcgatagaaagccagcaatattactatttggctagtcaaagttaaaagatgatggattaaaaacaaaattagtgaatttattcggtttttgggtataatggacaagtagcagaaaacgaaaggggttatcaccatgcaagcattagctaaaaccacaaaagatgaattacttgaaaaaataaaatccggtaaatacatgctctttttctcagcaacgtggtgcccggactgcgccttcattaagcccgcaatgcctgcaatagaagcggaatattcaaattatcaatttattgcagttgatcgtgacgagaacatcgatttagccgccgaactgaatgtgtttggtattccaagctttattgcgtttgagaacggtgaagagattggcagatttgtcaacaaagatcgtaaaacaaaagaacaagtagaaaagtttattgattcattaaattaagtaatcaaaatggtggttcgccgccatttttttgtgaggaaaggatacattatgttaattgcaagttacaatcgtcaagagttgggagatgtattagttgttattacagcccctgatactgaggaacagaagacgattattcgaaacaacatcgcgcagattacagcagctgacgatgggcatctattaggctataacttcttgaatgttcatgagactctaggtgatattgatgcgaatggacaattagaactgactgataagcaagtagatcagcttaatcaggctattaagacgactggatttgaatgcctgctgaagctcgatcgaacaccgaagtttgttgtcggttacgtagaacaactttcagatcatccaaaatcggatcatttgcatattacccgtacacgaattagtgacaatgaaacgttgcaaattgtatctggatcaccgaatattgctgatcatattaaggtagtggtcgccaaagttggtgcaatgatgcccagtggtcagattatttggccaggtcaattgcgtggtgttgatagcaatggtatgatctgttctggacgtgagttaaaattgaaaaatgcgccacagaaacctggggcattgattttacctgatgatttccaagaagttggtgaagcatttaactttgctaagggtaaccaactatttttgtaaactagaggggtaatgacgatgacaaataattacgatggcccatctttttatcgtcatggttctgaaaatcagcaaactaccggtaaggagaaggtccattcaccaagcccacaagaaaagaaaaagccattcaaagtaactcaggttccgacattcaagcgacgatcggcaccacaatcgtatgattatagtcgggtcctgcgtcatctgagaaaacagccagctgattattatgtggtagtcaaggaactaaccgaacaaccaacaaacggtacgaacgacgttggtctgacgaaagatgaacgtaaagtaaaaaccgcaacgcaaaaatattcccaacagaaaaacttgggaaatgcattgggacattcactaaatgatattttgagaagtgaacaggatgctcaacggacattaaaaattttcgatacaaatcaaaataaacatcattaaaattggagaggaacattaggcatgaaaaacgatacagtctattattttgttggaattaagggttcaggaatgagtgcacttgcgttggtactgcacgataaaggataccaagttgagggatctgatattgatcaatatacctttacacagcggggccttgagaaagctggtatttcgatttactcatttgatcctgaaaatattcatgatggactaactgtgattgccggaaattccttcccagatagccatccagaaatcgataaggctcgtaaattaggacttaaagtctatcgctatcacgagtttttaggcgaattaattaatgaatacaccagcattgccgtagcgggagcacatggaaagacgagtacgactggtttgctcgcgcacgttttaagtggtgttgcaccaacgagttatttagttggtgatggtagtggtcgtgggacggttgattcacggttctttgtttttgaagctgatgaataccgtcgccattttatgccataccatccagattatgccatcatgactaatatcgattttgatcaccccgactattatagtggtattgatgatgtcttttcagcttttgaagcctttggcaagcaagttaaaaagggcatatttgcgtggggggatgatgagaaccttcgcaaattagatgttgacgttccagtttactactacggaactagtgaacgtgacgatttccaagctcgtgatattaaacggtcaactaagggatcaacatttgatgtatactaccacgatgaattcctcggcaacttcgaaacaccattgttcggaaagcacaacattttgaatagtttggccgtaatcgcggtttcatattttgaaaaagttgatcttgatgagatcagacgtgaattactaacgtttagtggtgtcaagcgacgcttcagtgagaaaactgttgctgatatgacaatcattgatgactatgcacatcatccatctgaaatcaaagcaactttagatgccgctcggcaaaaatatcctgataaagaaattgttgctgttttccagccacatacgtttacgcgaacaattgcgttgctggatgattttgcaaagagtttaaacctggctgaccaagtttacttaaccgatattttcagttccgcgcgtgaaaagtcagggagtgtttctagtgctgatttgggtgccaaaattgttaagggcggttcagtgcttaaattagataatatgtccccattactggattaccataatgcggtagttgtctttatgggcgctggtgatgttcagaaatacgagcaagcttacgaaaagctattgagtgatgtgacccctaaaaacaactaattcataatcaaaaagtgtatatcacttgaagtcaatttttaaattaggtagaatgttcggaaagcgggggtgtccccgtaatcattttttagaaagcgatgtgtattgagtgaacaattttaacgacgattattcacaggcaagacgtgaggttggaaatgaagctggactaacacgatttatgacgcgaatgtatgcgaatatgacgcttgcagttctagtatcagccctcagctcgtttttaacgttaacggtctttcgtgaacagatctttggttacatgtcccagcatagtgggatgatttggatcattctgattataccgattgcgttgtcattcggtatcagttttcgagctactcgtaatccagttgccagtttcttgatgttgatggcgatggctgtcatttacggagttgagtttgcactgatctgtgcggcgtttacgggaaccagtattacagctgcgttcctttcagcgtctgcggttttcctaacgatgacgatttatggtggtgtgactaaacgtgatttgagtaaatttggtgcacatgcaacggctgccttggttgccttgattattgcaagtgttattaacatgtttatccaaagcagtgcaattacctatatcttctcgtacattgctgtcattatctttacggttttaacagcatgggatacgcaaaatatgaagcggatctatttacaatatggtaatcaggtttcagttggtggattagccgtgatgggtgccctacaattgtatttagactttgttaacctctttatcagcttgctccaaattttcggcatgagcagtcgagattaataaaaatgtgagtgtgtgattgccactcattgagaggacgaacttgaaactagtgtttcgggttcgtttttttgatacaatgaaaacgatactattaaggtcaggagataaataaatgacgaaacagttattactaattgatggaaacagcgtggcctttcgtgctttttttgccctacactcacaattggggaaattcaccaatcaaaatggattacatactacagcaatttatggctttaatttaatgctggatcatattttaaaagaagtgcaaccagatgcagctttagttgcgtttgacgccggtaaaacaacctttcgaactgaaatgtatgatgattataaaggggggcgtgataagaccccaccagaattatccgaacaaatgccctatttaaaagaactgattaaagcttatgggatgcatagctatgaattagccaattatgaagctgatgatattattggaacacttgcgctacaagccggggagcagggatttcaaacaaccattgtgacaggagatcgggatcttacccagctgtctagtgaaacgacgacagtttctgttactcacaaaggagtcacagaagttgagcattatacacctgagcatgtattagaaaagttggaaattagtcccagtcagattgttgatatgaaagggctgatgggtgatacgtcagataattatcctggggttactaaagttggtgaaaaaacagccatcaaattgatcaaacagtttggtagcatggaaaatctgtatgaacatatagatgatcttaagcctagtaaaatgaaggaacatctgattgaagatcgagacaatgcgtttatgtccaaaaagctcgctcaaattaattgtcaagcacccattgaagtaaccattaatgatatcgactatacgggtccgcaaactgatgaactaattaagttttatcaggaaatgaattttcagtcctttcttaataagctttcaggttctcagacagagcttgatttgacggatcctgaaattaagcagattgaatttacatgcttagataaaactaatttggatcagattcagacacttgaaggttccgttagcttttatttggaaatgccagatgccaattaccacacgtctgaatttgcaggatttagtattggagatgggcatcgttggtttgtcagtcgtgatgttgaactactcacgtcggcaccggttcgtcagttgctcgagagcgatacagttaaaaaagatgtgtttaatgctaaagcaatgacagtggggctgaaccgtttgggcatcacattacggcatgttgactttgatttgttattggtttcgtacctactcaataccaatgaaaatagtaatgatttaggcgttttggcgcgtgaacatagttattttgacgttgacacagatgaatccgtttatggcaaaggagcaaaacgtgctattccagatgaggatcaagttttgtttgcccatttagcgactaaaacacgtgcgattgctgaacttaaacctcagctgattcagaaactaaatgagaacgaacaaattgatctgtacacggatattgaattgccattaagtgacgtattagcacaaatggagataaccggtgtgaaagttgatgtcgagcggttaaaggcaatgggaagtaagctaatcgagcgattaagcgaattagagcaaacgatctatcaagaagccggtgagtcatttaatatcaattcaccaaaacagttgggtgaaattttatttgagaaaatgaaattaccagtcattaagaaaactaagactggctactcaacagccgttgatgtcttagaaaaattacgtgatcaggcgcccattgtagataatattttgttgtatcgacaaatttcgaaactacaatcaacctatatcgaggggttattgaaggtagtacactcgactgatcagaaaattcatacgcggtacctgcaaacactgacacaaactgggcggctctcgtcggttgatcctaacctgcaaaatattccaattcgactcgaagaaggtcgcaagattcgacaagcgttcgtcccaagccatgaggactgggaaatcttttcatcagattattctcagattgagcttcgtgtgctagctcacgtaaccggcgaccataatctgcaagaggcttttattgaagatcaagacattcatgccagtactgctcgtcgaattttcaagcttggcccggatgaagaagtagatcgtaatttacgacggcaagcaaaggccgtaaacttcggaattgtctacgggatcagtgattatggactttcacaaaatattggaatttcgcgaaaacaggcgaagcagtttatcgaaacttattttgaagaatttcctggcgtaaaaaaatatattgatgaaattgttgagtctgctcacaaacgaggctatgtcgaaacattaactcatcgcagaagatatttaccagagatcaatgccaagaactttaatcagcgctcatttgcggaaagaacggcgatgaatacaccgatccaaggaagtgcggcagatattattaaaattgcaatgattcaaatgaaccaagctttagcaactcaccatttaaaggctaagatgttactccaaattcatgatgaactggtatttgaagcgcctagtgaagagattccagtacttgagaagctagttcctaaggttatggattcggcagtttcacttgatgtgcctttgaaagtggaaagtgctcacggaaagacttggtacgaagctaaataaaactaggtgagaaaggaaaatacaaatgcctgaattaccagaagtagagacggtccgccgaggactattaaaaattgccaaaggacggaaaattgctgcgatcgatattcactatgaaaaaacaattaccaatgaaaatatagcgtggttcaaagagaacttgattggtgcaactattgtgaatgtggatcgacgcgggaaataccttcttttttgttttgataatcaaatgacaatggtttctcatttacgaatggaaggtaagtattataatttacccgaagatggagaaattcataagcacacccatgtagtttttcacttagatgatgacacaaaattgtgttatagtgattctcgcaaatttggtcgaatgacgctggttaaaaatgatgaggctttgcaagtggccggattgaaaaccattgggccagaaccaacggctgaaacactgacggtggaatatctacagaaaattatgcatgctagtcgtcgtgagataaaaccctttttgttggatcaaagtaacgtcgctgggctgggcaatatttatgtggacgaggttctttggatgagcaaaatccatcccaaggagcatgccaatttagtatcagatgaacagattgaacaacttagagacaatattattcaagaactggcagtggcaaccgaacatcatggtactaccgttcattcatatactaatgcgtttggtaatgcaggtgagtttcagaatcatttgcatgcttacggaaatgctggcaagccgtgtgaacgttgtggcacaccgtttaaaaaaataaaggtagcccaacgggggaccacttattgcccgcactgccaaatattaacggagaatgaaaatgactaaggtattagggctgactggtggaattgcaaccggcaagtcaactgttagtcgtgtttttgaagagtaccacatcccgattattagtgcagatgaagttgcccgacaggttgttgaacctgaaagtgtggccctaaatgaaattcaagcccaattcggtcaggtttacgttaataatgacgggacgcttaatcgtcagttgctgggaactttagtgtttggaaactcgcaaaaattagatttgttgaatcaaattatgcaacctaaaattcgtgcagaaattcagcgacaagttgcgacactaaaacagagaaaacctaaactgattgtattggaaattccgctgttgtttgaacagcatggaaatcaattggtggatattacgatggtggttaaagtggctcgtcaagtacaattagatcgtttaatggccagaaatcagttaagtcagcatgaagcactaaatcgaattcatagtcagatgtcactggctgaaaagataaagcgggcagacgttgttatcgataatgccggtacagttgaacaaacccgcgaacaagtggtaaaatggcttgaaaactataagtttatataatgttataaaatattgacgggaagtgaactaaatgcattgcccacattgccatcataataactcgcgagtaattgatagtcggccaacggaagatggccggtgtattagaagacgccgcgaatgtgaaaattgtggattccggttcacaacatttgaaagatttgaagaaacaccattattggtgatcaagaaaaatggtaatcgggaagaatttaatcgagataagttattacgcggccttgtccggtctgccgaaaaacgaccattgagtatggaaaaactaactgaaattgttggaaaagtagagaataaagttcgcggtctcggtgaaaatgaagtcagtagtcaagttatcggtgagtttgtaatgaacgaactgaaagatttggatgaaattgcctatattcgttttgccagtgtttatcgacagttcaaggacgttagtgccttcatggatgaacttcagggaattatgggacaacatcatgataaataatcgaagggggaatcgttgtgacaaaggtagacgatacggttaaaccacaaactgggttgatcgtttgcttagctgctgattaccgcacattctctcaatcgacattagttgaattttaccaaccgatcatgggagcgaatgcttttgcgctcctttttgcgttaaaaaatgcggttactgagcatccgacgctttcttcacgtcttgctcatactaggctactcgatcaactcggatttgacattactgaattagaaaatgctcgtcgtcggctagaagcactgggattattgaggacgtacgagacaacagatcagatgggaacagtcgttgtctacgaacttcaatcaactcagacgcctaagtcatttgttaacgacgatttgttgagtgtgttgttgcttgaagccattggagaaactaagtttgatgaactggttaaatctgtgacgaaatattcaatggatgtgagtcaactgacggaagcaactaaaacttttttggatacgtttcatgtcaatgctagtcagatcactgactcaccaagcattattcgtgaaagtcgagaacagtttgtggttagtcaaccacgatcaagtcatcagattccggccgttgattttgattttaaattattgacacagttgctggacaagcaacccattagtaatgatgaaattaataaacatcagacgttgatccgaactgaacacgtcatgtatggaatcgatgaaccgcagatggcccggcttattatggagagtacggatctagttaataatgagttggatgaacagcggttcaaaaaagtaatttcaaccaattttcagatgcggcattctgatgagagcaaaacgtccaaagacaccgtggctccggacactcaattgacagctaatacgtcaaaaactgatctcacgagcaatgagaaacaactgattaaggcctgtgaaacctatactcccaatgattttttacaaatccttattgaaaaaaaaggcggatttgtacctcggagtagtgaaaatgcgctccgaaacttaattgaacgggatgttttaagcaaaagtgtcattaatatgttgatctattacgttatccaagaacgtaataatacatcgttatcacaaaattttatcgacacgattgcctcggggtggttacaggcccaggtgacgaccgctaccgaagcattgacgcagattaaagaattttcgaaccgtggaagctctaccaattccggtgaaaaagctaagcgtacccgatatgtgaataaaaagagcggacaggttcgtgaaacactcccagattgggcccaagaagggtaccaacatcagagcaaaaaggtttctgaggatgaagtttccaagattaaagcacaactacaagccatgaaacagcaacaggaaagtgaggaataacgatggagagtatcggtgatgtgattcaaaaacgactcaaaaatcgtaatctcggtcccgcgtatgagaaattaatgaaatcagtctatgatgattcggatgttcaagcatttttgacggcgaaccaggcggtactggataaaacaagcattgaacgtggtgaagccaaattatatgaatttgtaaatgaaaaacaaaaaattgccaagggtgagccaacatttgcgccgggatatgaacctgtgttagttgtgagcaaccaactgattgatatttcatacaaacaaacgaaggcgtttcaggcccagcagcaagctagtcagatgaagcagcgggttcactcgatcagtatgcccaaattagtgaagcaagcgacatttgaaaaatttgattttgatgaagaatcgcgagtcaacgctctcaaaaaggcaattgactttgttgatcagtatcgtgaacatcctgatgtatttcatccgggactgtacttatatggcaatttcggggttggaaagacttatttattaggtgcgatcgcgaatgaactagcaaaattcaatatcacgtcgacaatgcttcattttccaagctttgcggttgaaatgcgcaattcaattgggacggatgaacgaacggcagataagctgaattctattaaacaagctaatattcttatgcttgatgatattggggcagattcaatgtccgcatggattcgggatgatgttttaggtgtaatcctagaatatcgaatgcaagaagaactaccaacattttttagttctaattttgatatggcaacgtttgaaaaagagcatttagcggttacgacaaagggtgatgtagaagcgcttaaagctaaacggattatggagcggattcggtttttatctcgagaagtcactatggctggcgataatcgacgtccgaagtgaaattttaatattgacagttttgaatgaacttggtatgatataaaagttgaaagattaaagcagaagcacccgcttctcgccttagtgatcggaatcgctgggctgatgagatgaaatgaatgtggttgagcaattaactgcatcggcggggtgtgtatgcaccgcgcctttttgctacgtctttcgctaaaaattttggaggtgtgttgctatagctcaagatatgatagtcaataacggcattcgtgctcgcgaattacgactaattgatgccgatggaaaccagttaggtgtaaaaagtaagcaagatgcgttgaagatggctgaaagtgctgaattggatcttgtattagttgctcctaaggctaagcctcccgttgctcggatcatggattacggaaagtaccgttttgaaatgcagaagaaacaacgggaagctcgtaagaagcaaaaggttatttcagtgaaggaagttcgcttgagcccaaccattgatacgaatgactttaacactaagttaaagaatgctcgtaagttcttaggcaagggcgataaagtacgagtttcaattcgtttcaaaggtcgtgcaattacgcataaggatattggtcgtaatgtccttaacaagatggctgaagcaacgaaggatgttgcaacagttgaacaacatccaaaaatggaaggtcgtagcatgttcttaacattagctccgatctctgataattcaaaaaaataaagagaaggtaggataatagttatgccaaaaatgaagactaaccgtgctgctgcaaagcggttcaagaaaactgcaaatggtggattaaagagtgccaatgcttatacaagtcaccgtttccacggcaaaacaaagaagcaacgtcgtcaattgcgtggccttagcatgatggacaagacgaacgttaaacgttacaagaagcttatccaagcttaatcataaatttttatttttagataatttaggaggataccacaatgcgagttaaaggtggaacagttacacacgcacggcgtaaacgtgttttaaaattagcgaagggttaccgtggcggtaagcaccgtctcttcaaaactgctaaagatcaagttatgaagtcatatgcttactcattccgtgatcgtaagacaaagaaacgtaattatcgtcaactttggattacacggatcaatgctgcagcacggattaacaacatcagctacagcaagttaatgcatggcttaaaattggctaatatcgatattaaccgtaaaatgttggctgatttagccgttaacgatgcagctgcatttactgcattagttgatgaagctaaaaaagcaagcaaatagtaattaagttaaagtgagattagggcaatttgatttgttctagtctcattttttaggtattaaagtttgaatgggtggcttgttaaccgtataattgatgtgaatgtattttacatgcggtaccaccctaattattttattggagatagttcatgattagtgtatttaaaccaacttggatggtcaattcggtctattcaatttcacctgaacaacttaagcaacacggtattaaagctgtatttaccgatttggataataccttaattgcttggaacaatccagatggtacgccggaacttcgtcagtggatgaagtcgttagccgatgccggaattccgttaattgtgatttcaaacaatagttataaacgggttaaacgggccacggccacattagacttaccatttatttctcgggcgttgaagccactagggtttggcattcggcgtgcgctgagaaaattagggctgcatcaagaggaagttgtcatggtaggggatcagcttattaccgatatggtggcctcaaataatgcgcgggtaagaagtatcttggttaaaccgctgattcaaagtgatgcttggaatactaaacctaatcgtttttttgagatttttctaaaacggcagttaaaacataaatatccaacgttaagttggcaggaggatttggatgactgaaacattaagcaatgacgaaaaattaatttgcatcggctgtggtgcgacaattcaatcggatgacccagagcaaattgggtacacaccaaagtctgcagtagaaaagggaattgaaaacgatgaattgtattgtcagcgttgttttcggcttcggcactacaacgaaattgcacccgtatcattgaccgatgatgattttttgcgattgctcaatcaaattcgagatgccaatgcgctaattgtgtatgtcgttgatatttttgatttcaatggtagtttaattcccggattgcatcgttttgtaggtgataacccaattcttctagttggtaacaaagaggatttgctaccgagatcattacgacggacgaagttgatggactggatgcgtcagcaagctaatttggctggtatccgaccaattgatgttacgctggtatccgctaaacgtaatcatcaaatcagcgatttgctagagttaattgaaaaatatcgtgctgatcgggatgtgtatgttgtcggggttaccaatgttgggaaatcaacattaattaatcagattattaaacaaacaacaggtgtcaaagaactaatcacgacgtcgcgattccctggaacaacactcgacaagatcgaaattccattggatgatggtaaacaattagtggacacgccagggattatacatcctgatcagatggcccatgtccttccggcaggcgcactcaaatatgttgcaccgcaaaaggagattaaaccgcgcacattccaattaaatgaccaacagacgatctttttgggaggcgttgcacggtttgattatgttcgtggtcctagaaatggggttgtggcctattttgacaataatttgaatttacatcgaacgaagttgggcaatgcggatgagttttataaaaaacatgttggcggtttactaacgccaccggctgaaaatgcagtgactgactttccacaactagaacgtcatgagttccatttaacaagtaagagcgatttagtgattgaaggactcggatggattacgattccgggtgatacgactgtagctggctgggcacctaagggtgtatcagtggttgtccgtaaagcaatgatttaagaattgaggattattaatgaaattacgtggaaaacaaaaacgttttttaagagcacaagcacatcattttcggccactttttgcggttggaaaaggtggtctatcagaaaactggcttgcacagttggatggtgcgttggataaacgagaattgattaaaattaatattttacaaaatgccgatgtgacggccagtgaagtaaaagaatttattgaaagtaatacaggcatccaagttgtgcaaattatcggtcgggtactcgttctcttcaaggtatcagatgaagaagaacggcgtgatttatcgacaagagttagcaaaatttaggaagtggtaggaatgaaaactcaagcggatacgattgttgagccgcaaacagtggttcaagttgacagaaaagatcgtcgtaagcggatcggcctatatggtgggacgttcaatccaattcacactagccacttgatcgttggagatcaggtgggaaatgcattgggattggataaagtaatgttcttaccagatgttgttccaccgcatgttgacacaaaatatgcaattgatcctcaactaagagttgaaatgattcgacttgccattcaaggtaatccgttatttgatattgaactggcggaaattgagcgcggcggtgtgagctatacgtatgatacggttgtggctctcaagaagaaacaccccgatgttgattattactttataattggtggagacatggttcaatatttgccaaaatggcatcgaattgatgaactatcaaaattggtaacctttgtgggggttcagcgtcgaggctttgaaactgaaagtaagtatccggttgtttgggttgatgttccgatgatcgatattagctctactgatattcggcaacgaattaaagagggccagtctgttcgctattttgtgccagattccgttattcacttcataaaggagcatcatttatattttgagtaatcaagagttagaatataaagaaaatattattccaatgtctcggcaggaactacttgagattttacgcaatcacttacgtgaagcacgttttcagcatgtacaacgcgtcgagtcaactgcgattgaactggctaaacagaataatgtgaatgttgagaaggcaagcattgccggactgattcatgattatgcgaagcagcggccagacacagatttcaagatggtaattattaaaaagaaaatggatcctgaattattgaagtatgggaacgcaatctggcacggaattgtcggtgctgaaatgattaaagatgagctgcacgtttgggatgaagatattcttaatgcagttcgacatcacactactggtgccgccctcatgtcaccattggaacaggtaatttacatggctgactacattgagcctggccgacaatttgacggagtcgataaagcccgaaaagtgacgaaggctagtttaactgatggcgtggcttttcagacaaaacaaacattacagtatttaattgaaaacgatcggctggtctacccaaaaactattgagacttataatgcatgggtagctggtcacggaggtaaggatggaaagtaaagaaattttagaattagctgttaaagcggctgatagcaagcgtgctgaagagattattgcactagatgtttcggaagtaagtgtgatggcggattacttcgtaattatggatgctaactcaaagcgtcaggtacaagcaattgcagaggccgttgttgaacaggctcataagaatgacattgtcatcaaaagtgttgaaggtaagcaagcaggcaactgggtgcttgtggacctaggtgatgttatcgtgcatgtattccaaaaagatcaacgacaattttacaatttagaaaaattatggtcgcaagcaccaatggttaatattgatcaatgggtcgaggcatgatttattctagttttgcaaaattgtacgacgatttattcgatgaacaaatgtatgtcgattggcagcagtttgttgaaaaacatctttctaaaacgactagttccgtccttgatctagcaggcggagccggtcgtttagccgtattgttagcgaaaacaggcttagacatgacagtggcagatttatccagtgaaatgttaagccttgcacggcaacatgctgaggatgccaattgtacagttgatctgcaacaggtgaatatgttggatttgtctgatatgaggcagtttgatgcagttacctgttttgcagattcgttttgttacttggataatttagatgaagtgacgcttgcgtttaagcaagttaaagctcacctaaatgatgcgggcgtatttcttttcgatgttattacgccgtaccaaacggatactatctatcctggatatatgtataattatgaaagtgaaaatcaggatactgcctttttgtggcgcagttttggtgattctgaatgcgaacatggtgttgttcatgaactaaccttttttaatcaacttcccaatcaggatgtgtatgaacgattagccgaagaacactatgaaagaacatatgagctgaagcagtatcttcaggctttaaaaaaagccggttttaatcagattgaagtgagtgctgattttggtagaagtgagattggatcaacgacaactagatggttttttgttgttcgttaatcaatttgagttggagaatgagaaatgaaggcagttggcgttgtagctgaatataatccgtttcataatggacatcactatcatattaatcgagctaaagaaataagccgagcagatattgtagttgctgtaatgagtggaaattttacgcaacgaggtgaaccaaccattcttgacaagtggcatcgggctcaggaagctttagctaatggtgtggatttggtggttgaattgccgcttgctttttcggtgcaaccagcccacttgtttgcaagtggcgccataacaatgatgaccgaattgggaattcaatcaatggtttttggtgcagaacacgcggaatgggattttgataagttggttagagctgaatcaaaattcaaatctaatcagttcgatcgttataatgcgacatatgcgactgtgtttaatgaacaattacaagaggccactggtgtacaactcacagagcctaatgatattcttgctttcggttactttaaggcacggtatgaacaggctgtaccactggatcttattccaattcgacgattgggtacgcactatcatgatttacagattaatgaacagcgccagattgcaagtgccagtgcaattcgcgaatctgtgaaagatcgacgaaataactatcaaacggtcgtacctcaacggacaatcaatgacttggcggaattgaatggtgttgccgattggaatgaattatatccttatttacgataccaactcattcaagcaccaattaaaacacttgggacgatttatcagatggctgaagggcttgaatttagaatgaaagcagtcgcagaaacggccgataattttgatgagtttattcatgaagttaagactaaaagatatacgtattcacgattgattcgagtctgtttgtatgtgctgctacaaattacagatgccgaaatgaaagcacattttgaaagcccatatatccgtattctgggatttaatcgacatggccaaacatatttacatgaaattaagaaacaagcaacggttccaattgtggctcgaatggatcgagaactgaaaaatggccttgctaatctagattatcgtgcgggtaagatgtatgaacagcttaaccgtaccgaattacaggacatgcgtcggcaaccaattattcaagattagcactgggtgtcaaggaaaaaacattgacaatcaaaatacagccgcgtatacttaaacgtgttgcattaggaggaagtacagatgaaatggtcattaaatgaactacaacggtatcaggatgaaccacttcagcttgatcgtacgttagatctaaatgcgctacttaccgaacggtttcctgaggatatcttaggtgcagatcccgttaaaattaagggatatctaagctatgaaaaaggcgatgttatggtcactgtatcagttgatacggtactgactgtgccatcgacgcgttcgctacagccggttaagttaccgatttcgtttaagtttacggaattttatctcgatgatgaatctcatcttgaacgttatgatggtagtgaaacggtaattgtattggatgaggatgagccacttgatttagatcaggcggttgctgagaacattgttttagagattccaatgcaagttctgtctgatgatgaaaaacaagatgatgcaacgttccccgctggcaatggttgggaagttatatctgaaagtgaatatgaatcgcagaagacagagcctaaaaaagttgatccacgtcttgctaagttaaaagaattatttcctgatcaggagcatgataatgattagcagacttattattagtggacaaatttatatgaaggaggtggcataatggctgtcccagcacgtaagacttcaagaacaaaacgtgacatgcgtcgtggtcacattaaacttaatgtacctggtttgactccttgtccaaactgcggtgaactacgtaagtcacacatggtatgcccaagttgtgggtattatgatggtaagcaagtagttgacacaaacaagtaattatttaatttaaaacgatattcatggcgccggacctgaatatcgtttttttatgttgttctataaaaagcttactaaaatagcagatgggcaaaatatcgttttgtccgtctgctattttcattggggaatcaaggtgtaggtgattaaatagctaatgtcgaatctcaatctagtgtcgatagtgaaatacaatcaaaataaaaaaggcctttcggccttttctattttgattaaagtgacatgtcaacgacttcacgaccaacaattttgccggctttcatttcatcaatgatatcattaacttcgctcaacttacgagtgtgaacgattgggtgaactttaccttcagcaccaaattggaaggcttcagctaaatcttgacgagtaccaacaagtgatccagccacttgaataccatctagaactgtcttagcgatgttaagttccatgttaccttgagggagggcaacagcaaccaaccggccatcaggacgcaatgaatcaacggctgcagtgaaggcacttgcattaactgcagtaacttgagcattgttgacaccgccgactttttcttggatttgttctgcaacatttccatcgtgacggttaattaaaacatcggcacctaacttttcagcagcagccaacttgtcagggttaccatcaacaacgacaacatgggcaccgaaaacatttttagcatattgaatagccaagttaccaaggccaccagcaccaacgactgatacccagtcgccaggcttagtattaccaacttttaaagccttgtacattgtgacaccggcacaagtaattgagctggcttcaacaggatctaaaccatctggaactttaacggcatagttggcgtcaacgatacattgttgtgccatggcaccatcaaccgtgaaaccagaattacggacgttacggcaaagtgtttcacgtcctgtaaggcagtattcacagtggccacatccaccatagaaccaagcaactgatacacgatcaccgatttttaggtttgtaacaccggcacctagcttgctgacgcgtccaacaccttcatgcccaataacgcgaccagggaatttaccaaaatcaccattagcaacgtgaagatcagtgtggcaaagaccacaatattcaatatctacaagtgcttcaccatgttcgaggggacggagctccttttcaataatatcaacataaccatcaactgagtcacgcacaacagcagctttcattgttttaacctctttcagaattagaatttatatcctcactagatatattacacgtagagcttagcaaattttttcattatttgcaagtgaaattctacacattttggaaaaataaaccggtttatttcccttgtgtagttgatttagcaacagtttaactattaatcgttgattcacataattaggacgttgttatctgtatcacttatttttataggcaaaagaaatgcaaattatgaaaatagctctgatatcctatgtttggttaggtaattatgatagaatatttaatgtatgtgaaaaataattagtataaattaaagaatcaagaagtaggagtgaaagactcatgagtagaattttaataattgaagatgaagaaaatttagcacgtttcgtagaacttgaattgcagcatgagggttatgaaacagatgttgaattagacggacgcgctgggttagatgcagcgttggaacaagatttcgatgtaattttgctagatttgatgttaccagaattgaatggcattgaagtagcacgacgggtacgtgaagtgaaaagtactcctattgtaatgatgacagcacgcgattcagttattgaccgtgtatctggtttggaccatggggcagatgactatattgttaaaccatttgcaattgaagagctgttggcgcgggtacgagcattgttacggcggattcatatcgaaggtgggggcaatgaaacgcctaaaacaaccgtcacttaccgtgatttaacaattgaaaaagaaaacagggtagttcgtcgcggcaaagatgttattaacttaacaaaacgtgagtatgaacttttacttattctgatggaaaatgtgaatgtcgtcatgtcacgagatgtattgttaaaacgtgtttggggttatgaatcgcaagttgaaactaacgttgttgatgtctatattcgttatctacgaaacaaaattgatcgtgccggtgaaagaagctacattcaaactgtacgtggtacgggatacgttattcggtcataataaatcgtaagcggggaaatgtgctgtgaattctactaaaaagaagacagccgaatatagaatgtccctgaaagttaagtgggctctcggaacggccatcggggcattactaatttttgcgctgctaacatttgtattgtttcaatctttcacgagtgatcttttaaaacgagaacagacttctgttaatcagtcattagtgtctgttgagcgacggttatctgacagtcgtgcggatgagttaactagtagtcatgtacgcagtctagtaagatatagtgatggcctggctgacaagtcgactgatgatcagagtgccaagggaatcatcaatggactcagtatttcagacttgtcaattgcagtttacaatttgaatggaaaactcgtgttctcaactgatcacgcgccatcaacagataaaattgttgatcataaaaaaattcaaacggttaaaaaggggtctcataaaaatattgttgggacgatgccggtaaccagcagcagatccgatcatccgaaaattggttatgtccgagtaaccagcagcttaaccggatattatcaagtcacgcaccgcttgttcctaatttcggtcctagtgttagtacttgttgtgatagccagtggccttttggggtatgtgctctcgtattttcttttgcggccaattgatgaaattcatgatacgttgactgcaattcgtgatgatccaactgataatcagcgtgttccaaagatgcatcgacgtgatgaattatctgacctcggcgaaatgtttaatgaaatgttggatcggatgcagcgttacattgagcaacagtctcaatttgttgaagatgtttcacatgaattgagaacgcctgtggcgattattcaaggacacatggaaatgttgaatcggtggggaaaagatgatcctaaggtcctaagcgaatcattggatgcatcccttaaagaaaccaagcggatgcaggacttagttcaggaaatgctagacttgagtcgtgccgagcaggttgaaattaattttagggatgaaaagacagacgtcggcgaagttgtacaccaagtatttaataattttcaaatgattcatccagattttgcgttcacgctggatgatgatttgaaggaacccacggtggccaaaatttaccgagatcatttagaacaaattttaattattctttgtgataatgccgtcaagtattctacggaacgcaaagagattcatttatcattgtcacgtaaccttaatcaggtcgaaataggggtacaggattttggtgaaggtatttctcaagataacatggataaagtctttaaccgcttttatcgcgtggataaagcgcggagccggaagaagggaggtaatggattaggattatccattgccaaacgactcattgaaggctatcgtggtaacattgctcttgaaagttctgcgggctatggatcgttattcaaagttacttttccagtgatacaggaaaatattaaaagtttagacgattagaaaatttattacaggttgtgtcaataagtggcataacctttttatattaataaaggctttcacaaacatacacatttgtgaaagcctttattaatatcggacactattagtctcgatgttgttgtttaccttgattacgattgcggttatttttgtgcgttgattcatcattactatccgaatgtggattggcaagggctgcttttgctgcttctgttgaatctgcggccggaacaacgacttttggtttaacgacctttggtgggttctctttgagttgcttttcgatgtttcgtctaatatgcggccgataaagattaataattagtgactgaatgattccgaagagcccgccaatgaagaagtaaatgccaagtccggcagatgatgacatggtgaagaataaaatcattactggactaataaacattgccatccgcatttgtttcttttgatcttcgggaacgccaagcatagatacccaagcctgaactaaataggcaacgaatgataaaattgcaaaaatgatacttgggctaccaagtttaacgcccataaatgtggcgcttgaaagatctggcgagtagcgaattgcggcatacaaggcagcgaatactggcatttgtattaagagtggtaaacagccaattccacccgtcatactaataccattttcacggtagagggccatcatctcttgactaattgcagcttgctcttcaggtgttttggcttttttctgacgtgcttgaatatcacgcatttgtgggccaaccatcgccattttttcttgctgaatagttgatttcttcatttgactaatcattactggtagtaaaatcagtcgaacgacaaagacgatcacgatgattgaccaaccatagttaccgccgaaaaagttggcaagccattccataagatgctgagttggtttagctaaatcgtcataaatcatgccataaggcttaccgtttttagtgcgaacacatccgcttagtaacagtgctaggactgttaccgcggaaatgagtgaaattttcttattcttcatctaattcatcaaatccttttacccttattattaataatcataaacgtattaaactatacagtagttgctgttgaaaagctactaacttcgataactattagcagtgatacggtactattcaatataaaatgtgtggtacgcttgtggagttgctgttgtcacttgaagatttttgacgtgtgcgaatggagtggggccttggttaataaagtctataaattcatcgatgacaagatctgccccttcgacttctatgtaaacactaccgtttgcttgattacggactttaccaccaagcttaaattcgcgggcttttttggccactgcccagcggaatccaactccctgaacgatgccagaagcaattattttgactgccttcaattttttcaccttcttattaggaacaatctgttataattgaggtcgcattggagtgataaatttggaaaaaataacatctgtgcataaccagcacgttaaagattggaaaaaattacagactaagaaacaacgaaaaaaaacaaatacctacctattagatggatggcatttggtagaagaagcaattaatgccggcaatcaaattgtggccttaattgcaactgaagagcaattggctttgcatgacgatattgtaacacgagagtttccgatttatgaagttacaaatgaaatcatggcgacaattacggataccgtttcaccacagggaattgcggcagaagttgagttgccgggagatcgatttacaaaacctgaaactagccatggcgcctggctatttttagatcgtgtccaggatccggggaatatcggcacgatgattcgaactgccgatgcagctggttttgctggagttgtggccagtcaaaaaactgctgatttattctctccaaagattgtacgagcaatgcaggggagtcaatttcacttacatcttagacagggtgatttagttgattggataacgttatttaaaactgagggtcatcctgtctatggcactcagctgaacccgcaggcgcttaattttcgtgaagtaacacctgtagaagattttgcgttaatcatgggcaacgaaggccatggtatggacgcggctactcttaacgaaacgacagcaaatctttacattccgatgaacggtcaagctgaatctttgaatgttgcaatttcagctggtatattgatgttccaactcaaccaaaagattaagtagttttaaatttaaatgagacaatgagcgaaaaactttgcttttttcctgaatgcgtgtattatgttgtcagtattaagaaaaggggctctgtatgaaaagaaatgcgtggcaaaatgacgaggagtatgtcctaattgttgaagacctacttcgtcaaccagctgttcaaaaactatcacagtatactcaacatcatcattcaaaccgcctggaccattcaattgcagtttcgtttgacagctatgagctggctaaaaaattacatttggattatcgcagtgttgcacgtgctgggttattgcatgacttattttattacgactggagaactaccaagttcaacttagggtcgcatgcatttattcatccccgagttgcactacgaaatgctgaaaaaattacaccgttgaacgatatggaaaaagacattattttgaagcatatgtttggcgctactttagcgttaccaaagtacaaagaaagtttacttgtttctttggtagatgactacgaagctgaacatgagtttttctcgccacttcgtcaacgctttgacggatggtatcaacgaatcaagctcagagctaatgtttaactatctgtttactaggggaggtggacttgatggcagtaacagaatcagttgctaattttacactttgtcctaaatttgaaaaaactttttcaattttgggtaaaaagtggaatggcctcattatcgaggtactattaaacgaagaaaccgttcgttttaaggatttggttgcaagtatttctaaatgcagtgatcgtgtccttgttgaacgtctaaaagagttagaacattgtgggattgtcacgcgtaatacacatcctgattcaagccgggtggactattcgttgactcagaaaggccgcgaattgggaccggtaatggatgccgcacatcagtggggagataaatggtttggtgaaaattaagcttgaccattgccccgatgttcactagaatagtattcgtatgttataaagacattgatggaaactagtagatgatgacgcattattagggagctaccaccctggactgaaagtggtagttagtgggtcatattgaatttcacttccgaagtcggcacattgtgtccggttaataaccgttaaaaattacttgagtgtgtggttttaccacaaactagggtggtaccgcgaagcttcgtcccttttttagggcggggcttttttattttgtaaataaaaggagaaaataatgggattacgcgaaaaattagatgagctacgtcagcaaggtcttaaagatgttgatagtagtcaagatttagatcgaattaacgatatccgagttaaattacttggtaaaaagggtccgattaaagaagcacttcgaggcatgcgtgatttaagtgctgaagagcggcctaagattggtcaatttgctaatgagatccgggatgatttgacacgggccattgaaagtaaacgtgccgaactggaacaagctaaaattaatgcgcaactagccaaagaaacgattgatgtaacgcttccggggagcgctgtctctcaaggacaaccacatgtgattcaacaaatcattgatcagttggtggacctgtttattggcatggggtatgaagtggctgttggggatgaagtagaagaagatcattataattttgagatgctcaacttgccaaaagatcatccagcgcgtgatatgcaagatacgttctatgtaacaccagaagttttgatgcgaactcaaacgtctccaatgcaagcacggatgatggaaaaacatgacttcagcaagggacctttgaagatgatctcaccaggtaaagtctatcgtcgtgatactgacgatgctacacatagtcatcaatttcaccaagttgaaggaatggttattggcaagcatattacgatgactgacttgaagggaacacttgaagtcgttgcgcaagaattattcggcgatgaactaaaagtacgtcttcgtccaagttatttcccgttcacagagccatcagtggaagcggacattacttgttttaactgcttaggaaaaggttgctcaatttgtaagaacaccggctggattgaagttttaggtgcaggaatgacgcatccaaacgtcttgagaatggctggagttgatccggacgtatacggtggttttgcatttgggttggggcctgaccgttttgcaatgcttaaatacggagttgaagacattcgtgatttttatcaaaacgatgttcgtttcctcacgcagttcgaccagaaaggataaatagtcaattatgaaagtttcataccaatggttacaagaatatttggatattgatgttaagcctgcggacttagctgaaaaaattgcccgaacatctgtcgatattaatgatgtttattcacccagcgatggattaaagaaattggtggtcggttatgttgaaagtacaacaccacatcctgattccgatcatctaacactgtgtcaagttaacactggtgaggataccgtacagatcgtgtgtggagcacctaacgttgtggccggtaagaaggttattgttgcactgccaggcgccagaattggcaacaacatcaagattaaacgaagcaagatgcgtggtgaattatctgaaggaatgctctgcgcacttcaagaaattggcttcagtgagaatattgcaccaaaagcctacgatgaagggatttggttcttgccagatgacgctaagcccggcgaatccgtcttcccatatcttggaatggatgatactattatcgataccgatatcacccctaatcgcggtgacatgtttagtatgttgggaaatgtgaacgatattgcggccttctatggccttaagtcccattttaaggttcaaaaggttaatgaaaatagttcacagttaacctcagatttggtggctgtcgacatcgctgatacacaacttgcaccaacgtacaagatgcgggtgattcaagatattcaagtcaaggagagcccactgtggcttcaaatccgactttggaatgcaggaattcgtccaattagtaatgttgtggatgttaccaattacatcctgttgaaatatggacaaccactacacagctttgactatgctaaattacccgcaaaacaaattggcgttcgttttgcaaagcatgaggaaccatttgtgacgttggatgaagacgaacgtcaactcgattcacaggatattgttgtgactgctggtgacaaacctgttgctttggctggaacaatgggcggccttgaaacggctatttctaacgacacaacgagtgttgccttagaggctgccatcttcgatccaattttggtacgtaaacaggcacgtcgtcatgacttgcatagcgagtcatcaactcggtttgaacgtggcgttaatccagaaacagttgaaacggctttgaatgaagctgcccaaatgattgccgaacttggtggtggtgcggtcacaaagggaattgttactggaagtgaacgtgatcttattacacccactatcgcgctctcgctttcacgaattaatcatgtactgggaacgacgttaaacgttgaagaggttgttgatatttttgatcgccttggttttgcaactgcaattgatggtgaacagattacagtaactgtaccagcacggcgttgggacgttaacattgaagccgatctgttggaagaaattgctcgtatttatggttacgacaatctaccatcgacgctccctgaacaaagtagtaatattggggcgcttacggaacgacaacagttgattcgaactagtcgtcacgtcctcgaaggattaggcctcaatcaagcgattagctattctttaatgaccacggaaaaggcaacacagttccaagttgagccccatagtaaccccatgcagctagattatccgatgagtcaagaccatgttgctgcccggatgagcttaattagcgggttgttaacggatgttgcatataatgtagctcgtaagcaaaaagatgtgcaattgtatgaacagggccgaattttcgtgacccatccagatcaaaaacggcctgaagaacaggaacatcttgctggtgtcctaaccggtgagcttttgactgataattggcatcaggctgagcaccacgttgatttttatgatgccaaaggaattgtagaacgctatctgaccaatatggcgttgcaacaaaaaatatcgtttgttgccaatcatgaacgcaaggaaatgcatcctggccgcactgcggatatttatattggtgaaaccctggccggctttattggacagattcatccacaagttgccaaggattataagatccctgaaacctatgtctttgagctgaatcttgaattaattttggcagcggcaaagaagtctcgccattaccaactgattagcaagtatcccgcaattagtcgtgacattgcactacttcttgatgaaggaacaactaatgatgaaattttagccgctattaataaaaaaggtggcgctcatttggttaacgtccatctgttcgatgtctatgaaggcgcccatttacctgcaaataaaaaatcccttgcctatacattgacgtatcaagacagccaaggaaccttgactgaagatcaagttaatgaatctttcgataaagtggttgattatctaaccgatcaatttaatgctgagattcgctaatttaactaagcagcgtttacgctgctttttgcgtttaaatttaatttaaaagtttaaatttaacgttcagtgtcgctattgtgaaaaactttagtataatggacgggattataaaaatagggtggtaagctaatgaatcagcaacagcatagtcataagaaaaaatattggtgggcagcagctatcgtggttattctactaatttgcggattaatagggacgaaagtttatattaattcggccatgaaacctgttaactcggcaaagaacacacagattcaagtgaaaattccgttgggtgcttcaaataagaaaattgggacaattctacaagataaaaaattaattaagagttcgtgggttttcgattattacatcaaaacacacaacaaaacatcatttaacgcaggatactatgttctgaaaccatcgatgaatcttgctacagtagttaataagctcgaaaagggtgggagctccacaccgttaattggccagaaaggtaaagttctggttcaagaggggcagaccattgaccaaattgccaaaactgttcaaaagcaaacgaaattttctgctaaacagttcttggcacttatgaaagatgaaaattatctagaccagttagccaaacagtatccacaattattaagttcaacgatgacggccaaggacgttcggtaccgtttagaaggttatctctatccggccacatatgatgtgtcaaacctgaaaaatttgaagacattggttaatgaaatggttgcagcagaaaatacgcaactaaagccttattttaatacgatgactaaaaaacatttaagtgttcaggaagtgttaacgttggcttcactggttgaacgcgagggtgttacaagtaaagaccgcggaaaaattgcgggcgttttcttcaaccgactcgataaaaatatgccaattcaatccgatatttcggtgatgtacgccttgaatacacacaagaaaaatttaacgtataaggatttgaaggttgattctccttataacttatatactaataaaggttatggacctggaccatttaatagtcccagtctgcaatctgttcaagcggtattaaatccaactcaacgcagtaaaggatatttgtatttcgtagcaaatacaaaaacggggaaggtttattactcaaaaacgtatgcacagcaccaaaaaattaccagtaagttagcaaaggataatcaataacgagaggaatataaactgtgagtgaaactaaaaagcggccccttattattggggtgacgggtggttctggtagcggtaaaactactgttagtcaagctatttatgatgagttggctggaaagtcaattatgattattgcgcaagacacatattataatgatcaggcccaaatgactatggcgcaacgtaaagcggtgaattatgatcatccactggcgttcgatactgatttgttaattagtgatttgaaaaagttattgaataatgagtcgattgaaatgcccgtgtatagttattctgaatttacgcgttcgaacaagacggtgcgtactgagccacgtgatgtgattattttagagggaattttaatacttgatgatccacggctacgtgacttgctagatattaaggtgtttgttgatacggacgatgatattcgaatcattcgacgcattcaacgagatatggtggagcggggccgttcacttcagtcagtaattgatcagtatttaacgacggtcaaaccaatgtatcatcagtttattgaaccaactaaaaggtatgccgatattattgtgccagagggtggcgaaaatacagttgcaattgatctgctaacgacaaaagttcgtgatattttagcccatcacggaaaatagtttcattgcggttttggtttacaagcaaccagtaacatggtaatgttttggttgtattaatttaatgtaggggtgacaaaatgtcagacgaaaaaacatacccaatgacacttgagggtaagaaaaaactggaagacgaattagaagaattaaagacaaaaacgcgtgccgaagttattgaacggatcaagattgcacgtagctatggtgacttgtctgaaaactcagaatatgaatcagctaaggatgaacaagcattcgttgaaggccgaatcagtactattgaaacaatgctacacaacgccgaaataattgatagtgaggcagttgctacagatgaggtttcattgggccgcacggttacctttaaggagcttcctgatgaagaacctgaaacatataccattgtgggtcagtctgaatcagatccattaaccggcaagatttctaatgaatcaccaattgctgtcggcttattaggccataaggttaatgatgaagtttcaattcaaattccgaacggtagtatgaccgttaagattttatcagttaaatagttaaaggatcgtctttaagtcgtaacacattatttgtgctacggctttttaatttgcataacatttgaagttacattaaaataaaaagtaagcggatacaattgagctaaagggagagaaagtcaatgcaaatttcagttacagatcgtgctagtcagtggtttcaggatgaaatgggattgcaacgtggaatgggtgtcagattttttggtaaggtctacggtaaaacaccagttcatgatggcttttcgattggcatgtcacgtgacgatcatccgattgatccgatcgttgatacggaaaaggatggaattcattacttcgttgcagaattggatgaatggttctttaaaggatttgacttgacggttgaatatgatcctaaaacggatggcccgatatacgaatatcaacaaaataatgaattggaataggactaataaagacgacgtaaccgttaaatggttacgtcgtcttctataatatcgatcattattttaggtgcttttgccgccaaactagtttgtataagagtgtaccaccaattgagataccagaaataagtaaccctaagatgaagaatggtgggtgataactgatgacaactttatggtgcccttttgaaatttttgctgctaagaatgtaccaagtactttacgcgtttgaacttgcttgccatcaacagagatatgccatcctttggagtatgggatagttgtcatcaaatcttgatgattctttttaacgttgattgtcccagtaattttagtatttgaatgtgcggtgatgtttaaaggcgaagatttaagcgtcttgttcaaacgatcaaagtgactttgatttaatttataaagactaatgttttgaagccataaactttgttgtttaagcttgaaggtaattgtgacgggttgtcctttttgcttggaagcaacgttgatgacaaccgtatttcgaaatgttggatattgtgtgagctttttaccatttaggtagtaagaggctgcatcatccgttaaattagccccaaaagtaaggtagtaggattcatttgtcttagggacaaatgttaaagtaacggaggctggttttaagagactttgtttcgtgaagatggtgccagtgattttagttgatgattgaacgttttggaaggttacgtgatcaaagttttgaaccgagaataatgatgaactagaggtatcaccggctaacgtttgataaatttcagactgccaagcaaccggatccttggttgtagacttaagtgtattaattttgtcagatgcggcaaatgctagtgatagtgctcgtttgtttttgtatgtcttagtgagcgtatcttcgctcgttagcgtttgtcgattgagatcaggtttatttgaagtagttggaagaattgatgacgtttctcgttgtccaataatcgaggtagtcggacgtgcatccataaagtattgcattcctaataatgaatcagtgacttgagtgccattggtgtaagcaacaaaaccgtcaccatcgggttcgccaatggatcccataaaactaggaatacttggttcgagagttgacccaaaatgcgacccaccattatagtcagcttgcatcgtatcgtccttagttctcataaaagttttgccaattctgtaaaagccggaatctgactttttgatcttattgacggtcttatcgagctgagttgtgtagtcgccaaaatcagactgactcacgtaactaatattgttaagcgaaatatatgcatttgtggccacttcgaaaatggcaagcatgcaaaagagtaggtcgtataggactggagagtagaatctgggaatacagagccataccaaaccaacgcaacaaaaaccaatactgattaataattgactatcatcaatgtatgaaaacgaacttaaatttaatttcaagtaggtatgcagcccgataatgataacgactagcggtacaatttttttccaaccaattctaaaattaggggtcagaacatgtgcggcaagccataagatccagaatgaaaataaaaatgaaaaccggtatgggtaccaaactggaaactgaccagcatgccaaagaaggtccaagggttgaacgcagaatgaaaaaatgaagaaaacggtaattgcgacagaaactagccgtaaccttaagtgatagcgacgatcaatgaagaatagaagaaaagccatcaccattaacattcctacgaaaaaattaggttgaccacttggcatttgtttaaagttaaatgatccggtaattaactttcccaacattttaaagggaaaatattcgaatttccagctaattttggtttcagtgtaagttcccttactttgcaataatgcataaaatgttggtagtagaaggatacaggcaaatagcccggataaaatcgaactaccaatgtattttaaaaaccgtcgacaactaattcgaaatcccaatgattgctttgtgagttgccagagcataaacagaattgtaaagattgcaaccatccaagccatatagtaattaacaatcaatagtgctgaaaaccaaatgatgtagacccaaggcttgttttcgttaaccaacttgattagaccccagataatgggtggtagtaggtatagaacatctaaccagataacgttgagctggttggcaatcatccatcccattagagcgtatgctgttgagaaggcaagaacgcgaatacctgactgtaacttagtcttttgtaggagccagccaaaacttaaaccggcaagcccgtacttgatcaataggatgatcaaaacgccgatggatagtgttttacccggaaatgctaagatgattaagtttaagggactcatcaaataatatgaaaaaattccaatcatatcaccgcccaaatccttagagaaagagtagaagaacgtttctgggtggtgaagcaaggttgatctgaaatacgaataaaaatcgatatattgttgtccgaggtcaaccgttagaatgctactagagccgaagggggccatagaacggtatgcaaaatagcttcccattagaataactggtagtaaaaaggctaaaaataaaatactatgtgttcgattaaatcttctaaaaaaatgcaattctctcaacctcaaatcaaaaaatttactgaaatagttaaaattacgcaaaatcgctgtttctttgtttgcactttgtatagaataacatatgaatattctacatacaaagttttaacgttattaaaacgttgatataccagcgtttatgcgacctatgaagaatgtataaatcttttatgaccaaaattcgcccaaaataattggcataattttcggatcatctgcaaattttttcattcttcactatcttttatgtcatcagactcagtagggtctggtgattttttatgcataaacgaattaagccgatctactgcatcacgttttccgttgtcggcgatgtgagtgtagatgttcattgtcgtgtagaacgacttatgcccgagcagtgattgagcttctttagctgtgacacccgcagcagataaaaaactagcatatgtgtgacgaagggcatgcagattgattacaggcatatcgtatcgattacagctagtaataaagttttcagctaccgttgtgagcatcattggaagtccgttccatgatgtggggaacatggtttcattatccggattgagtttgaaaatgtctaggtaatcatctcgtacactcaaccactggtccagagctttctgcgatatttccgaaactggaatagttctatgactcgcttctgtctttaataattcagtacgctcaaatttactgtgtgcgctatcttcggttgttttgacataattatacttaacttcgattaaaaggctgtcagcatgatagcatgaggtagtaagcccacacagttcaccaatccggagaccacagccagctaacacgcaaatgatggcataattacggactgccagatagtaacgaggaaagtatgcccgtttttttaacatggtaatccgattacgttcgcacttagcgtactgttcaaattgttctttcgtccaaaaacgagaagtgcgtcttgtgtgttccattggaacctgtacaccttgtagtggataccgataaatatagccatcttcttgagctttctttacaacttgattgataaatacataatcatttttaccagtggtccacgaataatcctgatgatccaaactgttcaagtattgttgtacaacagttgcgttcagctgcttaatggggatgtgcccaatttggccgctcacacgtcggtaggactgtgtttttgaaaaataggtattatttacgccattgtggttttttaagctctaaccacgtcttagcatacgacgcgaacgtgggattatcgttcttttcaatgaatccatcaaacattgcagattgaactttattggcggcttcttgcgcatcggatttgcgaacgtagccaccatggcttttttgtttatattggccgctataaacatccttataagatattcggtactcccatgtaccattacgttttcgatacgaagccatgtgtaatcacatccttaatttatttatattttgcccaaaattaaaattgaatagtagtaggagattcaattttatgttttttagcaaacatatgttctttttgagtgctaaataaaagccccgaaaaaaatagggcgtttatctgatcgctaatagagattgtttgtctgaccaattaaaaagctgtatatctgaattatcggcaattttttttgaattggcatttagtttagcttcattatcgttataaattattgaataagaaaggttcctatatgttttacttgtagattccgtatttttcaaaatatcatttattttatatgcgcttaccatcatttcgtcttttgaaattttattttgaaaatcaattattctcattggacgattgtattttgctggaataacatagtttgtggtatatggcactccgctttgcccctcaaaggtatattttggtaacccaccaaaatcattttcttccaaatagttatagacctcttcaaaaaacaaactttcaatattttttttcttagtgtaaaccaaatcgttgatcataagaattgcatttgtaagtcgttgcttcatttcaggaaaatcattaatactaccagatacagagagaacatcatcgaattgatcaattgaaaattgactttttactgaatcaataatttttttgcgatagttagaaatttctacaccagttagctctaagtcttcaagagttataccatcatcactaatttttattttatttttagaaagtggttgaacgtatatacgcatgttgtcaccgatactgttcacaaacggagtagtaatttcatcggctatatctagtgactttattgtgtattgttctcgtaaccataccgtataggcatctaacaatttattagttggcagttcagcactgttcatttattaattcaccacttttctcttttacttatttagactgtcttttcagaaatttgtaaattagccatctcgaaattattatactttaaaaattctccaagggaagaggcaatgtcgtcagtccggtcatagtcttgaatcttcgataaaggaatacaaatggcaccttgattgtgccgttcgtcaaaaatgtgtacatgtggtgtaggaattccttgatgagttgcaccaattatatcaattcttataacgatttcgcttgttgaatgcattagaacgtaagttaaatcatttttgcgaatatgaccttttctaacttgaataactttgaaggtttctttgctgttaaatattgagtgtccatggaaaatttcttgggatccactgattgcacaatagagttttttcttatttgttattttgggtcgattatgtaactgctgatatttttcatcttccatacagttcacatcctttcaataaataagtacgacgcctccggcaggactcgaacctgcgctgccatccggtgggggtacactttagtttgaaacgatcgttccgtcaccgtataccataacgctttgagcggtaccggtcattgagccaccatctagttgcgactgggagatggcctttacgaagaatccactttgcggatcgccatagaggcagccccatttccaatcgccaccgttgttgccatatttagcttctgcggccgctacggcttgagcgctgttcgtaatcgcaccagtagattgagtggagctggaggccacttggctgcttgaagaggcggcttgttgtttagctgccgaactcgattgtgctgcttgtgattgagacgtggccaccgacgcagctgatgatgaactagccgcgatcgaactagctttactttcggattcagcttttgccttgctttcagaagtggctttagctttcttaatggattcctttttagcgtgtgcctttttcttagccaccaaactacttgaatctttcttagccttatcaggtttagtttgcgagttcccacacgccgcaagtgatagggtagtgattagtgcaataccaatcgttaaaccttttttcaattgttacatctcccaatgtattacaatccgagcaactgcttctttttagcgtcaaaatcttcttgagtgatgattccgtcgtcaagcagtgttttgagctttcgcaattcttctccagtgtctagttctgaacttttcaaatcaatggctgatttttgatttttttcaaatagtgatggatattttgatgctacagtttgtacgttttggagatcctgtttaatccatgatgcttgaagaagcattgtatagagaatataatctgcattctttcccttggattcaaagtcactgattgacattttcatgccgttcatcataatgcggcctttgaataatttttgttttttaaattcaattgcgccgaattcgcttaatggtatgaatttatcatttcctgtgaaatggaaaagtttactaattcccatgaataataagccattttcttcgaaacttatgatgtaggttttatctgtgagtactgcaagatcgacagaaagccaattcaggcttgaaagtgtttcaacatatgctaaattatcggtattttcgggaaaacctagtgaaatttttttattcttaatgttttcaatgtttaaatcactcattatccttttcctttctagtgcgtttactggtttaaatggttaatagcgtaatcagcttgagcgggtgtgaattggtcgccagcgctagatgtaagttgatctcgaatatctgctaacgacatactcatgtcgtcttgataagtctgtgctgactccagagcgttttcattccaatcgacatctgtaaggtgatcaacggcatattgcgcctctgtggctgtgaatccgtcaccggaactagaaattaactgttcgtaaatgccttgtttagacatggacatagtcgcatatgtttcagcagactctagtgctgcttgatcctgtgctgtgacagaatctgaggatgaatcagcagctgaactagtttctgaggactcggaactcgatgaatcatcaattgtgtcactggacgtatctgacgatgcgtcatcagaagaatcatcatccaggctcttcatatatttagactgacctgaagttattttaagggtagtgggatcaaacttatcattaaaagcatcaattagatcgccagatacttcatcgtcgtatttctttgtgtagttcgtaactgcaaatattgcgactttatctttcttcccgactttatagcttgatgattctgaggcatccatgatgctcagttgcagtctaaattttccatcttttacttttggaaatccactatcatacccggtcttttctgatccatttagatcgtcaccaacggaatttgaaggtactgcaacgatttttgttccatcaggagcatcggtagttcctctaataatccattcatcatcttttgtcgttactttagtggttttaacgtcatagatagtgtgattgccagattttgcagtttgctgtccacaagcagctaggaaaagtgatgatagtgccacaacactaataccaattaattgctttttcacgataattcccccaagaattttattttttaaatcgtcgatttttagatttatacatacaagagatcaataaactatgtcttgcaatccaagcagctctatttgcttggacttatcaaattcagcaatcccgcactgattcgacattaatttcaacgaaaagtcattcgcaatacgttcctttttgaggattggagtatttgaatgaattcgccgcatgtagggagtgctcatatctttctccaaaacatgttttagctcatgaccaagtacatattcagtttcagcttcgctaagctgattgctgacggtaaccacgaaaattcgacgatcatagaaagtgtagccaagtgtcacgccatcaagatcggcatagagcaccggcacgtgcatgtatcttaatatttttcgagcatcgtaagtttcgtgctctttatagattttcgaaatttcatcgtccatagaaccaccttaatcgccatcacgatattttttaggtgtgaactttttctttgcttcctgttttgctaactctagcgccatttgaagagaagccttcaatttagcacggccctcgtcagtcatgggttcgccatagaagttaatatcagcggtcatgccattaattacatcttcgacttgttccgcggcatcttttttatccttttcggtcaggtcgtaatagtgtttcttatttgatctaccgtgtaggtaatctagggaaacgtcgaacagatcagctattttattttgtgtttcagtatctggtgtccgcttaccttgctcatatgaggcgtaggttgtttttgcgacaccgatagattttgcaacttcttcttgagtgcgtttactttcacgtctcagttcggatagtctttgaccaaacatagttttcacatccttcaagtgaaggatactacgcaaaacgcgtagaaacatacaaattgagtaaaaagatacaaaaagagtatttataggattggcgtaatacaaagcgcgtaccatcgtgaaagtacgcaatatgtattagaagaaaattggtaatggagtcataacgagcattgatcagcacacagcatcatatgatttatgagacgtgtaattggatgctatcacgtggttatgcaattactgccgaacgtgaggatctcgattatctaatgatggttatgaaggattaggcggcgatggtatggcgcatgatctttacaatcgtgtacgtgagttaccaattgacaatcgctttgaacaccctcaatgagggcgcatatccgcaagaagtacatgatcgttatagtaagagcgcttaatttagagaggaataatcatgtttaaatataaagttgtgtcagtggattcacgtaatacaaaattttatacgcctgacatttcattcgacaaaaagaaaggtaacaaatattatgtaggtatgatatttaaggattcaaatggtagggcgtggtatagagctgaaaatggtgaattggtgaatgaaacttcacagtacggtggcaaaaagtacaacaatctagtcaggaaaattggcttgaatcctaataagaattacaacggtagctaacaaaatgataataagcctccattcgaaagggtaggggcttatttttatgatataatttcgaaggcaagtcggagcgtcttgtcatttctagctcactttaattggtgggcttttttattttgcataaatgtatataatagtagaaacgtttttctcttttacatgagccgcccaaaatttgggtaagattgatactaaaaacgtggagcgcttgggcgaaatctcaaaatgacccaaaataattttgtgaagaaatttaaaaaagggttaatcccaaaaaatacccataaaaaaataagaacctatggtaagatatgaagggttcttattgttgtttgtatgttgtttaagcattttgttttatgcaattattgcgctatatataatgtataatatgttttgaaaacatatgacatcgaaaaaataagttcgaagttagttcattttatgaagttttggtaaaatggaagtggtgcaagatgcacaacggttagtcgctgtgtatacataacgtttaaggagcattaggtcacttgaaattatcgacgcgtatcaaaaacagatttaagtcacgatccagtaagaaaacagttcaatcacagattccgtttcgactgaattttttgctttggacagttggcgttttactactagtactcgcaattcggttgttctatcttcaggtactgaatggagatgcctacaaggcagaggttaaccgatctgatacgagtgttgaaaccaatagtgtccagcgtgggatgatttatgactcaacagggaaggtattggttggtaatgaagcgcatcaagccattacctacacgaagagtgaatctgctacggcaacagaaatttataaaactgctaatacactgggcaagtatttgactgtctcaacatccaagttgacaactcgaaataagcaagactacttcctggctagtgaggctaacgtaaaaaaagtattggcccagattccaggaagcagtaaattatctgattctgctaaagctgataaagaattagcctatttggataaacatccgagcttctataaattaagtgccagtcaaaagaacaaagcgatgatttacgcagaaatgagtggtgcttactcactttcaacgatttaccttaaggaaagtggggttactagtgctgaagtagctcaggttggtgaacatttaaacgaaatgtcgggtgttaaagttggtacgagttggtcacgtaattatccacaagggaaatcaattcagtcattaactgggactgtgtcgacccaaaagaccggcttaccaagtgacaaggttaatacacttcttgcggaaggctattccagaaatgatagtgttggacaaagctatttggaagaagaatatcaatctacgttagctgggtctaagtcacaaacggaagtttcttctggcagtggatcaagtcagattactaaagcagtgactaaatatgctggtaaaaagggtgataaccttgtgttgacgattaatgcgaagttccaaaacaaggttcaaaagatccttaagtccacgtacaagtcgtcaggagtcattggtaattctactggtgcatatgcggtcgttatgaatcccaatactggtgcaatctatgccatggccggagttgatcgtaatatcaatactggtaaggttactgatgaccaaattggatcgattaaccatccgatcgttatggggtcggttgttaaaggtgccactgtcatgggggcattgatggacggtgttattacaccaaatagtaatacgctgaatgaccaaccaatcaaggttgctggaacggcaagtaagagttcgtggtggaatagaaccggatcggtccctattacagccgaagaagcgctagaagtatcatctaactcgtatatgatgcaacttgcgatgaaggaagctggtacaaagtatgtggcagggagttcacttaacatgccaactagcatcttcacgaagctgcgaggatactttaaccagtttggccttggcgttaaaacggggattgatttaccaggtgaaactaccgggtatactggttctaccagtgttattgggaaggcacttgatttatcgtatgggaactacgatagttatactgttatgcagttagcacagtatgcttctacaattgcgaatggtggctaccggatgaaaccctatgtagtttcacaggttcgggggacaaatagtgatggctctcttgggaaagttgagtccacgacccaaccaaccgtgctgaatgctattgatgctacaaaatcagagtttgatgttgtccgtaaagggatgtatatggttgttcatggatccagtccatataagacaggtagtaagctagaagatctttcaccagctgttgctgctaagactgggacggccgaaacatttgctggaacaacttcgacattgacgcatagcttgatcatgtttggtccatacaaagatccacaggtggttattgccttggcaattccgggtgcatccacaagcagtagctctgtgaatgttcagatggggcatgacatctataaggcatattggaagacagttcaatcatccagtggctattaaaataacatgtcaaggaaatttacttaacaaagttagagaaattactagtcaaaataatcatttaatgatatagtaatacgagttagggttccacccgattaaaaaaagtttggaggtttcagccatgcgcgtacacattactttagaatgtactgaatgccatgaacggaattacttatcaagtaagaaccgtcgtaacaatcccgaccgcattgaattaaagaaatattgcccacgggatcataaagttacgttacatcgtgaaacaaagtagttctgtatgatgtcttaatgacaaagtataacaagaggctggtgacaaattattttgttccagtcttttttgtatccgtaaagcaatcatattttttgattgcgtaaaccggtggtatagttacaatgagattcaggaatgcatgtagtagattgcattcataaatttgaaggtggtggagcacaatattaaattggaaaaatttacgcgatcaggctttttgtacccaagcaatcgtcttgattcaagtgattatttttattctcatgacattagctggtggatcgacaaatactcaagttttagttaactttggtgcgaaggttactacctatattcaaatgggacagtggtggcgacttattacaccagtatttttacacattgggttaatgcacctagtagttaactcggtgacagtttattatattggaacacaaattgaaaatatgtttggtcattcaagatttttagcaatttactttgtgagtgcactgacgggaaatttagcaagttttgtattcctacctgatgctctttctgcaggcgctagtacggccatttttggcctgtttggagccttcctgatgttaggagaatcatttcaccataatccctatattcgtctgttaagtcgacaatttttgatatttgtcggaattaatttagtatttgacctatttatgtccggagtcgacatatatggtcatttaggtggactagttggtggttttttgatgggatatgtagttggaacaccacaaattggcaaaatcaacttgataaagcgttttctaagtggcatcatattgcttgtagtagttgttttgttttatcaaatgggtatgaaaataatctaaaggtgggtaattgaaatgaaaacgttatacgatgtgcaacaattactcaagcggttcggtgtctacgtttatgttggaaagcgaaagtgggatattgaattaacggcgctggaacttgataacctatttaaatccggggtcattgagcgtgacgattatttaaaagcaaaagtggttttacgccatgaacaccatttggaagagcaatctgaagcaaagaatggtctcaaggaggacgaacaatgagtagtaaaaaattaatcggtgttgatcttggtgggacaactgttaaatttgccattttgaccctctacggtgatgtgcaacaaaaatgggcatttagaacaaatattttggatgaagggcagcatattattccagaaattgtcgattccatcaatcatcatattgatttgtataaaatgtctcgagaccagtttgttggaataggaattggaactccagggactgtcgacttgaaaaatggaaccgtaacaggggcttttaatttaaattggaaaaagccacaagcactgattgaacagttagagactggaactggactcaaagccgcacttgataatgacgccaacgttgctgctttaggtgaacgttggaagggtgctggcaacaacggtgacgaagtcgcattcattacattgggcacaggcgttggtggtggtatcattactaatggcgaaatggttcacgggattcatggtgctggtggtgaaattgggcatatgatcgtggaaccagaggggtacctctgtacctgcggaaaccgcggctgcctagagcagtatgcatctgcaactggagttgtacatttggcaacggatgctgctgaagaatatgctggcgatagcaagttaaaggcaatggtagatgatggtcaggagattacttcaaaaattgtgttcgatttagctgaaaaagaagacgattatttggcaaatgaagttgtggaccgtgttgcacattatctagggcttgcgagcgctaatattagcaatattttgaaccctgaatttgtagtgatcggcggtggtgtttcggcagctggagaatttttgctctcacgtgttaatgctgcatttcagcaatttgcctttgcgaccgtacgcgactcaacaacactcaaattagccgagttgggtaatgatgcgggggttatcggtgccgcatcactagcaaaacgatttatgtagtgtaatttaatatttggaggaattagaattggtagttggagttagtaatgcgttgattacgattgatgtaatcttatttgcaataatcattatttggattgtaacaacggtggtacagtcgtttagacgtaagaagtattcgaccgtgctggaagaagaagcgtttacggaaggcatgcggaaagcacaagtgatcgatttacgcgaaaaaaatgattttgataagggacacatcttgggtgctcgaagcgtaccatatagcatgttaaaacagcgatatgcagaaattagaaaagatctaccagtttatttgtatgatcaggggatgtcgatgagtacacgtgcagctgcttcattaggcaagcaggggtatcaggacatttatattctaaaaaatggttatgctcgttggacaggaaaaactaaggcgaaaaaatattaaaaaataggggctgagatatattgcttatctcagcccctaatatgttgactatttattatgtgcagaacggccttttcgaacggcggccttacgattttcctcaaatcgtgtttcttcttcttcaattggtttcacaacgcgtttatggaaagtaaagacaccacccaacacggcgccaactgtggcagccgttccaatgacaaatccttttgcaaattgtttcatattggtccctccaatcatgttacttacattatgcaagaattggtctctttttaccagtgattcagataaaggagttgagtaaattgactaaaataattgcaatcgttggcccaacggctgtcgggaagacagctttatcgattaaattggcgcaacattttgatggcgaaatcatttctggtgactcaatgcaggtttaccgacatcttgatattggaactgccaaaattaggcccgatgagatgcaaggaattccccatcatatgattaatattcgtgatattacggagcgcttttctgctgccgaatttcaaaaaatagctaccacacaaattaaagaaattgcatcacgaggaaagctgccaattattgtgggtggaactggattttatctccaggcattaatagaaaatttgagtttaggtgacgaccaatttgatgagcgatcaatggagattagagctcaatggcagcagttcgcaaaaatacatgagcctcaggaagtctggcaaaggctcaaagaattagatcctaaagctgctcagcaaattgcaccgaataatgtacgccgattaattagggccttagaagtgattgagaaaacgggacatccattctcggaacagcggaatacaccctctgagtttgaaacattgcttattggactaactactgatcgcccacttttgtatgaccgaattaacgcacgggtagatttgatgatggcgaatggcctagaagaggaagcacggtggctctttgagcatcaaggacgcgaactacaggctggcaaaggaattggatatcatgaattatttgactattttgaaagccaatgtagtcgcgattcggcggttgagaaaattaaattagattcacgccactatgctaaacgacaattaacatggtttcgtaacaagatggatgtaatctggtttgatctagtcacgggccaacactcggtttcggaaattaagaaaaaagtagcaaattggttataaaattaatacttttcgtttatgttataaaacataacatgagccgttgacttttagttttatcactgttatgatcttatcgtagtaaggaaggagggatcattttgaaggagaaagagcttagacgttcgcttgcagttctgccgatggggacggttatgaaactcaccagtcttactgctcgtcagattcgttattatgaaacacaagaacttgttaagccacagcgaagcgatggtaatcgacgtttatattcattaaacgacgttgatcgattacttgagatcaaggattaccttgatgaaggattgaacatggctggtattcgtgagattttcagtcaaaaacaagtggaatctgagaagcgtaaggaagaacagcgaaagtcgctcactgacgatgatgttcgtaaaattcttcatgatgagatcctccgtgcgggtggtttgcaggggatgtcctctcaaccaacttcacctttacaaaaaccattttagcgttttgggtataagaaaggataggtatttgtatggccaagcatgtatatactgatgatgaggttcgacagttaattaaggatgaaaatgtacgatttttgagattgatgttcactgatttatttggcacaatcaaaaatgtggagattccaattagtcaattagataagttattggctcataaaattatgtttgatggctcatcaattgatggcttcgtgcggattgaagaaagtgacatgtatctttacccagatatgtcaacatggttagtattcccatggggtgcagaacatggaaaggttgctcgtgttatctgtgaagtttacactgcagaccgcaaaccatttgcgggggatcctcgtaacaacttgattcgtgtcttaggtgatatgaagaaggctggcttcactgacttcaatattggccctgaacctgaatttttcctgtttaagatggatgaaaacggcaaaccaacgactaaacttaatgatcagggaagttatttcgacatggcacccatggacttaggtgaaaattgtcgacgtgatattgttttagagcttgaaaagatgggctttgaaattgaagcagcgcatcacgaagtcgcaccagggcaacatgaagttgactttaagtatgcaaatgctttggaagcggctgacaatatccaaacatttaaattagtggttaagacggttgctcgtaagtacggcttgttcgccacgtttatgcctaaaccactttctggaattaacggatctggtatgcacattaatatgtcgctatttaacggtcaagggaatgccttctacgatgaaagcggcgatctatccttatctgatactgcgtacaacttcttgggtggccttttgaaacatgctcgtaatttcacggctgttacaaatccaattgttaactcatacaaacgcttagttcctggttttgaagcgcctgtttatgttgcttggtcaggttctaaccgttcaccacttatccgtgtaccaaattcacgtggcgtttcaacgcgtcttgaattacgttcagttgatccttctgctaacccatatttggcaattgctgcggtattggaagctgggctggatgggattaagaatgacttaacgcctagtgatagtgttgatcgtaatatctatcgaatggacgaaagtgaacgtgaagacaataacatcgttagcttaccaagtaccttacacaatgcgcttaagtatttggccactgatgacgttgtccgtgatgcaatgggcactcatctttataagagtttctttgaagctaagacacttgaatatgatgcatatcgtcaacaagttgctgattgggaacgtgaacaatacatggaaatgtattaattaaaaattaaatcgatcgttttttaagtccaaggttttcaaaatcttgggctttttatattgatcagtttaatttgttaaaaaaaatcaatgatcgcggcgcgaatactttaaagtcgcgcgaaaattcggtaagatagacctatgaaaccgattgatggggagaatgattatgacgaatattgtagatcaagatgatcataaaagtgccagtagcgtaattgatgaacaaatttcgctaaagattacatatttacaaaaattgcagcaagcggttgccgatcatgatgatcgacaagtttttgctttattagacaaccaacgttacacttcggctgtactacatcgtgagaatcaagaaaataatattagcgtagtaaaccttgttgataatttatccgatgaacttagtaatttcttaagtgaaaatctaattaagtatttgggaaaggcctacccattcttttactacgaagaattccaacatggccattttaaaatttattttggtaattggtgggatcgacgcgaatttggtgaattagatgttcttaatattcgcttcgtgtttgatcagactgaatatcaaaaattaacggattcatttgaattaacgaaggaaaacaaacgctacaatagcggtaaaattgaggcggtctcaaaagaaaacgactatttgcaaggattaattgacaatcaaaaggagcgcgaagctcagaagactcaactacaagatcaattaaaagaagtaacatcacgttcggggatgccatgggaatcaggcaagcaaaaagaagcccggcaagatctaattgatcagcttagcacgttggaagatcaggatcagcaggctcgtgatgcattgaaaacgattaaagataatgaatctcgtgttctagctttatcaaaagagaacactattttaagttatgaacagaaaagtattttagacacatttggtagctttgccgattttgaagccgcaaatcgaaacctctatgcagactatctcgatactttgagtaatgaaaagcaggtggctgatcgtgactaatgaagagcaagcattaacaacgacttcacagctgcatgattttagtgcgaatgtgaaacagggcttattgaggggacgtaagtatattcagttaatcgatcagctagtcgatactgacgattacgagacacttcttgatgcagcaacgcagttaacggtgatggatgtgaattcggaatatgttcagtttccacatcagtaccaaccacgggactattacttgttattcatggggagattgcttgaaatgcatgataataagtcgttagtcgtccaacttaaccaacgaactggtgaattgagtgcttctttgtctccaatcctagggcaagccaaatttttattcgaccttgaacggagcgaaaatggtggggcgttctttgttgaaacaattacgaagcaaaaactatgctatattaacttagaacgccgtatgttgcgttttaataatcgagccttaataaacctgttcgttatcgaactagctcagaatcaagatgttgcggctgaaacactggaacaggccgtatatccgttaattgcatttacccactacctaaaacaagattttgggtttagtgttgatttcggcattttggatgccgccaacggaacagattactatctcgaacaggatggtctacaactaacagttattgatcgactgtttgttaaaactgcggaaacggattacatgttggttaatttggttaaccgtgttggtgccaaactacaactggaacataacatctcattagaattgggtgttgctccaggttcaggggactcgcaacactggtcgttccgggtggatgatgacagagaggcggtatcattgtttgatttgttaattagatatccactgattcagacctggtacctaaacaaccgagaggcattagaagttaaatctgatccacttatatttgcgaattaatttaggagagtttatttaaatgttagatattacaaagttactgcagtattcaattcgattggatcgtgaaattgctgaagatcgtgaaattgtgatgtcggcaaaaaagagcttagaaaatgtttttgtatcactagatgttgagttagctgaaattgcgaacacttccgagtggtttaaggtttggaaaacgcatcgaggcaaaagtgatcccgacaaaacacctcgggagacgttattaactgagtacgtggatgcgctcgatttctttttgttgttgagtgctaaattaaaatggactcacttgattgttttagatcgagagggcattgagaaactaaaaaatggtcgcccaacggaactcaacaaggaatatttagcaattaagcatatgctatataacagttattttgaaaaccgccaagaagattttcgacatgcctggcgcctttttttgaaattagcatttgttgaattcggcttctcagagtcagatattatgtcggcttatttcgaaaaatatcaaattaatgaagatcgacaagctaacgactactaaaagctttgatataacgtgtttgttaattttgaacagcttaaataaatatttgattatctttttcatatcaaaaagtaatgacatgtaagtgtgattactttttttattaggtctaaatccgatatactttatgtaagacatactattggggaagtgagaaaatgcggcgaaaaattgtgaaattttttaaaactgatggttttatttatctcatttatgtttacatcattgcgttaattggcgcttcaattacgtttgcaatatcagaaaaagtccatttagcaactgctttttggtggggaatcgtgacaacaactaccgttggatatggagatatttcaccacacacgacggttggtaaaatcgctgcagttgtcttaatgtttattgggattagttttattggaatgttgactagcgccattacgacgtattttggtagcagtaatttggatcaaagtgaacatgaaatacttagcaaaatggaggaattacgaactgaaaatgagcagcttacccaaaagatcgacacactgacacaaatgattcaaaaagatcatgaaaacaagtctgagacttaaattcaaaaaagttacgaattactaaagatttaggttagttgacggcaacatcttgcgaattattacaaatgtattaccattgtaatataaggtaaaaattgcaaggagggattgtttatggttccatttttggtaatcgtgttagttctattatttgctgctgggtggcagttttattcaaataatctcaaaaagcaacagaatggcaagcattttgcagatcaaacatatcgggatgcaaaataactttttaacaaatttaaccagaaaatgaaaacttaattttaagtatcatttttgacaagcaaaagggatcctcaatggggatcccttttttacttatttttcaaattgttgtgatttatttcctctggttttacgatactgaatgcgcataagcttgacacattcggtcacgaataaaacgataataccagcaattattggaattaaccaaccaaacgtgaatccaatactagttgtgtggaaaatatcatgcatgaatggaagataaataattcccatttgcaaaataattaacacaccgataatgtaaaacgccatcttattttggaaaaaatacttcgaaattgctggataagaatttcgaatattaaacaggtagaaaatcttaccgaaaataatgatgttcaaagtcattgtgcttccaacgacatgtgacatacccatctgggtaaacacatcataggcaatcatccccaaaccggaaataagaagggaaacgtacacaatctctacaacatccatcttcgataaaataccagccttaactgaccttgggccccgaagcataataccattttcgggtggctcaaagataaacgcaaattgaatggtgagggcggataccatgttgatccatagtagctgtgttggatagagtggcattgtttgccccatcaagatactatagaccacgatcataccttcggcaaaactggtcggaagaaggaaccgaatcgttttgttgatattatcaaatacgtgccggccttcacgaacggccgcaacaatgtccgtaaacttatcattcgcaagaaccatgtctgcagactgtttggcaacttctgttcccttaatacccatcgcaacgccaatatctgctcgttttaacgcaggcgcatcattgacgccgtcaccggtcatggaaataacatgaccgtttgcctgctgtgcatttacgatccgaagtttattcatgggagtagttcgtgcaaacacgttgtagcggtcaatgttgtgctgaagctgttcatcgtccatctcatcaatttcgggaccggtgatcgaacgaattgtatcatctaaatcgagttgcttagcaatcgctgcggcggtatcaggatgatcaccagtgatcattttgaccttgacaccggcttgcctcaattgttgaatggattgtttaacttcagttcgtggtggatcaatcattccgaccattccgataaagtgcatttcttgaccgatatcgatttgatcaatgtcggtaacatcaggggccactttttggtagctaagtgctaccacacgcatgccttgtttcgttaactgcgccatttctgcttcccaatactgctcatttagtgaaacgttatgggaaatagccatctgcatgattgttgcaggagatccctttaacattaaaatgttctggtcatcccgcttaactaatctggcagaatagcgaatggcagaatcaaaggggagtgaatcgagtggatcggtttctggttggtgaccggttaacttgtgataaagcgttgtcagcgccccgtctgtcggctcaccagtcatttgccaattaccatcttcgaggcgtaattcagcatctgtcgtttggccggcaatatcaactaaccactgcacatcatcatcttgatgccagtcatagggacgatcatcaaggaggagatcgccctctaaatcaacgtgaccattttcggcataaccgacaccgctgactgagaatgtatgatcgtcagtgacgatagctgttaccgtcatttcatttttagttagcgtacctgttttatcagtattaacaatatcaacagcacccagagtttcgacggcgggaagagttttaacaatcacatttttcttggtcatgttacgagttcccatcgccaatacaactgatgtactagcaggaagaccttctggcatcgagccaacgaccattgtcacaattgcaatcaatagagttggtaaactgtagacgtgcgttatccacccaaggataaataataagccagccgccactaagattgctactgaaaggccaaaaccaagactgtttaaatttttcattaggggtgttacttgtccctttgcttcagtcacggattgttggatttgtccaatttgagtatcagcagccgtggcaacaacgattcccattgctgagccagatgttaccattgtggaggcaaagaccatgttagtttgttctgtaattggtaatttttcctgcagaatagggtggtcgtttttttcaactgatacagattcaccggttagtgaagattcttgaactgtaaaattatctgctgaaattaaccggatatcggctggaacggcatcaccggcttcaagattgaccaaatcaccgacaacgatatcacgagagtctaattctaatttatgaccgtctcggataacaaagtttttggaaatcagtagctcactgattttcgataacgcgtcgtcggcttgcttctcttgaacgtaaccgataatcgcattcacaataattaccagaccgataacaattgagtctgagtaatgatgcattaaaagagttgtaattgcagcggctgctaggatatagataatactgttgttaaattgtttaataaatctgatgaagttggacgtctttttaactttgagttcgttagtcccatatttgatcaaccgttgtttagcctcggcttcgctaaggccttcatcaacagttgtttgatattggttagataacgtttcttcggttaattgccaccaattttgatttatttgttgctcacgtatatgtgggtcatcgtctatcatgtattcatttcgctccttaatattgttatatcgtttatttgtaggggcttaatgcgggcaatttaaccacaacctttcaaaattaattaacattgtgcgtacaaaaaattatagcatatgcaaaaccttttgagctagttaaatgtgatgtaatcatgacgtaacataattgctatcttttgacaggtataactatttttcagtataatcagaatgtaagcagtatcagttgtattaacgtttgacctgaaagaggaggacttatgatggaaagatatcgtaaaattctagtcggaattgatggatctgaacaatcaatggacgctttacatcgtgcaattgaccttgggcaagcattaaatgcttcacttttattagtaacagttgttgacgatcgtgcgttagcaatggcaatgagcaatactggtaattatgtaatggcacctaatatgcgtgaggatctgatggctcacgcaaaagaaacaatgaaaaattatgtaagtgaagtaacaaaagcaggaattgattttgaagataaagtgttagtcggtgaccgtaagttggaacttgctgaaaatattccggataaggaaaacgtggatgctatcgtaattggtgcaactggattgacccgtatggaacgtgtttttatcggatctactgctagttacattatgaataacgctaaatgtgacgtaatcattgttaaatagaagcttaaaaaaactagctcctgagcactcaaaaaaagtgcgaggggctagttttttattagagcatattttggttttcatcaacgaagaagtcagtaaagaaaatgccggagcaattaatttgagagaaaattttatcaatactctgggtcatataacgtggcgtgtaaatcatgccatcacgaagccagttcttaattaggccgagttccgcagaaacaataaatgaaatttcaagattaaccggaactcctagctcagcgaattgagcaccaacctgttgatggaatttttgtaggtagtctgctaagcgtgcatacagatgatcaaaaaatggttcattttcttgattgttaattaaaacgtcgaaggtttccgcttcgttttcaatatatttaaaagcacgttgttgggaaaatacactgattggttcatctgtactaatcgctggcaaataatctgtaccatcaatcattacagcatcaaaaaaatcatccaaaatttcactcaatgatctttcaataaagtcttgtttgtctttatagtgcagataaaatgttccgcgggtgatagacgctttttccgtaattttttgaacactgatattttcaaccttgtattgtttcattaactgaaccaatgctttttttaggttattacgagttttgataactcttggatcagttttactattcgccatgcttacaacccctaatcgaatatatttcgtcaaattattaatgttgtgtcgagtataatctatatgtaagcgctacgtcaagactttaaaaagacatttcttcaaatattatctaatattcataacctcgatagactttggattctaatataagtaaaaagaggcgtctttttcatgttttgaatttgattgtttcacaactagtgaattatttaccaagtcacaataatttgagcccatttttgaagaattggcgtaattgtacttttagaatgattaggttagactctaattgagtattagtgatattctgatgctcaactaatcattgaaggggagtaatcacgatggatatttttgaattagcctaccgcatggccacacaatataaagggagagaaaatgacttagcagaacttggatatcaacaagatgacattaaaaagattattgaagatccaatggcaacacagcttccggtagcgctggcctataaaatggcaaatgactacgttacaattcaggttcgaactatgcgaggcaacaaagcgtttactgacaaattggagaagttacgagcaaaactaaactcagatgaagatacacagttattagcaactatgctagacagattacccacaacaaacgtttggttgttcgacaagtttaacggttcttattaggcttagtgctgctactaaaaatagaattgacattatgaacaaatatcaatataatgattaaggtttggagcggtagctcagctggatagagcattcgccttctaagcgaacggtcgtgagttcgaacctcactcgcttcattaaataagagccgttatacactggtttatttgtcagaaatgccgatataccagtgtgtaacggctttttatgtgttcgtttaaaataatgttctggtcatcataaaatttttaacattttctggtgtgcttgatcatcaagctcgagaactgacttaatgtaatattttaaggctgtctgcgtattttggcgtcctaggtgccttgctaccgagtgcgagtcatttttgcattggcgttgctgaagcgtagcggaatctgtgtggggcaatgcggatgttaagtagtgtctttctggaaaaagcgctgaccaaagtatttcaccaaagatttgtgaaatcatttgacggaaagaagagaatctgataacatatgtctgttgtatttgtgaactcgcaactgcaaccgcacgcaaacaagtctaaagcattctgctgcttgtacggcgagtctaagatattaaggaggtgcacaatatgtacgcaattattgcaactggtggtaaacaatacaaggtagaagcaggtcaagcgatctacgttgaaaagttagctgctgaggctggtgaaaaggttacttttgatcaagtagtatttgtcggtggtgaatcaacaaagattggtacaccaactgtcgacggtgcaactgtttctggaactgttgaaaaacagggtaaagaaaagaaggttgttactttcaaatacaagccaaagaagcatcaacacactaagcagggtcatcgtcaaccatacacgaaagttatgattgatgctatcaatgcttaattaggagttatcatgattaaggcaatattcagccagaatgcaacaggagtaattgatggcttttcagttaccggtcacgcggattctggtccttatggtcaagatattgtttgtgcagccgtttccggtttgtccatcaccataatcaatggtcttcaacaagtggtcggagaaaatccgaaagttacgcttgatgaagaaaatggtggtttgatgatggtcagtcagctgtcagacaagcatgatactcaaatattactgaaaactttctacaatggtattttagacatggcggagagttactcagactttctaactgtaaaattagataattaacaattctatatttggaggtgaacgatgatgattatgaatttacaattcttctcacaccacaaagggggcggttctactgccaacggtcgtgactcagctggtcgtcgtcttgggactaaggcagctgatggctcaactgtaacagcaggatcaatcttgtaccgtcaacgcggtacgcatatcaacccaggtgaaaatgttggtcgcggtggcgacgatactctgtttgctaaggttgatggcgttgttaaatttgaacgccttggtcgtgacaagcgcaaggtttcagtttaccctgtagctcaatagtaatgaaataaagatcgtggcaaaacattgttttgttacgatctttatttatttgcaaaaacatggtgacgttatgcaacgaattaacgaaatacaaagtgacattgaaaatgcgtatttagacgcttttttggtgaccgacgcaacaaatattttttatttgactggatttaaactgatccagggtgatggactcttactaattcatcaagaaactggatatttaattactgatgatcgctatgaagaggccttaaccgaatttgatgataaaagtttagtgggttgtattagccgacgctactttagcaaattaaaagagtgctgtgagcaattacatattacagtactaggatttgagtctaaaatatcatatcgtgagtatgatattttagacgaaattatggatgcggatattgttcccatgacagatttcattgaaaatcatcgggcaaataaggacacacaggagattgaaaccataactgcgactgccgcgcttcatgacgaggcattcgactacctgtctcagtacatccaagttggtatgaccgagatacaaattgctaatcaactagattggtggatgaaacagcatggtgcaagtaaggcgtcgttcgataccattgttgctagtggtgctaacgcggctaaaccacatgccttgtcaacctccaaaaagattagctctggagatattttaattatcgattatggttattttttggatggttatacggctgatgtcacccgaacggttgggttgcccggtgttgcagatgaatttgacacgatctatcgaattctgacagcagccaaagaacaagcaactgcccgtattgttcctggagtaaagggaagcgagattgataaggttgcacggcaaatcattgccgatgctggatatggcgaatattttaaccatggtatcggtcatggaattggacttgatatccacgaactgtcaactagttacggggcagataattcaacacttttggagcaacaggttgtcaccattgaaccaggaatttacttaccccacaatggtggaattcggattgaagatgatcttttaattacatctactggtgtccaacagctcacacatgcaccaaaacaactacctattttatagataattagttgctttttggcgccatttattgcagaatgaaatagatatattctaggaggaaacaattatggcaatttctacagcaaattttaaaaatggattaacaattgaagtggataacgcaatctggcggattattgaatttcaacatgttaaaccaggtaagggtggcgctttcgtccgctcaaaacttaagaacttacgtactggtgctgtgcaagaaaagactttccgtgccggtgcaaaaatggaacaagctaacattactactcgctcaatgcagtatttatacgctgacggtgacaattatgtcttcatggatactgacaactacgaacaaatcgaattgccagcagaacacatcaagaacgaaatgaaatatcttaaagaaaacatggaagttagcattactcagtttggtaatgaaacattgggtgttgaattaccaaacaccgtaactttaaaagttgctgaaacagaacctggtatcaagggtgacactgcttctggtggttcaaaacctgcaactatggaaacgggtgtcgttgttcaagtgccattctttgttaatgctgatgatgaacttatcattaacaccactgacggcacttatatttcacgggcctagttattaattaagactggaggactgtaccgatggcagaagacacaaatattgtcttaaatgacgatgaacaagaattaggaacaatccaaattgctcctcgtgtgttagaaatcattgcgggaattgccgcaagtcaaatagaaggcgtgtctagaatgcacggttcaatcgcaagtagtgtgaatgaacttttgggtcgccctgatcatggtcgtggtgttaaattaacgaataacgatgatgagctgtcggttgatgtcgctgtctacttggactacggtgtttctgttcctaagattgccctagagatccaagacaaggtaaaacaacagatttcattgatgacggatctcaagattaaagaggttaatgttcatattgaaggtgttgtaaccgaaaaagtcgaacagcaaattgatccaaatgatatttttgctgaagatggaaatggagaacagcagtgagtttgaatcgtcatcaaattagaagaagcgcttttcagaccttgttcgcattatcgtcaaattctggtgcaaatgtgagtgacatttatgaccaagtattgaatgacgatgacgaggttccggcgtacctaacgcaattggttgatggtgtcattgcacatcaggatgaattagatgctagcattcaacagctattggataaaaagtggcgtttgtcacgattagctaagactgatctggtgattttacgaatcgcattatatgaaatgcagtttgttgataatgttcctgatgcagtggcaatcaacgaagcattagagttaacaaagacctttagcgatgataaatccaagggatttgttaatggtgttctgggaaattttgaaaagcaagctaaataattggttttttaaagtctgatgagcgttaagcatcaggcttttttattactactttacaagttagctttatgctaaaatattaatattactgaagatgttttgagcagggagagttgattgaatgacaacaattttagatggtaaaaaattagctaaaattattaatgaagaaactaagaatgacgtaagtcagttgaccgctgctggaattaagccggggattgctgttattctagtcggtgatgacgaagcaagtcagatatatactcgtaataagcaacggaaagctgaacgtttaggaatgacatctatcctaaagcaatttcctgcaagtactgaacagcaggtcattatcgataccgttcaatctttgaatcgcgataacacaattaatgctattttggttcaatctccgttgccggcccatattagtcaatcgacagtaacggaagcaattgccccagaaaaggatgttgatggatttcatccaataaacttaggcaaactttacgctaatgagccaacccactatccagtggcatgcacgcctaagggaattatgacgatgttagaccattatcatattccaattgctggtcaacgtgctgtggtggttggtcgaagtattttggttggtaaaccaatggctgcgctgttgcaaaatgctgatgcgacagttacgattactaatcgtcaaacacaaaacttacagtcaattaccaaacaggcggatatactggtggttgcaactggtaccgcacatcttattacaccagagtatgttaaaccgaatgcagttatcatcgatgtcggcattgagcacgatgcaaatggtaaattgatcggggatgtagattttgaccgagtagctgacttaacatctgcgataacaccagttcctggtggtgtgggcccaatgactatcgccacattaatgcagcaaacggtagagttaacaaagtggagccttgaaaataatggataattccaaatatctttctgtatcagcattaactaaatatattaaacgtaaatttgacgttgatccttatttaggacgtatttatttaacaggtgaaatttctaattttcgtttaaggtctaatgcacatcaatattttagcctaaaggacgaacatgctaaaattagtgcaattatgtttaaatctgcatttcaaaaggttaaatttaccccggaagacgggatgaaggttctcgtttctggtagaattggattgtatgaggcgagtggcagctatcaaatttatgttgattcaatgcaaccagatggcgttggtgcactttaccaagcgtacgaacagttaaaaaataaacttgcacaagaaggattgtttgatgcctttaagaaaccattggttaagtttcctaagaagattgcagtcgttacaagtcctagcggtgcagtgattcgtgatattataacaacgacccagagacgattcccaatcacgcagattgtccttttcccggcactggttcaaggtgatgccgcagcaaaggacattgtgcgccaaatcgaacgagcaaatgcggacggaactttcgatacgttgatcattggccgtggtggtggctcaatcgaagatctatggccatttaacgaagagattgttgcgcgcgcgattgcaactagtaatctgcctgtcatttcctcagtcggtcacgagacagacacaactattgcggaccttgtagctgacgtacgcgctgcaacaccaactgcagcagcagaactggcagtcccagttttaacagatgaagtgattaaacttattaatcaacggcagagacttgttgcggctactcgtagcttgattaaattgaatcaacagcgattgaaacgtctacaacaaaactatatttttcaacagccaaatcggctgtatgacggatatagtcaaaacgttgatttactccgacaacgtcttgcacgacaagcagcaactcaatttgggcaatggcaacaacaggtgttagctacaaaaaatcggttatccgttcaggcacttagtcagcaaattagtcgtgctcaacaagttgaggaaacactccatgcacggctagaacgcgctatgcggcaatttatggttgatcaacataaagagtttagtagtaccgttgaatcgcttaattttcttagtccattgaagataatgtcacggggatacacttatgtcacagcgcatgatcatgtggtaaaaaacacaatcgatttgacgaccggtgaaagtattgatcttcactttaccgacgggcaagccagagcgaaaattacagagatcaagaaaggttagtacaaattatggctgaaaaagaaagttttgagcagcaacttaccgatctacaaaagatcgtagagcaacttgaacaaggcgacgttcccctagaagaagccttgaaacaatttcaaactggggttgaactaagtaaacagttacaatctactctagataatgcagaaaaaacattagctaaattaatggatgatgaagggcatgaaattccatttgatacaacacaaaaagaggacgataatcatcagtaacttatcagcgcttcaaattgaaattaaccattttctggccggaaatattgcagctgatactgcacagccggtacttaatgcagcgatgcagtattccttattggcgggtggtaaacggttaagaccagcattgaccctagccacgtatcagtcacttggtcagacacttgatccagacgtgttgaaagctagctgtgcagtggagctattacacacctattctctgattcacgatgatcttccagcgatggataatgatgacttgagacgtgggaagccgaccaatcataaaaaatttggtgccggtatcgcaacacttgctggcgacggattactgacattggcgtttcagtggttagttgataaccatttgcctgcaacaacaactaaccaattggtagccaagttagcaattgctgccggtcccgctggaatggtcgctggtcaaacatcagatatcgagggcgagcaccaacacttgaccctatctcaattacaactcctacatagtcaaaaaacgggggctttgattgagtatgcgatttgtgcgggaggaatcttagcgcacgcacagccggaagtaatgtcgttgttaagttcgtttggtaaaagctttggactggcctttcaaatttatgacgacttaatggatgtcgtcggatcggttgaacaaatgggtaaacaagtccacaaagatcatgatgagcataaaaatacctacccagagttaataggaattgatgaaacgaaggcggttttactggatacggttgtccaactaaaggcaattaaagctcagcttgaacaaagcactcatcaatcatttcaagtctatgatgaattcatagcgtactttgatttataggggaaaataatggaaaaagaacgtgttgatattttattggtcaagcagggattgtttgattcccgagagcaagccaaacgggcagttatggcaggcgaaattttggggaagaataatgaacgacttgataaacctggtgaaaagattcccattactacaactctacatatgaaaggtaaaaaaatgccttatgtaagtcgtggtggtcttaaacttgataaagcattaaaggtgtttaatatctctgttcaagataaaactgtactagatatcggctcttcaaccggcggatttacggatgtgatgctgcaaaatggtgcaaaattaagttatgcgcttgacgttgggactaatcagttagtatggcagttacgtgaagatccacgtgtggttgtaatggaacaaactaacttcaggtatagtcaactagatgactttactagtggacagccacaatttgcgtcaattgatgtttctttcatttcgttgaaattaattttgcctgtactggctaatattcttacacagcaaggtgaggttgttgctttaattaaaccgcaatttgaagcaggtaaggaaaatgtcggtaaacatggtattattcatgatgaaaatgtgcatcgtgatgttctcaataatgtccttaaatttgcctgtgatagccatttcgacgtaattggattggatttttcaccaattaaggggggccaaggtaatattgaatttctggctcacctaaaactagcggactcgctggggcaaattgccgcagacgtgtcgattgatcaggttttaaataatgcatatgaatcgttaaataaataaaggcatgtttagcctttcattatttatacatttctagtaaaatataatgtataaataatcatttcaaggggtgttaagatgcgaaaagcagagcgccaacaatatctacgtcagctaatgaatcagcacagtattgagcgtcaagaggattttgtgagcctactagatggacagggaattaaagttacacaagcgactatctcgcgtgacattaaagaaatgcagctggtaaaagtaccaagtattggtggaggatatcactacagccttcccgtccagaagcagctggatacgcaaaagaaattgcggcgaacactaggtgacgctgttatttcgatggacatacaggataaattggttgttttacatgttcaaccaggtaatggcccagctctatcaacactaatctcacagatgaattatgaggatgttttctgtacacttggtgatgattcaacagttttattaatttgccgcagcgatagtggtgcacagcaattgttaaacttaatcaacgaattgattgagggatagatactaaaaaggtgagggaagtgtgtcttctgctcacctttttggccagaatggaggagttaagttgcttcaggaattaacagtcgataatttggcaattattgatcatctttcgttagaattcagtgatcagatgaccgtactcactggtgaaaccggtgccgggaagtccattatcattgatgccgttggtcttttggctggtggtcgtggatcacaagaatttattcgacgtggagaagaaaagctaagtattcaaggacaattcacgatgcctaacaacgtaaaattcagtcaattgcttgatgaatttggtattgattacgaagactcaattttgattattcagcgagaaattcatcgctctggacgtaacaccattcgggtcaatggtactctgattaatacggggatgcttcgccagattggaacttggttagtcgatattcaggggcaaaatgagcatcaacggctcctacgacctgaagagcatttaggaatgcttgacgagtacgcacgcgatgatatcagcagtttgcttaaacaatatcacgaagaatatcatgactatgaacaggttaaagcagcacttgaaaagaagcaatccaacgaacaactttgggcacagcgcttggatatgctcaaatttcaggttaatgagattcagtctgcagatttgcaacccaatgaagatgagtcactgatagtcgaaaaagagcggttgagccactttcagcagatcaataatgcgttagagcttaccagttcgactttaaatggtgatgagaacggttcgattctggatttaattgctaacacgatgaacgcgctacaagaaattacagagtttgacgcgacttattctgatttaacggatactatttctagcgcctattacagtttgcaagatgcggcagggcaggcgtctcatcaactggataatttagaatttgacgaggaacgattaaatgaaattgaaaatcggctggcacttattgcggatctagaacataaatacggtgattctgtcgcacaaattttggattactacgacaaaatacaagcagaactcaaatccatgcaggcttctgaaactaatagcgataatttggaagaagagctccatgaccactaccaaaagttaatgactactggtcaccagttgagccagcaacgacagcaagcagcccatcaattagctaaaaaggttaaccaacaattaaaagaattgtacatggaaaaggctgtttttgaagttaaatttttaaaaagtggcagtggagaacgaataatgaacagtggtcttgatcgcgttgaattctatattcaaaccaatcctggtgagagtctggggccactcgcaaagattgcttctggtggtgaattatcgcgtgtaatgttggccctgaaaacaatttttgcgcaaaatcaagaaattactagtattatttttgacgaagttgatacaggtgtgagtggccgggtggctcaggcaattgctgagaaaatcagactaatttcacgctcctcgcaggtactatgtattacgcatttaccacaggttgccgcagttgcagcacatcattttatgattcaaaagagcattcatgatcgtcgaaccatgaccacggtgactatcttaaaaacaccagatagaattaatgaactagcccgaatgctgtctggtgctgaagtcactaaactaactcttgaacatgctcaagaattactacgtatgggacaggaatagttaaaaggactaaatcacgcgaaagttattaaaacagcgtgatttagtcctttttatcttttttcaatgtatctaattagtgagggcgttattaaataagtaacgttatccaacgtggttagtaaaatcttagaatccttgaaaagggatagatggccaattacatttgttacttggcccatatccgacgttggcatcagttgcagttttactaagaaatgcgattctaaggaacgacgcatgaataaatcaatttgaaagcggggcatttggcgtttaattacaactggctgaatacgaggacgagtagtttccgatagtaatagttggtcaaaccgttgcttcaattgattactaaccagtttaatcgcactttgataattctgcataatgaatcctcccgaacatttgtttgtgtttcatattatacgaacaaatgttcaattttgcaaccccactaatcaaactttaatttttttcgaccaaaaactagtaattttaaaattttcttgattacccataataaatagtgcaaaatggttagtaacacataaattaaggagctacataatcgcatgacaaaacgtggaatgttgattgttttgtctggtccctcaggagtcggcaagggaaccgttcgcaaagcaatttttgatcaggacaacaatgattttcagtattctatttcaatgacaactcgtaagccgagacctggtgaagttgacgggattgactacttctttgtatcaaaagaagaatttgagcgtaaaatccaaactggagagatgcttgaatatgccaaatatgttgacaattattacggaacacccttaaactatgttaatgaaacactggaatctggtaaggatgtctttcttgaaattgaagttaatggtgcaatgcaagtcagagcaaagtgtccggatggtgttttcgttttcttaactccaccagatttgatggaacttaagcagcgattaattcaccgtggtaccgatgcaatggatgtgatcaataaacgcattcaaaaagcagtcggtgaaatcaaaatgatgcagaactatgattatgcggtggttaatgatcaggttcccaatgcagtggaaaaaattaagaatattattcgcagcgaacggttacgtgtgccgcgggtaatgcctgattatcttggtatgttaggagagatgaacaaatgattttatatccatcagttgataagctactagaacgggttgattctcggtattctttgatcatgcttgcaagtaaacgggcccatgaaattgatgcgggtgcaacaccattactgagcaagtacgattcagacaaatcagtcggcaaagctatggaagaaattgaagctggcgaagtgacaatcgataaagatagcgaaacattttaattaagtttgtttgtgatacaaacacgagtccggagcaagttagttgctgcgggcttattttttcatgattcgtgttataattttatttagtaattgaatttagaatggggagatttgaatgacgcgtgtcacgattcacgtaacgggtggaatcgccgcttataaggctgtctcactactcagattatttcaaaaaaatggtgatgatgttcgcgttgcgatgactgaatcggcaaccaaatttgttacacccgccacttttgaggcgttaacaaagcagcccgttttgaccgatttatggtcgccagctcaaaaggctaaaattgcacatattgaactggcagattggactgaattagcaatcgtagtgcctgcgacagctaataccattgctaaaatggctggtggaatcgcggataatgccgtatcgtcaacgttgctggcaactgatgcccccaagcttgtggtcccagctatgaattctcatatgtgggccaatgaagcaacacagagaaatattgcacaattaaaaaacgatcaggttaatgtaatcccgcctgaaactggtcgtttggcagaaggatacgaaggaaccggccgaatgccaacaattgataccatttttaacgtggcgcaagctattcttcaatctgatgatcgattagtgggcaagaaaattttagtcacggctggtggaactcaagaagatattgatccagtccgttttatcggcaatcattcctcgggtaaaatgggaatcgccattgcaaatgccgccgcacaagcgggggcatcggttactctaattgcggggcaggttaagaatttagcaactctggactcgcgaattttggtgacgcgtgtcacatctaccgacgatatggcgcaggcagtaaaacgtgacttcactgatgttgatgctttagtcatggcggcagccgttgccgattttcaaccaataacaagagccgatcaaaaaattaaaaagaatccagatagtgatgagttaacattgcggttacgcaaaacaccagatattttaaaacaagtgggtcaaatcaaacgtcaccaatttgttgtcgggtttgcggccgagacacagaatttactccaaaacgcaaataagaaattaatccaaaagaatgcagacatcatcgttgcaaacaatgttagcaatcctggagttggctttggcagtgatgataatcaagtaactattctgactcgaaatcacgaacctgaaaaatggcccaagatgagtaaacaattagttgctcaaaaaataattgatttgatttcagatcaaattttgtagggtgattgaatggcagaaattgcacaaattattgtagatgttccgacaatgcaaaccaatcgtccctatacttatcaagtaccgcaggaatggcaacaccagatcaaaattggaatgcgcgtagtagtcccatttgggaatggaactcgcaaagttgaaggggttgtcgtaggtcttgacgagactagtacttacgatggtcagctcaaaaaaattgattcgttaatggatcttaatccagttttaaacgacgaattattgcagctgtctcaatggatggccaaccaaacttttgcttttcaaattacatgtatccatacgatgctaccagcaatgctaaaaacaaagacacaaaaatatctccatctaattgatgaagtggatgaagaaacttttctaactcaatttcacggattagatgaaattgagtttaatcccgaaaaattaactaagccacagcttagccaattattgaagctgaaaaagcaggaaaaggttgaagttgtttatcgtgttcgtgaccgtgcgaaaccaaagacggttctgggaatttcgcctgcattaacttttgaacaatacgaagaacagcgaagcacacttaatagtcaagcaaaagcacaaaatcgacttttatcttacttacaaagtgttatcgggcaaacaatcaaattaactgaagcacgacaaaatagtgctctttctacagccgtttttaataccggagcaaaaaaagggtggttaatcaaaaaaaaggttgaaatatatcgaactccgacggcactacaagatacggccatcattgaatcacaactgaaattaaatgatgagcaacagatcgccgttagcgccattaatcaggccgttgatcagcatcaggacaaaacatttttgcttgaaggggtgactggaagcggcaaaaccgaagtttatctgcaatgtatcaaacgggctattgatcaaggccagactgccatcatgttagtacccgaaatttctttgacgcctcaaattgttgcgcgcgttaaacgtcgttttggcagcgatgttgctgtgttgcatagtggcctgtccaatggcgaaaaatatgatgaatggcgtcgaattgaaaatcaggaggcccatgttgtcgtaggcgctcgttcagcaatctttgccccggttactaatttaggcctgatcattctggacgaagaacatgaaacaagttataaacaagatgaaaccccgcggtatcatgctcgagatgtcgctaaatggcgtgcaaagtatcatcacgcgccactggtcttgggaagtgcaacacccagcctggaatcacgggcacgggccgaaaaaaaggtttatcaccaactcatgctcacgcaacgggtcaatcatcatccaatgcctgaggttaatgttgttgatatgcgacaggaattaagaaagcacgcggagagtaacttttcgacagaactcctggaggccttggcgcaacgcattacgcgtggcgaacagagtattctaatgctcaatcgacgggggtattcgtcatttatcatgtgccgggattgtgggttcgtcttgcagtgccccaattgcgatatttcattaacgctccatatggacacccacacaatgaagtgccattattgtggtcatgaagaggcaattcccgatatctgcccgaattgccatagccaccaaattcggtattatggtactggcacacagaaagtcgaagctgagttggcagaaaaattaccgaatgctcgaattttgcgaatggatgttgatacaacccgccgtaagggaatgcatgaaaaaattttacgtcaatttggtgatcataaggccgatatcttactcggaacacaaatgattgcaaaaggattagattatcctaacgtaacattagttggtgtactcaatgctgatacggggttgggattgccggactttcgagcgagtgaacatacttttcaattattgacacaagtcagtggccgcgcgggccgcgcagataaacctgggcaagttattattcaaacttacaatcccgaccactatgccattcagcttgcacgaaaacacgattttgaacggtttttccaagtggaaatgcaaattcggcatcgcggtaagtacccaccgtacttttatacggttcaaattactgtcagtcatgaagacgaagctgttgctgcgaagaccatcttcgacttggcaaatttcttaaacaatgggcttggttcgacatgtattatgttgggacccacccctagatcgattgcacgtatgaatcgacgttactattaccagatggtgatcaagtatcaacatagtgatcgtttgcacgcactattaatgcaggttatgcaaaccagtcaaaagcttaaacaacggggattacaaatttcagttgatcccgaaccacaatactttatttaggagaatttaaacatgacatcagttgtatttatgggaacgccacaattttcagttccaattttagaaagcttaatcgctgatccagcttatcaagttttagcagtggtgacgcagccagatcggaaggtgggacgaaagcatgttttgacagcaccacccgttaaaaaagcggcgatgaaccatgacattgaaattttacaacccgaaaaaataaatcacagtgaagaaatgcaacgtgtcattgagttgcaaccagatttaattgtaacggctgcatttggacaatttttaccaactaagctgctggccgcggccaaaattgctgcggttaatgtccatgcttcattacttcccaaatatcgcggcggtgcacccgtacactacgccattataaatggtgacacacaaactggggtttccattatttatatggttaagaaaatggatgctggtgatattttgtcacagcgcgccatccccattacaactgatgatgatacaggaacaatgtttgataagcttagtgttcttggccgtgatctgttattggaaacattgcctaatctggttgctggcaacattcaagctactccccaagacgaaactaaggttaccttttcacctaatatttcgtctgaagaagagtcacttgattttcatcaaactgcacaacaaattgactgtaagattcgtggactacgaccgtttccaattgccaatgttgttttagatggcattcgaacaaaaattattgcggccacaccgttaacggaaacgacggacatggcaccaggaatggttgtccgcgctggtaaacatgagttggtgttggcggctgggaaaaataccacaatttcacttcagcaactcaaacctgccggtaaaccacaaatgacaattaccgactatcttaatggtcatcaaaatctaacacaaggtgtacaggcgattacttatgaataatcaaaatgaagaagtcaaacaaagtgtccggtacctcgcattaacgacacttgataaaattatccaatctaatgcttactcaaacattcaattaaatcaggctttacaacagactaccttgtcggcagccgacaaacgactattaactaatattgtttatggtgttattcaacaccgattaactttggaatactggctcaatccatttattaagggaaaaaagctagattcttgggtcaaaacactactaattatgtcactttaccagtaccgttatctagatcgggttccgaactgggcagtgaccgatgaggctatcaaaattgccaaggtgatcggccatgctggaatccgtaaactggtcacagcagtgttacatactgcactcagaaataacgaaattgattttgcaaagattgaagacccaatcaagcgaatgagcatcgaatatagtgtgccacaatggctaatcgatgaactgaatcgccagtatgggctcgaagccactcgagcagtattaacttcaattaataacgcaccacatcagtcaatccgaattaatcgaaagttgacaaccgttgcacaggtcaaagaattactgactgatcagcaatttgatgtccagcaaagtccagtactaccagatagcttaatcgttagtggcccgatatcggtcgcggataccgacttgttccagcaaggattgattactattcaggatgaaagtgccacactggccgttgatagtatggcgctggcaccttctagtcaagttttagatgcttgtgcagcacctggcggtaaaacggtccaaattgcacagaatttggatgctcatgcatctggcaaagtaacggctttggatattcaccctcataaaatcaaattaatcaaccaagtagcccggcgactgtcagtttccgacgttgttgaagccgtaaaactggatgcacgaaaagtagacgaaaaatatgcggatgaagcatttgactgtattttggttgatgcaccatgcagcggctttggcttgattagacgcaagccagaaattcggtatgacaagtctttagcagatagtttgaatctgcaaaaaattcaactcagtattttaaatgcagttgcaccaaaggtcaaaaaaggcggtataatcacctatagtacttgtaccatcttgcaacaggaaaatgatcaggtggttactcaatttattcaaagtcacccagatttttcaattattccaacggaaaccactaaccagttgccgtcgcatagtcaacaagcgacattaacaattttacctagtgatttcaattcagacggcttcttcgttgcaactataaaaaagagcgacaaataaatgaggaatttttgatgaaaattgcatttaaaacagatattggcagggcccgcgaggaaaaccaagactatgtcggtgtttttaaaaatatagatcgccttacttttgccatcgttgcggatggtatcgggggccatcaaggcggagacgtagcctcatcgatggcagtttctcatattggccgtcatttcgaggaaacctcttttgagacgcccttagcggctgtaaaatggctttctagtgaagtacgtgatgaaaacgcccaaattatcgccaaggcgcaacaatttaaaaatctgcaggggatgggaactacattagttgctgcaatcctatttgaagatcagatgattgtggccaatattggggacagtcgcggctatctcaatcgggatggaaatcttagtcaattaacggaggatcattcattagtcaatgaattggtcaaacgcggtgaaattactgaggaacaagctcgaacgcatccccaaaaaaatattattactcgaactttggggatttctaacgatgcggacattgatgtgaacctgtatgaaattcataaaaatgaccgtttgttactgtgcactgacggtctatctaatatggtggaaaatcagcgtcttttagaagtactagaatcatcacttacaacagatcaaaaatgtgagcaattaattcacgatgctaaccaagctgggggtccggataatattaccgtactcatcgcggaaaattaccaggagggcagtgacatatgaatcctggatatacactaaataaccgttataaaattattcggtcccttggtgagggtggtatggccaatgtatatttggcacacgacctgattttggatcgtgacgtatcagttaaattactgcgattagacttgcgtgacgatccccatactaagcgacgatttcagcgcgaggcaatggcggcaacgcaattaaatgaccctcatattgttggtgtgtatgatgttggtgaagaccatggtcttcaatacttggtgatggaatacgttaagggaaccgatctgaaagaatacatcggcctacattttcccattccgttcaagcaagtcattgaaattatggaacaaattttgtcggcagttgaagaagcccatcaacacggaattattcatcgcgatttgaagccacaaaatgtgttgattgacgaacatcagaatgtgaaaattaccgactttggtattgcagttgctgtatcacaaaattcgttgacgcagacgaataccttaatggggtccgtacactatctttctcccgaacaggctcgtggaagcattgctacgccacagtcagatgtctattcattaggaattattctatatgaacttttgactggtaaagtaccttttgaaggcgaaacggccgtttcaattgcactcaagcacttccgggatgaaattccatcagttcgcaaatttgatccacaaattccgcaagcactagaaaatgttgttttaagggcaacggccaagcttccagcggatcgctaccagagcgcccaggaaatggcgggtgatttggccacttcgctttctaacagtcgtgttggcgaatcccgttttattcccagctctgatgatcaaggggagacgaaggtgattgacccaagcgaaatcaatgcggcggtcaatgacgaaagtaaaacaactcaaaatactcagcaacctgttaaaaagcatcggaagtggccatggattgtcggtatcattctgttgctggcgattggtatcacaacatggctgctaattccaaagcgtgttgtagtgccagaattagctggattaacacaaacacaagccaaaagtaagcttcaagaacatcatttaaaattaggaagtgttcaccgcaagaccagtgaaacggtgcacacaggacgagtaatcagttctaatccggattctcaacgaaaaataaaagaagattcaaaggttggtttgacaattagtactggtcatcgaaaagtcaccattggcaactatacgggtgatgattatgcatccgttgccgcaaaacttcgaagtgagggaatgacagtcaagcgagttgccatttattccgatgatgtcgattccggtgccatcattaaacaaagtatccatgctaagaaaaaagtaaatgctgctagcacgacaattacatttcatgtaagcgccggaaaaaagaaagttacaattccggattttactaacaaaacaacggctgaggtgcaaaaatacgccgatgataatcagcttcaacttacaaccaacgaggctgaatcggattcagtagacgaaggacatgtcattagtcaatctccagttgctggaactaaggtcagtcatgatgattcgatcaccattacggtggcaaaaaagcaggaaacaagcaccactgtccaagtgaacgttccgtttgatagttccgataatcagactcaaaatcgtgttcaaatttatattcaagatgctaatcataatttaactcaggaatatcaagacatcatgattagccaggatacaacgatcaacattccgtttactttaaatggggatgataagggcgcctacaaggttattcgtgatggcaaaacaattatgagtgcaactaatattcaacaataaaacaataaggagaaacgtgtgaagaaggggattatacaacagtcgcttagtggcttttacgatattttggatgatacagaacacactatttatcggacacgtgcccgtggcaattttcgtgcaaaaaaaattaaaccaatggtgggagatcacgttgattttcaaagcgataaccaacgtgaaggctatcttcttaaagtccataaacgcgaaaaccagcttgttaggccaccgattgccaatgtcgatattgcagttgtcgtgacggcggtcaaagaaccagaattttcaagcaatttactggatcgacagttggtcgccttggaagcgcaaaatgtcaccccaattatttatttttccaaaacagatttgttggatccttcagcagcatcaacgtttaacgaaacaattgttaccggataccgtacaattgggtaccatgtgatttttcatcagccagcatttaacgagcaagttaagacggagctgctatcatttttaaccggtaaaatcagcgtcgtgatgggacaaactggggctggaaaatcaacattgcttaatcaactatcaccagaactgcaactggcaaccggagaaatttcgcaagctcttcaacgcgggaagcatacaacgcgcaaggttagtctgttaaatattaatgggtcgcttattgcagatacaccgggattttcatcgtacgaagcgtttgaaatgacgataaacgagctacctcaatattttcccgaaatgctgcaattaagcgcagaatgccgcttcaggggttgcttacacatcaaagaaccaagttgtgccgtgaaaaaagccgtcactgatggtagaattatgaacagtaggtatgaaaactatctgatgtttcatgacctgatagctaatcaaaaaccaaaatacaataaagagaaatgaggaattataatgattaaagttgcaccttctattctaagtgccgattacgtcaatctacagcgtgacattgaaaaagtggaaaagggtggcgccgactatttacacattgatgtgatggatggtacctttgtcccaagcatttcgtacggtccaggattcgtaaaagcaattcgtaaggtttcaaatttattccttgatgttcatttaatggttcaaaacccagagcatttaattcaagacttcattgacgccggttctgatttgattggtgttcaagtagaagcaacatctcatatccatcgtgcacttcaattaatcaaaaatggtggtgtaaaggcagaagttgttatcaatcctggaacgccagtgtcattgatcgaacctgttcttggaatggttgatcaagtgctagtaatgactgttaaccccggctttgggggacaaaagttcttgccagaaacagtcgctaaaattgctcagttggaccaaattaaaaaggaccgtgggtatgactacgacatcgaaatcgatggtggcgtgaataatcagaccgttgttgactgctataaagctggtgccacagttgcagttgccggatcttatgtttttaacgacgctgatccagtggccaagatgaatactttaaaagatgtaaccaaatagataaaatatgtattaaaataagagtgcggcatattagccgacactcttattttttaggagacaccaatgacgattcaaaaacgaaaagtaaaaaaactgaatgtactggtagggggaccaacgcaacagtggcctgacaccctaaagagcggtcaaattgaaggcccttggattggcgttgaccgtggagcaatccgtctgttgcaattaggaattaaaccggaaattgcagttggagattttgactcaactgcacaagaagaactcgcacgcgttaaggaacagattacccatatcgagacattcccgcctgaaaaagacctaacggatacgcaaattggtgtcattaccgcaattcgatattttaagtttgagcaactcgcgatatatggcgctacaggagggcgaatggaccatttactcgctaatatatttttaccccttgagccacgtttcaggccctatgtcactaaaattaaactcattgaccgccaaaatacaattacttactatcaacccggaatgcacgaaataaaaaaagaacctaataaaaaataccttgcgtttgtgacactgacaaaagtggacggtctaacgttattcgatgaaaaatatcctttaaatgattatagtagtggccatccaacatcatgggctagtaacgaatttaatggtgatctaaatcattttaagtttgacagtggcattgttgctgttattcagagtcgagactaaaataaaaaggcctgcatcaattaagatgtaggcctttttatttaattaaactcgagtcactttacctgatttcaaagtgcgtgctgaaacgtaaacctttttaggcttaccatctacgagaattgttactttttgcagatttggcttccagctgcgacgacttgagttaagggcatgagaacgcttgttaccaaagcgtgtccgtttaccgctgataaaatctttagccatgaataacccctcctcttctcatcaatttttttactattgatcgcaattgcgcgataactcacctaaataatttaccatagctacgatctcattgcaatagatttctgtcaagttctttaactttacagctataaatattgttagatcagtcattaaataggaaccagtcataaaaatatcatatcttcagtgctttttcaatgaagaacagaacataaaagcaaaaagtgagttcagatcaaattactggcactttaatgaaaaagatgttatattaactgcacgataggttaaaggttttacctattcgtactcctcccaaaacctaaactatgaaacatagtcttccccaaaaccctatgtttctccaacatgaacaagcacacttccccagtgtgatatcttgtagtcgacacctcaccccagaggtgtcgtttttagtataattacgttgtttggtcaaggggagacttaatttgctttttatcggttatgtggtatggtagaatatcgttatgagtaaaacttactttttgataaaaaagggggccatttaatatggcagttaagattaaaacccagtacggaacaatcgatatcgcaaacgatgtgatttcgactgtcgttggtggtgccgcaactgataactatggtgttgttggtatggccagccgtaatcaaattcgagacaacgttaacgatattttgagaagagagaactacagcaagggtgttgttgttcgtcaacaagacaatggaattgcagttgaagtgaacattattgttggctacggcactaaaatttctgctgtttcaaaaagcgtccaagaaaaagttaagtataatttagaatcaatgcttggcgtaactgctaattcggtcaacgttctcgttcagggtgttcgtgtactagctgaataaattagcatgatctcgtcaggaggataaataattgacagtcacaaaaattacaaaccttgaatttggcaagatggtgcaagccgcttcaaatcgactccagcaaaacgccgaattcattaattcattaaatgtgttcccagttccggacggggataccggtactaatatgagcatgtcgcttgctagcggggctaaatatgaacgcgaagcaaccagtgacgatgttgctgatctcgctgctgccttagctaagggactcctaatgggcgcccgcggaaattctggtgttattttgtcacaaattttccgcggattttccaagggaattgaaggcaaagcaacgttaactggtaaagattttgctgcaggatatgccagtggggcccagacggcttataaggccgtaatgaagccaaccgaaggtaccatcctaactgttgttcgcgaatccgctaaggcgggaattgaaaaggccgatgaaacggatgatatcgttgaaattttggcaaccatttacgaagcagcacaaaaagcacttaaaaagacaccagatttacttcccgttctgaaagaagtgggtgttgttgattcaggtggacaagggcttacttttgttattcaggctttttatgaatcacttagtggcaaggttattgatgatgaagaccacacacctgataatgcagagatggatgaaatgatcaatgccgaacatcatcgtagtgctcagggacagcttgatccggatgatatcgtatatggttattgtactgaaatcatggtccgaattggccgggggaaacaagttaccaaaaagttcgattatgatgaattttacaactatcttgcagatttaggagatagcttattagttgtcaacgatgacgaaattgtcaaagtgcatgtccacactgaacatcctggtaaggtattgtcttggggacaacagttcggtgatttacaaaaagtaaaagttgataacatgcgatggcaacaagaaaccatcatggaaaaggatgaacaacccgcaacagctagctctgagagcagtgtaccaagcaccccagttgaaacagccgtgattgccgtttcatcaggagagggcattgctaagctattcaagagcttgggtgtaacccatgttatcagtggtggtcaaacaatgaatccaagtactcaggatattgttgatgcaatcaacgccagtggtgccaagaaggctattgtattacctaataacggtaatattttcatggctgcggaccaagcagcagatgtcgttgaaattccaactaaaattgtgcacagcaagaccattgcgcagggaatgacggccatgcttgactttaaccccgatagttcactcgaagaaaatcagactgctatggaagaaaatcttgcaacggttaaaagcggtgaagtaaccaatgctatcagagataccactatcgatggtattgacatcaaaaaagacgatttcatgggcattgtgaatggtaaaattacggtcacagatccagatgttcagatggcggccatcaagatggttaaagctatgttggatgacgatagtgaaattgtaacgatcatttttggttccgatggtgacgagaaaacagctcaagctattgaagctgctattgaagaaattgacgatgaacttgaaattgaaatccattctggtggtcagccagtttacccatatttaatttcagttgaataatgatctaccttgatcgggggaaaactgtgttttcactcgatcatttttgtattagttaacaagtaaaggagggatttggtgcttagtcttcaggatcctgtttctgctgtgccaggagttggtccaaaaacggccgaaaatttagcaacgttgaatatcctgtccgttgaagatctgctcacgtactatcctcttcgttatgataactttgaagttcaatctgtccaaaatgctaaggaccaagaaaaaatcacgattaaagggaccgtgatgtcggagccggtgattgcacgatttgggtataaaaaaaatcgattaagtttccggcttatggttaatcgtgaagttattttggtgactttttttaatcagccttatttaaaaagcaagattgaacttggccgcgatttggctgtatttggtaagtgggatgggcagcatcttcgtatgactggcagtaagttattcacggttgatactgctgaatcgcattcatacagtgctgtttatccaactaataaaaatgtgaaaaaggccacgatcaaaaaaattattactgcggcgtttaaacaatatgaaaacgtgattccgacgcttattccagagtcgttgcgccaacaatatcatctaatgtcccgcaaagagatgattcgtgagatgcattttccaaccagtgatgaacagtctaagcttgccaaacgaagtgcaacctatgaagaattttttttgttccaattgcggctgcaagcaactaaacgagcaaatcaaaaacgtaatggactcgtcattaaataccataacgatgagattaagtcatttatagggcaattgccctatgagttaacaaaggcgcagaagcgagttgtgaatgaaatttgtcgtgatcttcttgaaccggttcaaatgaatcggctattgcaaggtgatgtagggtctggtaaaaccattgttgcggcaattgccatttatgccgcaattactgctggataccaagcagcattgatggttcccaccgaaattttagctgaacagcatgcgcaaaacttagcacatctttttgaaggcttgccagtgaacgttgggctgctaacgggttccttgaccgcgaagcagcatcgaatacttgaagatcaaattcaaacgggtgccattaatttaattatcggaacccatgcacttattcaagatagtgttgagtatgccaaccttgggcttattattactgacgaacagcatcgatttggtgttaaccagcgtcaaaagctacgtgaaaagggggaccggccagatgttttggcgatgactgcaactcccattccgcgaacattagcaattaccgcttatggtgagatggatgtttcgatcattgatgaattaccagctggacgacttccaattcaaactcgctggttaaggtctaaccaaaatggggttgcgttggaattcgttgcacaggaattaaaaaagggtgcgcaagtatatattgtcactccactaattgaagagtcagaagctttggatgtgcaaaatgccacagcactttatgaacaattagcggcttattttgaaccacaatttaaagttggcttattacatggccgtttgtcaaatgatgataaagatgcggtcatggagcagtttaaggctaatgaattacaggtattagtttccacaaccgtcattgaagtgggggtggatgttgccaatgcaacggtcatgatgatttatgatgcagaccgttttggtcttgcccaattacaccaacttcgtggccgtgttggtcgaggaaagcaacagagctactgtattttgcttgctgatcctaaaaatgaagttggagtggcacgaatgcaaacaatggtggacacgactgacgggttcgtcgttgcccaaaaagacatggaactacgaggatctggtgatattttgggacaaaagcaatctggtgtcccagaatttaaaattggcgatccggtaggagatttgaaaatactagaaattgcacaacatgatgctgcagaactgcttaaaatgccccattgggatgatgtcacagacaatattccactagttgcatatttaaaacggcatcagttgcaaactcattttgattaaaaagagaggttgatgaaatgatgaaaattgctgtagacgccatgggtggcgatcacgcaccacaagagattattaagggtgtcgaggctgctcgtgatcaatacccagatattgaattcttgctttttggcgacgagcaacaagttaccgctgagattaagaaccacgaacgactacaattaattccgacaacagaaatgattgagatgggagaagaaccggttcgagcaattcgtaagaaaaaagattcttcaatcgtgcgtgcagccacagcggttaaagaacatcaagctgatgccttcttttccgcgggtaatactggggcagtcttggccgccgggttactaattgtgggccgtattaaaggaattgatcgcccaggtttaacttctgttctgcccgtacctaatccagagttagcacaatctaattttgtatatctagataccggggcaaatgctgaaagtaaaaccaaaaatttatttgaatatgcatatttaggtaaattttacgcacaacaggttttgggtgttaaagaaccacggatcggtcttttgaataacggtgaagaagaagacaagggagatcggctccataaagaagtttggcaacaactaaatgacgcaactgatttaaactttatcggtaacattgaatctggcgctttgctgtccggcaaagccgacgtcattgttacagacggttggacaggtaatgcagcactgaaggctactgaaggaactgcgaaaacggtccttaaattaatcaaacatggtattttgcatggtggattacgtgcgaaacttggctatttacttttgaagccagtattcaaccaaattgccaatgttatgggaacttcgacatacggtggcgctgttttgctaggtttgaaggccccagtggtcaaaacccatggtgcctccaaagccgatgcggttgcaaatacaattagccagattaagaccatgattgatacaaatgtgattcaacaaaccgttgattactttgatcaccaagaattagtggacaatcctactgaaaacgactaaactggttcagtgagaaaaaacgaggagcaactaaattatggataaacaagcaatttttgataaagtaagcgaaatcgtcgctgaccattttgatattgatcgtgctaaaattacgactgatttaaatttaaaaaccgatttaaatgcggattcaattgattttgttgaatttgtgcttgaagtagaagatacttttggttcagagatttctgatgaagaagctgaaaaacttagtacgattggtgaagtagttgactacattgccaataaccaagccaaataaactaaatactgaactaaaagggccgtagcaaattgcatacggtccttttccgtgtaaacaagtggttgttactcttttccaatcttgttaaaacacgtataataggcactataacagaagaaggaagtagcaatgataaaagaattagaaaacgaattagcagataaatttgatatccattttactaaccatgctttattggacgaagcattcacgcaagcctcttatgtgaatgagcaccccaaccgcggtttaaaattttatgaacgaatcgaatttttgggagatgcagttttacaattaacagtttcggaatacatctacaagcgctatccacagatgccacagggggaactcacccggttacgtgcggcaatggttcaagaggatagcttcagcaagtttgcggtcgaatgtcattttgatcaatatattcgtcttggtcatggtgaagaaatggctggtgctagacaacggtcctctttactgtgcgatatttttgaatcatttattggtgccttatatttagaccagggaaaagatgctgtcgtttctttcatcagtaaagttatttttccgaaattagaccaaggctggtttgataatgaagttgattataaaactagccttcaagaattcctccaacgcaatggtgatgttgatatcgactatactgtcatcaaagaagagggcccagctaatgcccgccggtacacagtcggggtaagtgctgatgatcaacaaatcggtacgggaactgggacttcaaagaagcacgccgaaatggatgctgcaaaaaatgcacttcaagatctacggcaaaatcaacaataaagtgagagaccaagatgcgattgatttcattagagttaaatggatttaagtcatttgctcaaaaaaccaaaattgaatttatgccgggcatgacaggaattgtaggcccaaacgggagtggtaaaagtaacatcattgaagcaatccgttgggtgatgggcgagcagtcagcaaaagacctccggggcaacaaaatggcagatgtcatttttgctggatcggatacacgtaaaccacttaatcgggcggaagtagccattacctttgataatcaagatcactatcttaatagtgactatagtgaaattaagatcactcgaaaactgtatcgaacaggagaaagtcaatatttaattaatggtcaagaatgtcgtctcaaagatgttcttgacttatttatggactctgggctggggcgtgagtcattctcaattatttcacaagggcgagtagaggccatctttaatggaaagcctacagatcgtcgggccgtcattgaagaggttgcaggggttgcaaaatacaagaaaaataaaactaccgctgaaaagcgattagctgatactaccgataaccttcaccgagtcggtgatatcatcagtgaactggaaactcagcttgaacccctagcgcaagaaagtgcacttgctaaagaatttcaagaacagaaaaaacagtttgatcaacttgatcgcactaaaactgtgcttgatattgaagcatatcaagctcaaaccaaaacaattgaacaagaacagcatcgtttggaccaaatgacgcatgactatgataaaaaagttaaagcagcagagtcgacactggttaaattaaagcagagtcaaacgcagctcacacagcgaaaagatttgcttcagaatcaattacttgagcaaactaagaaaattgcggacctgaacaatctattaagccttagttctgaacgctcaagtcaacaaaagattaacttgggtcaattaaaacaacaacgtacgcagcttgaacagaataaagaagaggcctcgcaagagctcaccaaaattcaagctacatattcgacacagcaagctgaaattaatgccatgcaagaacaggttgcaaaagccgaacagataaccgctgaacaacaggcacagctattaacggatcaaattgaagcactccaaaatcaacaaatcgatcaaatgcaggcgctgacgactgttcataatcaaagaacctttctaactcgaaaccatgaacaagatagtaaacgacaagttcaatctcagacagaactgaagaccattcaggcacagtttgatgaactaaaaatagccttgacacagcaacaacagcagcgaaacacattgaatgctgagctcgctgacaagcgaaaacaactgaatacggaacttaatcagcggcaaagtttaaaaaatgactacgatgctacacaaaaaaagtggtatcaggcattaggtaatgtccagtcactggaagcaagacagacgagtctcaaatcactggaaacggagtattcgggattttatcaaggcgtacgtactgttcttcagcaacggcaacagtttaacgggcttatgggaccggtggcagaattgattaacgtccctgcacaatatacgaccgccattgaaaccgtccttggtgcacagctccaaaatttagtcgttgataaccaaacaacgggacaagccattattagctacctgactcgtaaccgtggtggacgggcaactatcttaccaattgattcattggcgcatcatacacctaatcaaattattttggatcgaattagtaacatggatgggtttttagggttggctagtgaactagtcaccattcaacctgagcagcaaattattgttgaccatctccttagtaatacaattgtcgcggataatttatcacatgcaacccgtatttcgaagcagacgcagcaccgttttagaattgtcacaactgatgggcaacttattaacgctagtggcgcaatgactggtggtgctaaccgccaacaaaggcaagggttacttagccgtcagaacgaagttgagcaactggaaactaaactagttgctgctagaagcaacgtgagtgatttagaagcaaccattcaaaagctcgatcaggcaacacaagctaataatcaggttattgcgcaattacaaacaagtgtgactgacctaacaaatcagtttcaaactgctgatggcaagctgaaagtattaaccgatcgacaaaagctaaatgaacggcagttaaaagcactatccttcgaggtagggcaacaagacggttcaacgtcctcatatgaggatcagttacgcactaacgagaacaaggcccaagaaattgagcaaaccattgaaacgttgaagcagaaaataatagcaacgaaacaacagcttaacgcgacacaattagacgactctaaacgtcaagaatcacttcagcaaaagaagcagtggcttgcagttgcacaagaaaagattcgacaaacaaaccagcaaaaaaagcaattgcaaattaacatacacacgattgatgctcaattggatgagttgaattccaaagccaacatggcgagtgaatcgcaggaaaaaagagagcaggaaaaggctcgtgcaactcagtcgttacaacaattaaaaaatgcgcagactgaatcacaaactaatctagaacttgtcactcaaaagctagatactcaaactattcaatttgaaactgctagtcatgatttagatcgtctgcgtgaactccagcgagcaaccctaaacgatctcgatgaagttcatgccaaaaatgcgaaattatcagcccaattagatcacggatttaaccgtttgtccgaaaactatgctatgacattcgaagaagctaaacaaaacctaagctcaatggcgccacaacaaattaatactcagctaaaattgttgaagcgtggattagatgaaattggaccggtaaatcttggctcaattgaagaatatgatcgcgttaataaacgctactcattcttgcatgatcaacaaacggatcttttatccgcaaaacagcagttaaatgatacaatgcaagaaatggatcaagaggttgaaacgcgattttatgaaagctatcagcaggttgcaacatcattctcacatatttttgctcaaatgtttgggggcggccaagctcagttagttttaacagacccagataacttattaacaactggcattgacatcattgctcagccacctggcaagaagaaccaacagatgagcttactttctggcggggaaaaggcactgactgcgatcacgctcttatttgccattttggaagttcgcccagtaccatttgcgattttggatgaaacagaagcagcacttgatgaagctaacgtaaaccgatttgcgcgctatttaagtacttatggggataatggcccacaatttattgttgtcactcatcgtaagggaactatgatgaatgctaatgttttgtatggggtaacaatgcaagaatctggtgtttcaaaaatggtttcagtatctcttgaagatgttccgatttaaggaggaaataatgggattatttgatatttttaaacgtaaacaaaagaaaagtgacacgacagaaccagaaagtaccgcggttgttagtgaatcaccgtctgcaacaccagtcaccgaagtagaactaagtagtaacactgcacaagcgacggcaagtgcgatgcctcaatcacaatcagcaacttcagcgacctcaacacctgcttcagaagtaaccacggtggcttctgaacccgtgaatttggagagaccagtaagttctgttcaggatactgttgaatcagatcaaagtgacgatgagccagttgaaaagcaaccctcacaatcagcagcaagcattgtcgaaccaacctcagtagaaacgaatgctaaccaagaaaatgagagccacaatgaggctagtgaagataccggtaccgataataagtatgagcagggactggcgaaaacgcgaactggatttggtgcacgtctcaatgccttgctagccaacttccgtcatgtagatgaggacttttttgaaaatctagaagaggcattaattgagtccgatgtaggctttgaaatggctgagacactaagtgaccaacttcgtgaagaagtcaaattacagaatgcgaaaaataaacaagccgtgactaacgtcatcattgaaaaaatggtcgatttatacgaacaacagggcaaagatgaacataacgaaattaactttgcatcaactggaccaactgtcattctatttgttggcgtgaatggtgtgggtaagacaaccacaattggtaagatggccgcaatgtatcagcagcaagggaaaaaagtacttctagcggccgctgatacgttccgtgcgggtgccattcaacaattacaggtctggggcaagcgcgatcatgttcccgttgtaactgggccggaaaaaggggatccagcagcagttgtatttgatgctgtggaacgtgccaaacaagaaaactacgatattttgttcgttgatacggctggtagactacaaaataaagtgaatttaatgaatgaattagccaaaatgaaacgcattattagtcgtgagattcctgatgcccctcatgaagtattgctggttcttgatgctacaacgggccagaacgcactcagtcaggcaaagttgttcaaggaaagcaccgatgtaactggaatcgtcctgacaaagttggatgggactgctcgcggcggaattgtgctagcaattcgtaatgaactccatttacctgttaaatacgttggcctgggagaaaaagtctcagatctacaaaaatttgatgcgagcgaattcgtctacggactatttaaaggtttagttgaaccaactgattaggatggtgacacaatggagatcgaaaaaaattaccggattaactcgttatttgaattttatcaaccactactaacacaaaaacaaaataactacattcagctttactacggggatgacttttccctgggcgaaattgccgaagaattttctgtgagtcgtcaagcagtgtatgataatataaaacggacggaatcgattctggaagattatgagagtaaactccatttacaccaagactttttagctcgtaatcgccaggcagatgagattcaaagctatgtcgcaacgcattatccgcaggatgaacatcttaataatctggttgcacatctcgaaaatctagaagaagaatgatggggagtaagttatggcgtttgaaggattaacacaaagattacaagatacaatggcaaagctacggcgcaagccaaaagtaacggaagctgatttaaaggaaacgatgcgagacattcgtctagcgttgttggaagccgacgttaacttcaaagtggttaaggactttgtcaaacaagtacgtactcgggctgcaggtgctgatgttctcaaaggattaaaccccgcccagcaaattgttaaaattgttaacgaagaactaaccaagatgatgggggaagaagcagttgccctcaacaaatctgataaaattccaactattatcatgatggctggtctccaaggggctggtaaaacgacaacggctggtaaattagccctaaaactcaaaaacgagcaaaatgcccgaccaatgtttatcgcagccgatatttatcgtcctgctgcgattgatcaattggaacaggttgcccagtcaattgaagtcccggtttttcaacttggaaccgacgttgatcccgttgaaattgtccggcaaggattgcaacaggcacgcgatcaacataatgactatgtaatcattgatactgctggtcgtttgcaaattgatgaaaagttaatggacgaactagttcaaatcaagactctcgcatccccagatgaaattttgctggttgttgatgcaatgacaggtcaaaatgcggttgaaaccgctgaaggatttaacgaaaaactggatatcactggtgtcgttttaactaaattagatggtgatactcgtggtggggcggcactttcgatccgtgccgttaccggtaaaccaattaaatttgtcggacagggtgaaaagatggatgacctggacgtcttccatccagatcgaatggcgtcccgtatcttgggcatgggtgatatgctcacattgatcgaaaaggctcaaaaagatttcgatgaagagcaggcccaaaaaaccgttgaaaagatgcgtgaaaattcatttgattttaacgacttcttggatcaaatggcacagatgcaaaaaatgggatcaatggaagatatcatgaaaatgattccaggaatggctaataaccctgccttgaagaatgctaatattgatcctaaagatatggaacatttaaaagccatcgtgtattcaatgacaccagcagaacgtgaaaatcctgatttattgaacccaagtcgtcgccgtcgtttagcagctggttctggtcgtccgattgtagaggtcaaccggatgattaagcagtttaatcagatgaaaaaaatgatgaaacaagtttcaaatggaaatatgtctggccttgagaatatgatgggtgggtctatgccgggtggccgtttaggtaaactggcaatgaaccgaatgtctcgccaaatgaaaaagaacaaaaagaaacgagcaaagaaaaacaaaaaacgtcgttaatatgtatgaaaaggttactttcaaattgaaagtagctttttttgttacctaatttaagtttatctaacaaaaaatgaaaatttaaaagataatcagaccatattagcatgaaagaataaaaacgtttgttaattattaggaaaaggaatacaataatggtgtattgtgaaactatattcaaagattgacttttttgtaaaaggaggaatttgaaatggggataaaaattggtgtattgaaagaacaatctccacatgagcatcgtgtttcaatcgatccagaggttgttaaaagattaactaagtccggtaaaaaagtttttattgaaaatagtgccggcagtgacgccaatttttttgatgtggactatacagccgtgggagctgaaatagttgaccgaaaaacggctttaacgacgactgatattgtagtcatgattgatatgccagatgacgaaacactggccgccttgaaagatggacaagtcgtgatcgggttatttaattcgttaactattccggctaaaattgagatgttagcaaagaaaaatgtaagcgttatctcaatggaacttctacctcggacaatcagtcgggcacaaaccatggacgtgttaagttcacagtccagtgttgccggttataaagcggctttgattgcaagtgatctttatccaaagtattttccaatgatgatcacggctgctggaaccgttaaaccagctaaagtattggtactcggaaccggtgttgccggattacaagccattggtactgctaagcgattaggggcgattgtctctgggtacgatgtacgtcctgcatcacgtggtgaagttgagtcactcggtgcaaccttcttaactagttcagtcgcaaacggtgctggaaacggtggctatgcccgtcaattaacagctgaagaacaagcggctcagcaaaaagagttggccgattttatagcacaaaatgatattgtcatcacaacggctcaggttccaggacataagccgccattattagtcacggatgatagcgtcacaaatgccaagccaggcacgatctttgttgatttggctgctagtgagctagggggaaatgtggcccggagccagccgttcaaaacgatcacaactgaacaacatgtcaccattgtgggtgctggaaacttagctagccaagtttcaaattcagcttcgcagttatttgctaaaaatattctcgctgtgttgaactatattattgatgaggacacggtccaatttgatttaaccgatgatgtattaaaagacttggttgctacacataagggagatattgtaaacccacggcttcgaaaagccctcgatttaccggatcttccggatcctcatacagaaacggaggagagctaatatgagtcaagaattatataccaatattgccatctttgttctcagtattcttgtcggatttgaggtaattagtaaaatccctgcgacactgcatacaccaatgatgtctggcgcaaatgctattcatggggttgtcgtggttgggactattctaattgcgctggaggcacactcaatattattttacgtgattgccttcattgcggtcttcttagcctctgtcaatgtggccggtggatacgttgtcactgacagaatgcttacaatgttttcaaaacccaaaaaatcagatgatcaatcacaagacgggggtgaaaagtaatgtcactattaatgacaattgtttcactgatgtatttaatcagtgccgcctgttacgtcattggattgcatatgatgcggacgccgaagaccgcccgtaatggtaatcgagtttcagctgtcggaatgattattgctgttatcatgacttttttgattgcactacatcaaaatgaggcaacaatgaccggtagtctcattttggtagttggattagtccttggattaggatacggtactattcgcgcccggacggtggaaatgacggatatgccgcaactggttagtttgttcaatgctgttggtggtggtgccgcagcagcaatcgggacctttgattacctaagtatggcggctggttctcatttacactttgcattttcatttcctgtcgcacttgatcttgttattggtggaattactttctccggttcattgattgctactggtaaattagccggtaaaatttctggtaaacccattacttttcctggcgctaaacttctcaatgccattgtcgtcattgttatcctagtttccgtagtactaactattggattcgctgctaattcttggtggctaattctcacgctatgtgccagcttagtttttgggattttaatgacaattccaattggtggggcagatatgccagttgttgtctccttgctaaacgcttttaccggcttagccgtatcaatggccggctttgtcatcgacaatcaagccttaattattgcaggggcgttagttggtgctgcggggacaatcttgaccttacaaatggcagcagccatgaatcggtcagtcatgaatatcattgccggtggattcggtactggcgatagtaatagtgctgcagctgatgatattcccgtaaatgttaaggaaactaccgctgatgatgttggtgttcaacttgcctatgcaaataatgtcatgatcgtccctggttacggacttgccgcggcacaagcacaacacgaagtggccgaactagcaaaactgttgaccgatcacgatatcaatgttaattatgctattcatccagttgctgggcggatgccaggacatatgaatgtgttattggcggaagttaacgttccgtatgaccaaatgaaacagttagaggaagccaattcaatgtttgaaaatacggatgtatcactcgtaattggggccaatgatgtgaccaatcctgcagcacgacgcaaagggaccgccatcacaggaatgccaattctagatgtcgataaatctaaatccgtggttgtaattaaacgttctatgagtactggatatgcaggtatccagaatgaattgttctcagatgacaagacccacatgctattctcagatgcaaaaaaaggaattcaagaaattattgcatccaccaaagaatacttggatgaataaggacattcatacctaccaaatcgacgaaatatgaagttatttcaaataaatttaaactgttaaggaaatttactttacattcgttttaaacactggtatattattacgtgttaataaaagtttgggaggtgtctattcaatgtcagttaaaattcgtttaaagcgtatgggttcaaagaagcgtcctttctaccgtatcgtagttgctgattcacgttcaccacgtgatggtcgtttcatcgaaacagtgggtacttacaatccattgatcgaacctgcagaagttaagcttgaagaagaaacgatcatgcaatggcttaacaatggtgcacaaccatcagatactgttcgtaacattttatctaaagccggcgttatgaagaagtttcacgacgaaaagcttgcaaaaaagtagtggtgtttaatcatgactagtactgaaatagatactttaattagattgatcgtccaaccgattgtggctcatccagaagccgttcagatagatatggaaagaacattgaagtatgaacaatacactttagatgttcacgccgaagatgttggtcgtgtgattggccgtcatggtcatgttgcagctgatattcggacaattgtctatagtacgattaacgataaatctagaaaagtacggttagtgattaatgatcatcgtaaccacgaaactcccacacaataaccgtgcgggagtttttttctttagttaaaaataaggagacaacgtgaaatattataatgtaggaaaaattgttaatactcatggtattcgcggcgaagttaaggtggtctcaacaacggattttccggaggaacgctttcagcctaaacaacaactctatattcaagcacagcaaccgattccagttaccatcacggccgtaagagaacataagggaacctatctgctcaagttcaaagagttcgacaatatcaaccaagttgaaccttataaagggcaagagcttatggtcagcgaagatgatcagcaatcacttgaagatggtcaatactattatcatcaaatcattgggttagatgttgaaacccttaccgatggaaaaattggtacgattaaagaaattttagcgcctggtgctaacgacgtatgggttgttaaacggccacaccaaaatgatctgttattgcctgtgattgatgatgttgttaaaacagttgatcttgaacaccacaaagttttagtagaattaatggaggggcttgactagtatgcgaattgatattctaagtctttttcctgaaatgtttaaaggaccactcacagaatcgattctcggtaaggcaactgaaaaagggctgttagatgtccatgttactgactttcgggaatataccaccgacaaacaacgccatgttgatgatgctccgtacggtggcggcgccggaatgctattacaagcacaaccgatcttcgatgcctatgatgcaatccaaaaagaagttggtccagatacctctaaggggcgtgtcatcttgctggatccggctggtcaaaagtttgaccagcatttagctaatgaattggcccatgaagatcatctaacatttatttgtggtcactacgagggatacgatgagcgaattcgacaaattgttactgatgaagtatcgctcggagattttgtgctcactggcggggagcttgcatcaatggtcatgatcgatgcaacagtccggtttattccaggagttctaggtaatcatgattccgccacaggggattcatttgaagatggtcttcttgaatacccacagtacactcgaccagccgattttcggggcatgaaggtcccagaagtactattaagtggtaatcaccaacgaattgctcagtggcgtcaaaaagagtccttacgacgaacactccatcgcaggccagatttgttggaaagtgcacacttaacagggcaacaacgccatcttctttctgacataaaaatcgaagaagatgaaagtgaacctgaataactctttacaattggtagggtattatgctaagatattacctggctattaagccatagtaacgatattccgctgttggttatccgacaagaatgtcggcgaaaggaaagaaaactatgcgtcaaaatactttaatcgaaaagatcactgctgatcaattacgtagcgatatccctgatttccgtgccggagatactgttcgagtttatgctcgaattgtagaaggttctcgcgaacgtatccaattattcgaaggtgtcgttattaagcgtcacggcttcggtatcagcgaaacatatactgttcgtaagatcagtaacggtgttggtgtggaacgtactttcccacttcactcaccacgtgttgaccggattgaagttgctcgccatggtcgcgttcgtcgcgctaaattgtactacttacgtgcattacatggtaaggcagctcgtatcccagaacgccgtatcaataagtaatttaaaaaagaggctcatgataaattatcatgggtcttttttgtttggatttatttaaccctatttttgtagaatcgcgtttggcaattactacttttttaagtataataggcgtaatagataaagatgggggtaaaaataatgccattagttcacattgatttactagaaggacgttctgaagaacaattaaaagcattggttaaagatgttactgctgcaatttcaaaagatgctaacgttccagcagagcgtattcacattgttctaaacgaaatgaaaccaagtcactacagtgttggtggaacactgaaaagtgaccaataataatatttctattctaaatggtactgggagataatcttgtaagacaagcggatgaaccacaatgggcgtcttatcgttgtggccgctttttttactgtttttaggggaggattgcgtgtgagtacacaaattaatgctgatcaaattaatcatgaaggccatctacttattggtggcgttgatacaactagcctagcaaagcagtatggcacacctttgatcgcatatgataccaacaatattcgtcaacagattagaaattttaaaaagatctttgatgaagagcaagttgattaccaaattagttatgccagtaaggcctttgcgacgattgcaatgtatcaactaattaaccaagaaaatattcattgtgatgttgtttccggtggcgaaatatacactgctgctcaggcaggcttcccaatgggaaaagtttcatttcatggtaacaataaaagttacgaggaattagaactagcactcgatcagaacattggttgcattattctcgataattttcatgaaattgagttactatctcagttaaccgacgaacgcggtcaagatattgatgtgatgttccgtgtaacaccgggcatttcagcacatacgcatgagtacgttatgacaggacaagaagattctaaatttggttttgacatcaatagtggtcaggcagatgatgccattcaacaagtacttgcaacgcggcacctcaatccaattggcattcattgccatattggctctcaaatttttgcaactgatggcttcatcatggccgcacaaaagatgatggcactattgcatcattggcaagtaaaatttgattttctggcccccgtcgtaaatttgggcggtggatttggcatccaatatactgacgatgaaaagccgcttcaaccagaaagctttattaaagctatcctccatgaaatgaagcgtattgctgccgaaactcaaatgaagttacctgaaatttggatagaacctggacgatcaatagttggaaacgctggcgtttcgctctataccgttggctctcgcaaagtcattccgggtgtgagaacctatgtcgctgttgatggcggtatgggcgataatattcgaccggccctatatcaggcaaaatatgaaactgtagttgctaataaactgactcaacccgtaacagaaacagtttccattgcgggtaaatattgtgaatctggcgatatgcttgcttgggatcagaaattaccaaaaactgaagcaggtgacttgttggcaatcttggatactggtgcatatggctattcaatggctagtaactataaccgtaatccacggcctgccgtcgttttttgcgaaaatggcacttcaaaattaattgttaaacgtgaaagcttgcaagatttaattcgacaagatttaccattagaataaaatattaccgatcactatctgagaggatgacataatttgagcgatcaacaatacatcatggcgattgaccaaggaacgacaagttctcgcgcaatcatttttgatcatcaaggaaaagaagtcgctaaagcacagcatgaatttacacagtattttccggaaccagggtgggtggaacacgatgcccttgaaatttgggatggtgtccaaaaggtaatttcggatgtcatgattcaatctaaaattaggccctacaaaattgctgctattgggattactaaccaacgggaaactaccattatctgggaccgacatacgggcaaaccaatctatcacgcaatcgtctggcagtctaagcaaaccagcgaaattgccgatgatctaatcgatcatggttacagtaaaatgattcatgataaaaccggattggtgattgattcttatttttctgctaccaaaattaaatggattcttgatcatgtagaaggtgcccgccaaaaagcggaaaacggcgaccttatgtttggaacgattgactgctggctactttggaacttaactaatggaaaggtacatgccacagatgttaccaacgccagtcggacaatgttgtacaatattcatcagttggattgggatcaagatatccttgatctgcttgatattccgcgttccatgttaccagaggttcgttcttcatctgaattatatggctataccagtgagtaccatttttatggcgtccaaattccaattgccggaattgctggagatcaacaagcagcattgtttggtcaaactgcctttgagaagggcatggtaaagaacacatatggtacaggcgcctttattgtcatgaacacaggggttgaacctacactatcagataacggcctgctaacaactattgcatatggaattaacggccaaattaactatgcactcgaaggaagcattttcgttgcgggatcagcagttcaatggctacgtgatggcttacagatgattgaacatgcgtcggaatcggaaaaactagcagttgctgccgaatcgacaaaaggcgtttatgttgttccatcatttacaggtttaggtgcaccttattgggatcaagaggtccgtggtgcgatgttcggactcactcgtgggacaacaaagaatcaaatcattcgtgccacactggaatcaattgcatttcagacgcgagatgttgtcgatactatggtcgctgataccgggttaccacttagagcacttaccgttaatggtggtgcctctcggaacaattttctcatgcaatttcaagcagatattttgcatactccaattcaacgggcagaaattgaagaaacaaccgccttgggcgccgctttcctagccggtttagcagttgacttctggcacgatcaagatgagcttaaacatcttagtgcactaggcgccgaatttcagcctaaaatgtcagaaacaaaatgtgccactatctatgacggttggcaacgggcaattaaggccacacaagcattcagccatcaagattaaattgacgataaaaaaggactgatcctatcggatcagtcctataattattttcaaacggcaaactgtgacggcacatcaattttaaagtaatcttgtaaatagtgggccaagccattatgatcattatcatcttgagtaacatcattggcaatttgtttgattgattcaattgcattactcattgctacaccgcggccagcgtaggaaatcatttcagaatcgttatcttcatcaccgaaagcaataatattttgttgcgcaatcccataggctttagcaatatgctcaattccggcgtctttatgaacccccttagaaacaacttctaagatactgtgtgggccgccccagacacgaatatcaacgttagccccatagtttttattaattcgaccaataagtgcctgtttgtcatttggttcgtattgcagggtaagcgctgttgggtttgatgttaaattcaaactattaagcacttcattggttgccaaatgcgtggggaaaaagtctttcatcacgcgactaggctggtttgcccaaagatgcattttattttctgctgtcatggtatgaattcccaaatcttgtcgatgggttagaagatccagtgcaatttgccgatcaatgttttgctgatactcaaattgccactgttgatggggaatgtgtgctaatgcaccattaaaattgaccatcgggcttttcaacccaatttgatcataaaattggcctgagattcgatacggtcggccagtaacaatactgacaatatgaccatctgcagctagttttcgaagcgttaaaattgtttctgatgaaagttgagattggtcattcaatgtagtaccatctaaatcgatagcaattaagtgttgattcatattatttttcacttctttcgttcaatgattacaagtattcacgttatcataattcatcaaaaaacactagtaaaatcaactaattaaagacgtttaaaacgatatattgtaatatacaatgattaatattgtatattacaatatgcctaacaaaaggagttttattttgaacttaccgcaagatttcattaacaaatatcaagagctattaggacccgaagcaactgctttttttgattcgtttaatcagtccagtcccggcggataccgaattaattcaaacaaagccagttctttggttgatcaatcatatgtgactaatgaacaagtgccatactgtcgtgacggacattatggacacttaaatggtaaatccatcgatcacacaacgggctacctgtacagtcaagaaccatccgcaatgtatgtgggggaggtcgcagatccacaacagggagaaaaagtgttagatctgtgcgccgctccgggcggaaaaagcactcatttagttgcaaaaatgcaaaactcggggctgcttgtcagcaacgaaattttcaaagcccgtgccaaaattttagcggaaaacttagaacgttggggggcacaaaataccgtcattaccaatgaaagccctgaaaaactagaaacccaatttcctgctttctttgatcgtattttagttgatgccccctgttcgggggaagggatgtttcgtaaggatcctgctgccacccaatattggcataaggactactccaacgagtgtgccaatcggcaacaacacattcttgactcagcggttaaaatgatgcatgccggaagtaccttgatctattccacatgcacctttgctcctgaagaagatgaacagattattgattggtttatcagaaaatatcctcagttcacacttgtaccaataaaaaaatattctggcatggatgacggtcgaccagaatggggcaacgataatcccgaactcactaagactgtccgactttttcctcatcatatgaagggtgagggacattttgttgctaagcttgtctggcaggcagcatcagactcaaaaatagttcctacagtaaaacatccgtttcgctcagtaaaattaagtaaggagcaacaaaccgaattaactgaatttcttcatagttgtttggtaaattaccaaattcgtaacttagctttatttggtgatcagttgtttgacatgccgaatggaatgccgataatcgataaaatgtcgatcgttcgaccgggcgttcatctgggaacttttaaaaaacgtcgatttgaaccagcacttggattagcacttgccattgacgatgatcaagtccttaacaaactggctatcactgaagaacaatggcgtcaatacgtccatggtgatacgattaccgtgaataacgactatccaaaaggatggtatttgctaacttgtcaaaatcatgctgtttgcttcggtaaactggttaacaaaaccgtaaaaaatttctatcccaagggactacgattctaaaagaaacacgagaaacgactaaaaatcgtttctagtgtttctttgttcaaaatatgattgtaattcatttgataaaacgtgaggtacctttgttaactcattgaactgacgacaaccacagagtagcaagactctttctatttcaacacgccaattattaatggtttgaattaaagcatcgtcgccttcacggattagtttattcaagaaataaccagcgactccaactgcctgtgcacccaaattaccgcatttaatcacatcaagtggggtaacaataccaccactcgcaatgacgtgggcttctttttgaaacctttgactttctaataacgactctggcgtcgtctggccccagtcagccagatcatcgaaatcattttcatgatttcgtcggttttcaattcgagcaaaatttgtcccaccacgaccactaacattgatatttttaacaccggtgttaattagttgttgcattgtttcctgactcatgccaaatccaacttccttaacaatcaccggaacatcagtccgttgaacaatttcattaatattatccaaccacctaaatgatcgttcaccttcaggcatgaccagttcttgtgcgacgtttagatgtagttccaccgcattggcatcgatcatctgaacaacagttttaacctgttctggtgatgccgcagcgctgatattagcaatcaaaacaccatttgggttttcctgtcgcaatactcgaaaactatcgattccgtccggatgcttcaaagcgacactctgagaaccacatgccattgccaaatcacagtcggccgcgattcgcgcaagttgctgattaagcttcaaacttaactcgctaccaccggtcatcgcctcaatgtagaaaggggccgacaattgaatggtttcagtcaacgcacttgtcaatgtcacgtcttgaatcgataattctggtaaactttgatgaattatccgcacaccgtcaaatgggtggttctggtgcgatataccgtataatttttcggcgagcgaaatatgttcattttttctctgtgcatgttgtgattccataattaatcctctaggttatgaaagttgcgtgatgccttctttgataacatgtactgttaaggaaagctgttcgatgtgattaaccttccactctgccaacatattagctaaatccgtccgacggtcaattaaaacaattccgcagtcgccaccaccggcaccagaagtcttagcagcaccaccaaatttttcggctacttcacacattttagttaacaccggagtttcaatttgaacacctgaaaagtcgcttaattgatgcagcaactgacggttatagcggacttcattttgaatctttaacaaattttgttcacggaagccttccaccattcgttgaatacagtttcgactctctgaaacaaacgtttgatactcagtttgatcacgaacttttaccattgaaaccttgtcaactaacttggaagttgaagccggcgagccagtccaaccgatcacaagttttagatcagcaggggcaactagctgttcaatttgaagatcaggccactctagatcgatcaattctggtagcggaagaacgtgacgtcgttcagccaaccattggcgatcaaaagagtggtacgcaatccagccaccgtagacggaagcggcaatatctccgagggacccgtttccttgaacatcaaaatgggcaatcgcagccaatttaaaaatctggttttgagtaactggtaaatggtaaaacccacagagggctttaaccgtcgccaccgtgacagcagctgaagaacctaatccatactttttaccatcttcactatctaaatcactatcaattcgtaaatgataaacacttaattgttggtttagtgatcgcgcatattcttctgtgattttaatggccgaaagaatgtagtggaagggattatcgcggttgtcaaaaaccatttcatcgcccattctacgccaatggagtgaattttcagtatactgacgagaaacgatacttccaaaatccgtactttcttcaacagtacaagtaacaaattggtttagtgccacgattaccgcgggaaggccactttccacgacggcgtattcgccagcaatatataattttccaggtgcttgagcagtaatcaacagaacatgtcctttcatcaacctaatttaatattaatccagatattggattcccggtcctggtttagcaaccacgagttggtcttctcgaaattcaatttgaagcgcctttaaaatttttgggcgatcatttttgtgataaatcactttcacgtttggacccgcatccaaggtataatagcagtttataccctggttacgcaagtcatgaataagcgccattgcccgcaacgtgtccgcgttgaaatacgtgaaactgggatcagccgctaaattaagtgcgtgcattcgcattgcatttagttcggcaatttgaccaattcgtgtaacatcttgcgcccgaatagcttgcttcatggccaccatgtcgtgttgaacgacatcaatccaagccgggtagtagggtgaagtttttacaacactttgcattccagaacgactggaaatctttttgatgttggtatctagcataatggccgtcatttccaagccaaagtccacccgttcttgaatcggctcagcaaatgatgtcgcatcatctgttccgtgatgccattctactagaccgccaaataaagaccgcgttgcagaaccggaaccacgacgagcaattctagataattcggtgcgattcaggttcatcccggctgctttagttgctgccgccgccaacgcagcgaacgccgatgctgatgaagctaatcctgcagaaattggaacatggttagttgatgttacttttgcaaatgccgtaacaccactaatttctcggatgtactgcataaactttgttaatttgataaagtttttttcattgaccggttgaccatcaattacaaactcatcgtgttgtagttgaggatcatattgaacggccgttgtcgtgtaaaattcatctagcgtaagcgataaactatccgtgtaggggataattagctccgcgtctttcttgccccaatacttcactaatgcaatattagtatgggccttcgcttttgcatacataattacgcttcaagtcctcccgatagtggttgaatccaggtagcactagccccagcactaaccattttagtagccaattttttggctgccgtttcgttgtccatcaatgcaattaaacatcccccacgaccgccaccagttaacttggcacctaatgcgccgttaagcattgctaggtcaatgagtgcgtctaatgaaggatgactaacagacagagcactaagctgttgctgagcagctgtcaagcattttccaagtttagtgatatcgccgtgcttcagacacgatttagtttcccgtactagtttacccaattgctcgattcgctgcatcgtgattaattggttagcttcaagctggtacttaacggtattaatggcttcctttgtccgaccttcgacaccagtatccacaattaaaagtgtcgcatcaatattcatctgcaaggggactgtttgactatttttaacgtaccaaattggtgaatcagaactcacggtcgcagcatcaagaccactgggactgcgatgcgtaatttgttcctcaatatctgcaaacgccaaaagctgttctcgactcactgcacgaccgtaatagtcaaaaaaggccttagttattgcaacagcggttgctgccgaagaccccataccacgttcggccggtagcatactcgtgatttgcattaaccaagcatcatcatatccgttgaaataagcagttaacttctgaattagcgtggcgattccggccattgtttcaggtaactgattaactgggccatcaaaataacggctatcaattcgttgtccaccagattgagtttccaaaatcgtcacattgcacataacacgggagaggggcagtgcaattgctggttgtccatacacaacactgtgctcaccgatgagaattattttggcgtggctagtaccactccctttttgcaccatcgaatctaaccctcccaaatgtctagaataaaaaaccagagttcattatacattaaattattcattatagtgacaaactaagctgaaacttatacagagtttaataatcccaatcgtttactaattaaattttaatggtttctccgacgagaaaaatggtaaagctctttcacaaatagtatgataggaattgatttaataataactaacaatggtgactaagatgcataatcaaaaaatatattcagtcgttgacttagaaacgactggtaccaattataaaaacggggatcgcatcattcaaatcggatgcgtcctgttttgtgacggcaaaattgtcaatcgtttcgaatcgctgataaacccccaagcaaacgtaccactagcaattgaacagctaactgggattagcaatcatgatgtgaaaagggcacccttattcgatgacgttgcagcaacggtttttagtctgttaagtgacactacgtttgtggcacataacgtcaattttgattttccttttttaaacgccgaattagaacgtgctggatttccagctctagaaatttccgcaattgataccgtaacactcagtcaaattttgttacccacagagcctagctttcggttgcgtgatttaaccaaatatctcgcaatcgatcatgattctccccatagtgcagactcggacgctgaagccactagtcagttactcaacaagctactcattcgactccaagacctcccgacggtgacactacagcaattggttaatcttcggttagacttaccctacgaaactgcgcaaatgtttcaaaatgagttggccagccgcacagaaaaacgacaactgcccaatagcctttatcagaaagaaaatctcattcttcaccggccgcaccgccgtgaactaattaataaccggcaatcgctcaagtatcctaagaccaaatcagcaaaagagaagctttatcagcagtcaaataccgatgggttggactaccggcaatcccaagcccgaatgatgaatgctattttcaataattatactcatgaaaatcctaaaaatatgattattgaagctgggacggggactggaaagtcacttggctatcttttacccatgacctatttaacttatccggaacataaagtggttattagtactgcaactaatgttttgcaggaacaactgaagcgctcggttgctgataccttgaatccaattttgccatttacggtcagttgtgtggttttgaaggggaacagtcactatatcgacttggctaagtttgatcactccttaagtatgattgaagatgctaagccagttcaaatgacgaaagccaagttattggtctggttattagaaacacaaagtggtgacttggatgagcttaatctgaatagttatcgtttaccatacttcaccgaaattcgccatcagggaatcaacagtttgaatcgccaaagtcgattctacgaagatgattttctagtgcgacgccagactgaactagaacaagcgaatattgtaattgttaaccatgcttaccttgcacagcatgctacagaattggggcagtccttaaactcgccatacttagtggttgatgaagcacagcacttaagcgatagcatcttaaagaaatcacgacatcaaattagctttccaacaattaacgctgctattcacattttacaggggctggttaatgctggacacgatcgtaatttaagggaaatttttaacgatttgccacttggactatataacatcgatctcttacgtagcgacttggtgagtcttgaaacagccttcaaacagtttgagcaggcactatatcgacaatttatgctcaacgttgattcacaacaggcacagtccattattgaacagaccatcgataatcacgaactagcagctatgttacaaccatccaataaaattttgttagatcttgaacaggcgctgggcagtttacacctgcatttcaacgccatttaccatctttttagtcacaataaaaagcattggttagcaagcgaccgttacctcgtgacacagttccaaagccaactcatgattattactaaggccgatgaaaccttacatcactttagcgatgtcctgattcatcaaattgccgaatccgttttctggctcactgttcaccagtcatctgaaaaaagtaacttacaactgagtggggggttactcacaacccgtaatttcttggcaagccaagtttatccagcatttcagaagcccacttttgtcggtgcgacacttttctcatcaggccgatcacgctacctatatgatcaattagatgtagatccagatgaaactcgaatcaagaaattcgcatcgccatttgattttaaaaatcaggctaaaatgatgattgcggcagatgcaccactcattacagctaatagctaccaccaatatatcgaatatctcagtaaaactatctaccgagttacaaaagacaatcctcggcaaacgttaatcctgtttaattcactgctaactatcgaacaggtatacagtcagctgcatagtaccgaccttttcttgcaacgagaaattttggctcagggaattaccggcaacaaagaaaaagtgctgaaacaatttctaactggtaatcagtcaatattgctcggagcatcaagtttttgggaaggcattgacctgcccaaaagtcagctggagctattaattatcacgcgactaccattcgactttccagacgcagttttagcaaaggccgagagtaactggctgaaacaaaatcataagaatcccttttatggggcagcccttccaaaggctaccttgcgaattcgtcaggggatggggcgcctaattcgaacgccagcagattacggagttgcgattgtattagataaacggttaagtgaacgtaaatatgggcactcaattatgaatactttgccagccgaattaccgatcgatacaattccaactgatgaaattattaaagaaaccaaagctttctttaaaaagcatgaataatatgctgaggtggtaaaatgtctgttataatagcattcgattaaataaaaaggggtaacaaatttatgcagagccgacgaaatagtcaacggcgtcgccatccaattcggttgacattggtgattattattctaattttcctgtgtggctggaccatctacgcagtgggaaatcatcctaaaaatgaatcacggcaacaagccattgcaatggctaaaaagtacgcgaatttaaagaagacagatgatttttatatctacaatcgtgaaaaaacgtactataccgttgctggtaccaataaaaagaaccaatcgattctagttgtcatcgccaaaaagggtggcaagattcgggtactcaagcaaaaagacggaattaccaagaacgaggcattaactaagatttggaataaacgcaatccaaaacgagttctcaaaattgcaccgggtatttttaataaccatgcagtttgggaagttacttacctcaataagcacggaaacctgtgttatgaactcttgaactttaagaacggtaaagacgttcaaagaattgataatttataagatgtaattggaggagttttcgttggaaacaattagcattattgatgcaccaaattttgtaaaccaaaaagtcaaaattggtgtttggttaactgataaacgttcaagtggcaaaattgcatttctacagctacgggatggtactgccttttttcaaggagttgtgctaaaaaacgcggttgatgaatcaacgtttgatgttgctaagcacttacgccaggaatctagtttctggattactggtgagatacatgaagatactcggtcaaaatttggctatgaaattcaagtggcgtctatcgaggtgatcggtgaaagtgaagaatatccgattacacctaaggaccatggtattgactttttgctagaccatcgtcatctttggttgagatctagtcgtccgcacgcaatcttaacaatccgtaatgaggtgattcgtgctacgtatgaattcttcaatcgggaggggttcactaaaattgacgcacccatcttaacaggtaacgcccctgagggaaccactgacttattccacacggaatattttgatcatgacgcttatctttcacaaagtggccagctctatgaagaagcaggtgcaatggcgttcgataaagtcttttcattcggtcccacatttcgcgctgaaaaatcgaagacacgtcgtcatttgattgaattttggatgattgaacctgaaatggcctttatgcaccaggaagatagtttggcagttcaagaacagtacgtggctttcttagttcaaaacgtgattgaccactgtgcctcatcacttgcaacccttgatcgtgatccagaattgctccgtaagtatacgaaaacaccatacccacgaatcagttatgatcaagcaattgacatgctacaaaaagcggggatggatgttaaatggggggatgattttgggtcacccgaagaaacgtacctcgcagatcaattcgaacaaccagtattcattttaaactatcctaaagccattaagcctttctatatgaagccacatccaacccgagaagatatcgtgatctgtgccgatttactggcccctgaaggctatggagaaatcatcggcggttcagaacgcgcaaccgattataactatctccttgagcaaatcaaactagcaggtctcgatcctaaggattatgaatggtatcttgatttacgtcgttacggttctgtaccacactcaggatttggtttaggactcgaacgcttcttaacttgggtaacaggagaagaccacgttcgcgagacaattccatttccacggttattaaatcgtatttatccataaagaaattgacggggaggtagtttactatcagcgaaagtatcgatcaatttgtcgacgcctttgagtcatcagggcaaaccattattagtaatcttgttttacgaaattatcgtcaaattggtatgaccacagctcagctaatggtctacttacaattaaaatcatatcttgatcaaggaattgccagccccaatatttctcaggttgcaactaacttgggaaccgatgagaaacaggttttcgaattacttcatcaaatgattcaacgccagtttcttgttcacgagactaaaaccgataactacggtaaacaaagtgattactacaatttttcacttctcacaaagaaaattatccaatttgtatcgaatcaaacagctgcgcaaattgcaacggaagatacgagtgaacgagaacaaacctttgataaaatcgaggtagaatttggacggccactatcaccaattgagttagaaacagttgccagatggtttgatgacgaccattacgcaccaaaaatgatcgtattggcgctgcaagaagccgttttaaatcaagcatggaatcttaaatatatggatcgtattttacgaagttgggaaaaacagcatgttacgactccccaacaggttgatcaaatacgccaaactcatattgagcaacaaacagcccaaggaaaaacgacacataagcatcctgctggcccagatattccactttttaaaatatcagatgaataaaagaatcggcaatccgtttggattgtcgattcttttattaaaaacaggcatgattcgtgctcgtaacttggacatagtgtatgctgaatgtatcaatgaattaggggagtgatgatgtatggagaagtatgactacgatgttattatcattggtgcggggccagggggtcttgccgccgcatatcaactttctgcaactcataaggtacttgtcgttgaaaagcatctttggggaggaacctgtcccaactatggttgcgatcctaaaaaaatgctatatggtatcgtagaaactcagagacaagcacaaaaatacaagcataatgggcttgaagatactgctcatttaaaagtcaattggcatgatatgatgcagtttaaacgtttctataccaatcagattcctggaggaaccgaaaatggtttaactaatgctgacattgaccacattgccggaacttgtcattttttaaatgcgcatcagattcaagtcaatgaacgtcaaatttccgcgcaatattttattattgcaaccggcgccgaagcttcaattcctgacattgaaggtagtaattggttaaaaacaagcaccgactttttagatgaagattctttaccagcaaaaattgctttcatcggtgggggatacgttgcgattgaactagctaatatcgccgtcagtgctggcgctgaagtccatattttccagcataatagtcgtgtgctcagaaattttccagaggaatatactcaaaagctagtatcactacttactgagaaaggaattattttccactttaatgatactattaccggtgtcaaaaaaggagctcatacatttcaagttacctcccagcatcaacaatcattatcagtagacgcaatatatgccgccacggggcgtcacgcgagtgttggatcactaaacttagaaaatacaaccgctgcgtacacctcaaaagggatcagtgtcaatgatcatcttcaaactgatgcaccaaatatttttgccgtgggcgatgtcatcgataaaaagatccctaaattaacgcctgtcgccagttttgaagggcggtacgtcgcacaacaaattaaaaaaatcagtgcttcaattcagtatccagtcgtcccacataccgtcttttccggcccagaattatcgcaagttggtgttagtcttgaaactgcagaacaacatccagagttgttcaaaattaattccgcatctgtcggcaaatggtatacgtacaaccgtcttttagatactgacgctcaagtaactgttattttaaatcagcaagatcagacagtagcgggggccgttgtacttgcatccaatgctgaagagctcatcaactattttactttaatgattaaaaacaaaactacggttaatgatttaaaaaatttcataccggtttatcctagcgtggcaagtgatttgacctactacatgtaaaataaaattaaaaagctcaaatttcatttttaagtgaaatttgagctttttctacgtcacattattgtccaggtgttgcagctgcactgctatctggttgagttgacgttggtgtagatgtcgtggctgatgatgttgtatcagtagttgttgcatccgtactctgagtagcatccgtattactatcatctccgtcgccatttggctgttgttcaacggatgacgaattattagaactactacttgaattttcagaatcttgtttagattcgctcattgatgaagatgatgaaacaataacttcactgctactgtctgcgtctgaagagccattattgttctcagcatacttatcactggtccccgtgtcactccacgaagcacctttaacctctaactcacgctgaccatttctagaaacaactgaaacagtatctggaacagaccagtcagaactaggattttggttttcaagatagctcatttcacttcggtaaactttctgagccgtcttctcataggtgcttgtgactgcatgtccagcgaccaaagccttatcataaccggtccaaatggagatcgaataatgtttcgtatacccagcaaaccaagaatccatcacaccggatgagacgccgctgccacttgggtactgtgtcgtcccagttttaccagcttgatgaaccccagagatcttagcagccgttccagtcccgctagaactgttaataacacctttaagcatgtcagtaatcatgtaggcggtagaactcttcataacccgtttcccggtagaactgtacttgtaagaatcgccgctcttagtcgtaatagagctaatgtagtagggcttatagtacgttccaccattcgcaaatgtcgcatatgctgcggcttcttgcagtggtgaaatatataacccgatcccattttgcagttcaaatccagaactcgaggttggcttaatgccaagtttagccaagaatttggttgccttgctcataccaacatcttgtagtgttctaatggctggaatgtttcgtgactgtaccaatgcctgacgtattgtcattgttcctttaaattgacggtcaaaatcgtacagcttcttagaagttcctggataagtaaatgaaatatcttttaccggcctgaaagtggggtagtttagatattcaattgccgggccgtaatccatcaatggtttagatgttgagccggcacttcgatccgtttggacagcccgattaagaccaaacgttacattgccagtcttacgaccaccaagcattgcaatgattttaccgttgcttggattagtaattgcggcaccaatttgcatgtctttactctggaaagcaaccgttccatcattggctgtgtcatagagatgctgttgtgcgtccatattcaagttagtatggacttccaatccatcagtataaggattgtagccttttttcttcaattgcgaaacaacctgtttcaaataagaatcaatgactttgttattactatcatccgctgatgacgcacttgaagtatttccgtgtgatgaatctaatccggtctgaacgttaacttttttggctgccgtagcctgtgattgagaaatatatttgcttcggaccattgcatctagaacttcattccgacgctgcgtagcggccgtcgcgttgctaattggattatagtaggttggtgactgaggcacgccggccaacgttgcatattgagaaagtgataactgactcaagtttttaccatagtagtactgtgcggctgtctgcatgccgtatacgccattccccatataaaccttgttaatgtaaaattccaaaattttggccttggagtagtggcgttctacgttaatcgcgagccatgcttcttgcgctttacgcttgattgtctgatccgatgcggcagttgagaaaactgatagtttgaccaactgttgtgttaaggtactgccaccttgaagaccactagatgagtgggtgagatctgaaaaagcagcgcccacaatccgaacaggatcgacaccatgatgcttataaaaacgacggtcttcaattgaaacaaccgcattttttaattctttcggaatcgatgctgatttaacatactcacgcttttgagcacccaattcagaaacaacattattatcagaatcatagattctagttgcaacttgactggatagctcactttcagaaattttaggtgctgtggaagcatagtagaagaagagtaccgctcccattagaactaaaataccaattaaactaagtccccatagtatgattcttttaacaatacttccggtattatgagaacctgacttgccattcttttcagactgcatgcgagtctgtcgtgatggacgtttgttatctgacatatcgtactcctttatactccaagatcttcaatcaatcgatcaaccgcatctatatatggaatcagtggattaaattgataggtaatttgatatccgtcttgttcgatatttttgagtggaattgacttacgaccgccactatcttgctcatcccaataagcaaataatttggaggcgggaagtaagaaaagctgatttgtatgtgaaaacttgagaaatgcaaaacagacaccaccctgttgaacacatgctcgtagatgctcaatctgatgttcatgaaagttttttaacgggaaagaaaccttattatttgtctcttttgcgtcaaaatccagataataaccacggtaaacaccattgtaatccgtcgttgacggtcgtctaaaataggcttccttaattacagcagcactccgctttggataatcaaccttaactaattgtacaggtgtaggttttttatggatcaccgcaatgttatgagcaagatagtaggcgttgctttcgtttatctcttgttccagcgtcataccccgtttgccataaaccgaccgtgttacatttgaagtttgctttgacgaaccccgctgattgggcctagtatattgttgtccatttggataatgaattgtcatttttgcaatcctcccagctatacagtattataccaaacatacaggtaaataaagtttaaattttttgtagggaaggttaataaatgagtcgactatggattacaggctatcgaagctatgagttaaatgtatttcaagaaaaagatcctaaagttgaagtcattaaacgagcagttaaacaagcattacgtaatcaaattgaacagggtgttgactggcttatcacggggccacaactgggaattgagcaatggtcagcacgctggggaatcgatttaaaaagcgactacccagaaattaaagtcgccattatggcgccatttgctgaattcggtagtcaatggaatgatgataacaaggccaaattatctcagttacaaactgatgcagattttgccgatcaggttagtgatacaaaataccgatcaccagctcaacttcgaaattatcaagagttcatgttaatgcatactgatgcggcattatttgtatatgattctgagtatcccggcaaatcggaattcgaattaaaagcagcccagcaatttgctgagacacatccgtatcctgttaacatcattgattttgatcaactacaggaagcggcaaacgaatatgaagaggaacaagaagagataaaaatggaaagaaatcatgaagattcataattttatttgcatttattcatttttttggtaaactaaattaggtagttaagaaatcacgactgaggtgctgaaattggataacattaactttactccaaaagatattctccaaaaagaatttaaagaaaaacggatgggatcagcttatgatccaacagacgttgatagtttcttagatgatgtcattaaggattacgacgcatttaacaaggagattacacggcttcaaggtgaaaatgaacgacttaaggctaaaaatgatgagctaagtcgtcaagttgaagtcggtgcttctattggaacacgttctactagtgaacaaccagtttcgagtgcaaccaatatggatattctaaaacgtctttctaacttggaacgtcgcgtttttggatcacaacttggcaacgatcagtctgattcacacttgctttaattaaataataaatttgtaaattttgggtgattgcggctggtttgtatcagctgaggaaagtccatgctcgcacagactgcgatgtctgtagtgttcgtgctcggtgaaaaaataagccgggggaccagtaatggttacggcgggaaaaacggctaaggcttcggctatgctcgagtattcctgaaaagtgccacagtgacgaagcaatgttggaaacagcattgatggaacgcggtaaacccctcgagcgggaaacccaaacttatggtaggggagcttcacataggtaattgaactgattgtggggggagactttatgtctcgagatagatgattgccactgcacaattgagcctgaagattgtgcttcgacaaaacatggcttacagaaatttacaaacaggcgagtccagatatttttatctggactttttattttacttaaaaataaaactagcatactagttccttagaaagaactaatgagaaagagatatcaccctcagttcaattgacaaaatagttaataaggttataatgtaaacggattcatgatactgatatagcagttttaaacactatcgataataggttaaaaggagtgctaacaatgcaagttattgaaaatacacagttcagggccgaaattaacgaaaagggggctgaattaactcatctgattaataaagccggaaattttgactatatttggaataatgatttatggccaaaacatgcaccagtacttttccctgccatcgggcgatctgaaaaagactcatacttactcaatggtcaggaataccaaatgccacagcacggttttgccggtgaccaactttttgatgttactgcaaacagtggtcaatctctgacactttcattaacagacaatacggcaacaaaaaaactgtttccatttaagtttcgcttagatgttaccttcacggttacggaaactggtatcaaattaaactttgatgttaataatcttgatgatcaaactttagccttctccattggctctcatcccgcatttaatgtgccgattgacggtgacgccacattcgatgactaccaacttgaatttaaacctaagaacttagatttaaaacagtttgaaatcattaaaacgccggcaccataccgtgatggtaagatcatcccacttacagctgctgataaaagtacaattcaactcaaccatgacatgtttgaggccggattagttatcattgagaatgacggtatcaattcagttaagcttagctcacaaaaatcagatcatagcattgaattaagcctcaacgattttcgctatgtttgtctatggaccaaggaaggtgcgaatgcgccatttctttgcattgaaccattccaaggactgcctgacatttctgggcaagaaagtgaactactcgaaaaagaagcgaatgttacactcgatgctggtaagcaagcaagctacggctacgaaatgacattaaactaataatttattatcgcaattcaaaaaacttcacttcatacggtgaagtttttttgtttctgcacttattaaacaggagatttgctataattagacttgtaaatgaattttatgaagaggtaaaggatgaaacaatacaaattaatggcaactgctgctgccggaatcgaagcactagtcggccgcgaattacgtgacttaggatatgatactaacgtcgaaaacggccgtgtccgttttgaaggagacattaaggatattatccgaactaatttgtggctaagaactgctgatcgcgtcaagattattgttgctgaatttgatgcggtcacttttgatagcttatttgaacaaacaaaagctgttgcttgggatgacttgttacccatcgacgcacaatttcctgttgaaggacgttcacacaattctcagttacacagcgtgccaaatgtgcaagccattgtaaaaaaagctattgttgccaaaatgagtgacgtataccaccggagaactcggttgccagagactggtgcactgtatccactagaagtaatgattaataaagatcacgttatgcttactttggattctaccggaagtagcctattcaagcggggctatcgtactgctaagggtggggccccactcaaggaaaatatggcggcagcattagtcttattatcacattggttcacggacaatccatttgtcgatccagtgtgtgggtcaggaacaatcccaatcgaagcagctttaattggccgtaatatcgcccccggcttcaatcgcgattttgtttgtgaaaagtgggaaatgacgcccgataatttatcacagcagattcgtgacgaggctgattctctggcagactacgatactgaattagacattaccggatatgatattgatcaaaatatgattgatatcgcgaaagttaatgcacaggaagcaggtttactacaggatatttcatttaaacaattggcagtgaaagattggcaaaccgataaaatcaacggcgtcctcgttgctaatccaccatatggtgaacgacttggagaccaagacaccgttcgaaaactctatcaacaaatgggtgatgtctaccggccaatgacaacatggagtaaatatattcttaccagtgatttagaatttgaacagttttacgggcaaaaagcaactaagaagcgtaagctctataacggttctttgcgaactgatctgtttcaattctggggcaaaaagcaaagataaattttttagatattttcaaatggtttaaatcttgttaaatcaaggtttaccgtacatagttttatcgcaatatctcttaaactatctcatgtatgtgggaaaaatatgggaaaacgtcaatttcccacatttttgattcctcttgaattccttgaatgtgaaatgcggaaaatctgtaagctataaacaccgagagtgcgttatttttcctagttctgaatttagttaaaatgcgtccatatcgtcgataatttgtcgcttacgcttgtccgaaccggtatcatactgagtggtcatttcaattttactatggcccatgatattcataatatcgactcgatcgactgcatgttcgacggcgaatgtcgcaaatgcatgacgcataaggtgagggtagatatggaacccaatcttattagatagatagtcaaagatatcatttacatcaccaggcggaataggggcaccatcaagcttgctgacaaagataaaggtatcatcagtcaattgcttgttgaaactcgtcagcacgtcctcagcctccagcatggcatcttcgaagatctcgtaaaccttgttagtgattgggacatcacgatatgaactacgtgtttttaacgggtttccttcgggtgcgtaattaacgcgcgccaaatctaaatgtagatggtctgggaaaatacttttggggcgtaaccctaaaatttcgccacgtcgtagtgccaggagggcgccataaaaaatgccaagctccattggtgataaatacttgttagcagcttcgatagatgctttatactggtcttcgttaatttcagtgttacgctggtgctgattggttttcggtacccgacaatgtgcaatccgattaagtgagattaactcatcatcaacggcctcattgagtagagcggacatggcgtctttatacgtcctcatggatagttccgagtatccattaacttttcctcgtatccttttcttaaccgctagttcattcaaaaagttctgaaaaactttacgattaatttcagtaagtttcattttgccaaatacaggtaaaagatgtacacaaaaataaccctcctgattatgcagggtggagacggaccatacaccggtcttaaacttcctgtcggacaaaacttcgtagtactcttcgatcgtcatatttttagctgcacctctagatcgacgtgcttgttgttcggcatcgtttgcccaatcttctgcatcttcaaatgatgtaaagccttgtttctcaaacgaataaatcttgccgaaaatggttcgtttaaaccggacccaatattttctacgacgatctctggttttgtagctacgaattctggaatccttcaatagtttcttttcatcagttttagttagtctattttttgctgtcattttaatcaatcctttcaaaacacatgtcggccaagacgtaatatttaaaaagcttgattaatttgtggcaacacctcctttaatggggtaaaattatgtatgtaaaaagagtgcgttcactacgcattctatgtactggccggtacacactcaaaacttggtaggggatgagtgtgtaccttttaatttgtcaattaatatgggggaaagatccatggatatttcaaaactttttgcgacgtttcttgctgcaggagggcttggttttatcaactactcaattgcagatcgcttggatttagtcgaatttaataatgaaaagtcaaacatgcggcttccgtttatgcttgcatggacaattccagattttgctatctacctgttagtctcatactttgtatccagattaaatggtcttaaaatacaccatttaaaaatttatctgaataataatgttgaactcgccatagcgttgctaataacactcatactcgtttactttttatcgctttggttactaccgatcgtattcaaacacgataaagcgttaattaattttcgaagaaaaaagtacggccatgcagaactattcgttgggagtgcctggaacaaagcttttgataatgacagaataacacggtgctatgtttacggtttcgataaaacttttttagtgtccggtgaaattaagcacgcttcgagtgacgcacaatcaactcagatgaccattactccattcattaatgatattaacgaatgcccatttaatgaattgatagagcagttcacaaaagaatcatttcaaaaaacacacgatgtcagacaattactggattatgataaaaaagtaattattgtaacggttgaagatacagacgatgatggcaaataatcatttactatctttgttatgtgtaaaaggatttttacgatcctctgtgcgatgaattggtttttccttgccttcgttaaagacacttctcttttccatatgttgaatattccgtagtaaatgttcttccggtgtatgattttcttttgtcattggtatcaatccctttcaaatgatataatttagacacagggctctaggcccgagtgacaaagtgaccactcgttattttgtttactctatactttttacacgtgtagcacatccattatcttggcgggtaggggatgtgttttattttggttccagcagaacaattttgtattctttcaagtcagcaattccactcatcttcgttgcaatactcttaaatgaaccaattttcaaatttgtatccaaatcggtttcatctttcaacaataagattcgtagttccttttgacctgaataacgagtaggtttaataaacccaaatttttttgcaaaatcaattgtcgtaaaatttgttgtatctattttcttatcatcactggtgtaatctttatatctgatgctatcaataaaagcggggatattattttttgtcaaaaactgttctacctgcaccagaaattcatacatcggtaacactacacagggtctaccatccgcaatcttttgaaatttatttagtacattttcttttattttataaactttttcctgaatagtatcatctgtaacttcgtacaagtctttcttcacgcttagaaatgcaaatgacgcgattggcattttaccgacatctttattagatgttctgattattgctttactaaaagggaacagtttgggtttatcatttgaaccggcaattttataaaatagtgccgtctttccaggaattagatgtaccggatatgttccttcactccagtcaccttggtcatgattgccatttttttctaactctcgaacttcattaatggtcataaaatgtatacaaccatcttcaataaagtcattgatgaaatcagcattaataaatttcaccaaaaaataaaagtcattgttcaaatcgaatttgctcactgaacttctcctttacaaaagtatctaattatcaattaattgatcaagaggaattgtcttgtgtttaatctctctaatcacaaaatcagatccaatcggtggcatattttcagatttattttcatctgtaatataagcttcgatttcgcgaaaaccatctctaaatttaaatgtcctattactttcaacgaattcctctaaatttttaatttgagattttgtcaattcattgtcagtgataacaccgatgaatttttcatatcctcgaaccggagtgggtgaattaaatgcagcaggggacattggtttcacaagatgatccacatggtacgcgtattttcctataacaatctctatgtttttatacatctgttggtgcatctcctttctaattttcaatggaccttgtaggactcgaacctacgaccggacggttatgagccgtttactctaaccaactgagctaaaggtccgaacctggctgttgtagtgagaaactgattttatgattctattacgaatcagcacttgttttatccaagtgcgacacggctttactcaaaacataactatcaaatacgaactcagattcttcaggatctccatctgcactgcgttcaatgctttcaacaactgctttttgattatccttggagaaacttattgcttttatatctgaaatgttgaaaacgtacttgtcatcatctacatcaagtaccagtgtcgtcaagttttccgtatctgcctttttcactacgtgtacaatatcagccgagtatttagttgaccattcgtacatgcgatagcccttaacattgtcaatagttgcagtagtcccatcgaccgtacaatcagcggttaaatcggaatctgtatcaagattatctaggcgagactgaatattcaactcggctgttgattccattaattcgctttcctctgcagctgataactttccactgtcactaggggacttatccggtttggtcacatcaactaatgactttgcttgagctgaatttaaagtaagttttgtggttcgaaatgacttatcaaagctattcatcaatacttttggaacggtgtaagtatcgccaaaactcttattaaatccggttaccgccataatagccatggcagttttctgacctgatttgactttctcaaattcatttccaacgacattcattggttccacgattgcagagaatttaccattttttactttgggccattcaacattgtctgaaacaccagcaggggtgcgatagttcaaaccttttttattgctggaggcaatgatgatctttgctccgtctggggcggtggtagtgcctttgattttccaatagttatcagtaaaatccccattcttcacatatttaatctttgtgatgctagtacggtacatttcatattttccaactctcacgtgggacttctgacaaccggtcaagaaagcaaccccagcaatactgattagtgacaccatcaaccattttttcaaaagactacctcatcacacaaaagaatttagtccgtaagttcacgataaaaatcagccgtattcgtatcctcatcactgaaatcactactgaaagtactgtaactgccactagggtagctcacaaggttggttagttttttgagcttatcataaccagacttgtacttggcatagtcatacttaccagtatcatttttcttcattgtttgaacgactcgagacatgttgttcatcgtcgtttcaatatccgaaatatcatccgagttctgatttgttaaatcatcaacggttgattcaacatcaaagtcatcagcgctaccagaattatcaatcgcatccatccaaccatcacgaatactattgccgacatcttctgctttattagccgcttcgtagtagtaaacatcatacaaactaatttcctttttaaaccgtttattcatcgctgcttcttttcgagtctctacaacagccacatggtgattgtatgcgccaatacccgcaaagcagacaagactaagtacaactcctgacacaataacaattaaagcctttcgttttgaacggtctttagcgtaatcaataatcagcatcacgattccgacgattgctaccaccaagccaaccaagaaaatcagcactaaaaacgtacccataataaatccccccaaaggaggttcaccgagttttgcgtcgtctgtgttagggacgtaatcaattgctaatctatgcgcgcataatatttaacttgatgttcaaatcctgaggtaacccagtaagttcatagtattttttaaattgattttcgccgctaaaattattagccattgatactaaccaagtctgtaactcattttgaaaactagctgaatcaattctgccacaattcttcataatgacacaaatcagacaaaatagatcgtctcttccgttcttatttaccgtgtattcatgttcagatagcagagtagagccgaaaattgatttaatcacgtcataggaaatgcttccatgagtagcgttatatttaattagcctggatccgtgggcgagagtatttctgaaatcatttaaaattgccaatgagcttttaacaaatccacgctcgtcatcttttatgctctgttcttctggaatatacatgatattacgcacaacgaaatccttttctgtggatttgagtatgccatacaaacttctgaattctcccaacattaaattcgaaaacaaaatccaaggtggaatttcgtcgtgtcgatttcgataatacttggttgggttattctcagtagtttcaccaacatgtttaatctgtcttaaaatagaatcacgtttccgattccgatttgaaaaatgttgatttgcaagataagagtccatagattcgccaaaggagtctgccaatgcatgtgccgtcagttctttcaatcttgtttccgcaagtaaactatactttagtaataatgacttgagctcgttttcaatccaatattgagccatgaggtctgaaaagttgacgccactgttaaaatgctcttttccagcatcatcacgataaaccaatccatccttaaaagcatttattagcccgtaatacgagcgagattttaaagcatcgataacatatccatattgtgacttgggaatgttcattccacgttttcgaagtttttcaaccaagtcaggatagctagtaaaaggtcgatctgacaataaattcacctccaataacgaaaaaaccactacgcaatgatttgcatagtggttttaagcgacccgttttggtacgacaggcatttcagttattaccaccatgctaattcaaataatgtttagtgtcaatcttttattacttcatctccaacatggatcataggatcaactgctgatgtatccattgaacttgtttcattgatactcacttgcaaggctttttttccgtttgattgtccccatggattcacgatagatgcgaattcattttcaaaactttcacaaattgaaaacttttcatacagctcaataactttaattttggccttttttactttaatagcacctagtatctcatgtgttgtaggatcgagaataggatccgcagattctccaacaatagtgaatgtttcaccgactttggtgcctatgttcttgccggcggtgataattactttatatgggtctaagattcgggctacttgaatttttttgtcagccatgataaacacctccgtgtttaattattcttctcactcaaactatcctgttccgacgcgagggcagggtcgtcgatcgcgtaagtgctgccttgatcctcggcagcatgttgttgatcagctagctgttctttagcgaagtcatatacttttgattgatgattgacatttaactgatgcattactgcgactgtagcagcaatcattgaagtgtcgtttgacgagtaagcattaaataagtcctgcggtgtcacattaaaagccttggcataggaagcaatatcattttcgtccaacgctctattctgattttcgtgattagaaatggtattttgagcaatcccggtaaggtcacttaattctatttgcgtcatatgtcttttttgcctgaagtctttaataacaggcccaagaatatttgcattcataaaaatgtctccttctactttataagataataatatcacattatgagataagcacaatacaaaattatgtaaaattgagatatttttatcttgcatattatctcattatgagataatattattcgtgaaaagaggtgaatattttgacacactcaacaaaagagcagttacgaatcgatttattacgtcccaaaacaaagcttgcagctatgagaaaaagtaaaaatataaccactgctcaaatggcggagaaattaggtttaagtcggaggcagtacgagcttaaagaaaatggtaagtatccattcaatgattacgagatgcttgccatcacacaaaaattcaatgtagatattcaagatatttttttgaaaaataatatctcattatgagatattagaaataattttacattccagttcgaagtcagagaagggaggtggtggtcatcaaccatcattcaaatattgtgcctgcagacggaacctccggtgatgaacaagtagtacctgggacgcttgagctagcacgcgcaattatcaaattatgcaccgattcaggtgtgcgttatttagcacaaaataaagccctctgtctggcggacagaaagctttatgaccttgcgattaaacgaactggttagtgaccgagaagttcgtcgtgttcttcatcttcggatttttgctctgctttgtactgatcgtattgttccttagttgcaccaacaacaaaggcggtattgtagtacatttggtcattcacaatgtcgataaccttagttccaacatggagcagtaaccatccttgagctaactttttgttggctcgactctgcgcattatcgtcactgaactcaagtgtaaaaacaattttgtccattatgcttcacctcactttcattatacgtgtacacagtatagcaaagtaagaatggtgaattatctaaaaatcaaaaaagctcctaccagaagtgagagccagagaagggaggtgtggggatgcaggaagagcaacaattcggactggtaaagcaaccatcgtttgatggcgaaaaagtcaatctaacaatgatcttatcaaatggcgccgatttacttgccaaaataaaaaaagcccaacggttgaacgctgaacttcaaacatcattggagcggatcaaaaattttgaacctaggtttcacttggaagaatcgaaacaggattgatttcaaaatcatcagggaataagtagaaatcaaaatttggcaaattcttaccaagaaaatgaatgtttgttactgacacatttaaatcaaactcatcttcagataaacccaagacaaattcctttaacttggatagaaaaagagcctgattttggtacaactcgccgctttgatcaccaaaatcatcattttcaagaaactcggcaatgaatgctttacggtactgatacttttcttcgctcttattaaacagcgaagaagcttcataaaagttggcggtaagaaggcactaccgtacgaccagacatacaaggtttgatcgatcttactaccattatgaatacgatcttcaagcatagacacaccgtaaagaaataacgctgcttgtttgaaattcatgttaaatcacctcctctcgaaagggtgatctaagtatagtctgcctacgtgaatacgttattaataaaaaaactctcactagaagtgagaagccaagaaggatgtgtataaattactgtttgatgattccgaacgctttgcaattgcatgtgcagcagttgtgctatccataatcggattggtaatgagtatagtgagaaattaatgcatatatttttccagcatcaatacttgctgatcaagagtaatttcaatcggttttatattaaaggatttagttaaaggtttatgaccaaactcaaattcgaaatcgtgcgctgtatttaaatctacacgtttatctagatattggaaggcacaaattatgtcgcaagatttaaacggctcaatatttactggaaattcggttgcaaacacttttgaattgccttgtccttgcaacttcacaggccaacgagctgcagtgaacactttatcatagaaatttagatttactttgtttaaagcaattggcttagataatccattatagatgttaactgagagatttatttgattgctgagcattgatgaccaatttagttgaatagatggttttctatgtctgtttatccatgtcgaaacagcggcatagatggatagtgtcagtgatattaaagaaaaccaaaaagttggtttcatgtaaaaggggagttgggacgttaacaacaccattttagattatctcgctttcctatagttaacttgagtataacaaatttcaagaacaataaagcatcagtaaaagaattccaacataagcgagaagccaaagaagggaggtgtgggatgctcaatcgtaaaaaaaataaagccattaaaagtggctttaaaaaatatagacattgaaaacgcgctgcaatcagtggattttgtacatattaagttaaaattattttaattaaattcatgttctgccaactcccgagtattttttccagaaatcaacaattcatgcgaccatttaaaattaacagtttctcccattggaacgtagttgcacctctctttagggccaccaaaaagtacgcgccattcacgctgctcacgatatcttgcgggttttaggaaaaacatatctgacagattaagaagtatatcttcataactaagtgggtaatgatctttttcataataatttatgataccattcaaaaacggatacggaatattttttagagaattaagcattgtatttttagcaatgtaaatccacggtctaccatatccaattgcatcaccaaattgcgtatttctacttgttaaatcatgcagaaatctttcatttaatttaccatctactaggtcgctttgtctgactactgtaaatgaggttgtcccccacggtatatcagagccgattaatatatcagcagttttaatataaaaatattttcgtgtttttcttgcttttgtgacgtatgacttgggtacaaactttacatcactcgaattgtttagtgcaaaatgttcatcaacaaatttttttagatgagaacttgttaattctggtgactttaatatcgaatagttaccaccacacgtccggctaacaaccttttcttttcctccatcaaaacaataatttaatgattttggtaaataaactgtgttgttaccacacacttcgaaacccgataataaattaaaaattgtgtctgtaacacttccttcaatcgccctttgtgaagctgtaagttcattatcatttaatttttcaacattatcaatgtacacattgccattcattaaatcttcaaaagggtgtatttttttattcttttttacaaaaaaatctgtaaattttaaaaatccaattgaatcagcaggtagatttctgtttactttcatatatttgctcgactttcactaattactactttctaattttaaaagctcttcaaaaactttccatggctttttatccaatgcaaccgcagtagccttcaaaatcttcccagaaatagtatctgtcccatgctccgactcagcaacacgctgcagggtactattagaaacaccactggctttagcaactttgtatcgagtaataccgttttgatccaaataattctgatataatcccataatattcacctcaccaaattaataatcgatagtagtagggcaacaacagcaataattaaagttgccacttgaacactctttttcatattagaacacctcatatgttatactgtacacgaaacaaggggcaagccccttgctaaagttatttctgtctgaacgtagtaatcaagttaatgattgctgtgacaaggttgattagtaggataatcaagtttgttagttcagacgtttttttgtttccggtgtttctttttcctgctcaatttaaccatctcctttccatgtctatgcattactatattgattgcgttataaagtgcaacgctttttcgtaataaaacgtaaaattatgtatactagtcttggccgattcatgtgggaaatatgtgggaaaagctgttacaattattgatgtagtagggtagcccagctttggggcaaaaagcaacgttagtctaatatctttatttttttgttaatcaagcaataaacgtaaaaaaagttttgcttacattttgtaagtatgatatgctggtactcgttaacgaattaaagcttttattggaggaacctaaatatgaaaaatgaattaattagcttagctaaacaacgccgttcaatctatgctctaggtaagaacgtgtctttcaccaatgaagaaattagtacattagtaaaagacaccatcaaaaacttgccaactgcgtttaacaatcaaactactcgtgccatcatcacatttggtgaatcacacgataaagtttgggatattgttttagcccgtttgagaaaagaagtcaaagatgacgatgcgttcgctaaaacaacggctaagatcaacagctttaaagcaggatatggtacaattttgtactttactgacactgatgtggtcgatgcttacaaaaagcaagcaccactatatgctgataacttctatgattggtcagagcagggtatgggaattgccaatttcgctgtctggactgccttagccgaaaatgaattaggcgctagtctacagcattataacccacttattgacgaccaaattcgtgaggctttcgacgtaccagccaactggcgtcttagagcagaaatgccatttggctcagttgaagcacaagctggcgataaagattatatggatgatgatcaacgtttcaagacttttgactagcattacaactagtctagttattcatccgtcatagtagcaacaaaaaatagacatctcaaatgagaatgtctattttttgttgctaaatttagtttaaattaagcgatttcgtcctcaatggatgccaatttttgatatactggtagtgtgtgacacatactatgattcgtttgcgtgtaacgcttgatttgcgaggttgtgagcaccttggttttgtttttcaggaatccatttcgttactacaaaattgaaaatatcaatcaatgccaacaactctgctagttgcgcttcataatgtttcgcaaatcctttgccaacggcatcgctaactaaccgactatcggtataaaacagaatggtttcgtcagcagtaaattgttcttttactgccttgaagcccgcaatagcagctgcaaactcgccttcgtgatttgaagcagagtttaatgtttgttttagttgcaaatttttttctggactaataattaagacgcccaaaccagtcggtcctggattgccaagagttgcggcatccgtatatagtttaatcatatatgtaccctcacttagtatgttattaaaggagatttataccccatggaagaacaacaaagatatttttatcaaccaaatcctgtatctgcagtcattaattggtgttggaccgttgttattttactaattggaattattgtgtggcttgaaattacgcattttcaatggattacagcagctttttttgtagtcttcattcttttggctttttttcaaattacacgtcgaactgttttagtgacaccaaccaaactagtattcagtcgggtgcttcaaaaagattacctgattattcccagacagtcaattcgccaattacgcttctctaaacattcaatgcatatgaccgtgaatgggcaaaccatgtttttttcgtttatgcccaattcacttgagtcaatcaagcaacaactaaaataaacgtacgtttctctggaggatgttatgccttattaccttatcgttatcttactactaatcatcgccgaccaagtggttaaatatactattgttcagcaaattgcactcaatcaggtacataccatcatccccggattactatcgttcacgaatttaagaaacgatggcgctgcatggagtattttgagaggtcaacaatggttttttacaattatctcaatcgttgcgctactcattttaggctattttctttggcggtttcgttctaaaaaaatgtatgccttcagtattagcttaattttggccggaacaatagggaactttattgaccgaattcgcttagggtacgttgttgatatgttccaactagattttattaatttccccatttttaatgtcgcggatatgtgcctgaccattggtgtcatttggctcgttatcgcagtatggatttcaggtgatctagattgaataaaacatttacttttaaaataacggaagaacaacatcttggccgaatcgataaaatcctgccaaaactcatgaatgacgtttcacgttctcagattcaaaaatggattgagtctggtcatgtgatggtgaacggcaaaacagtaaagcccaaatataaattagccaataatgaccaaatcaaagttgttccagtagaacctcagaaaattgatctcactccagaagatattcctttagatattgtctatgaggatgatgacgttcttgtggtcaataagcctcaaggaatggtggttcatccttcagcaggccatccaaatcacacattggtgaatgcattgctttatcatagtccgttatccacgattaatggcgaatttcggcctggaattgttcatcgaatcgataaggacacgtctgggctactaatggttgcaaaaaacgaccacgcgcatcagtgtcttgcagctcaactaaaggccaagacgaatgaacgtgaatatattgcattagttcatgggcaaattgaggaagaacgggggaccattaatgccccgttgggacgttcaaccattaaccgccaaaaacaagctgtcgttgctgacggacgtcatgccgttactcatttcaacgtgctaaaacgttatcagcactatacgttggtcagttgccatttagagacggggagaactcatcaaattcgtgtccacatgcagtatattggtcatcccttagctggagatccactttatgggccacgcaaaacattacccggcaacggacaatacctacatgcaaaattgttgggcttcgttcatcccactactaatgaacaaatgacgtttgaagcaccattacctgaatattttcaaacgatgattacctatctgaacacacacgatttatagatcgtaacaactagtaaagaaggcattcttgtgactgaaagatatttaattttagaagatggatccgtttataaagggaccggattcggggctcctgcggtgacaacaggagaactcgtttttaacaccagtatgaccggatatcaggaaattattacagatcaaatttatcacaaccaaatcgttatctttacccaaccaaatattggtagttctggtattaatcaagcaaactatgaatcaatcctacctagtatcaagggcgttattgtccgagaattagccaatgtatcaactaaccgaatcagtcgattgtcattggatcaatacctcaagcagatgaatatccccggaatcacgggtattgatacgcgtgcggtcgtcaaaaagctcagcaaaattggtaaaacgatgaaagctagtattgttcctgttccagacgaccacgcattcgatcaactaaatgcgacggttctaacaaatcaacaggtggcccaagtctcaacgccaaaaccatatcctaatcctggaacgggtttgagcgttgttgtcattgattttggccttaaacatggaattttaagggaacttggtcggcgaaactgcaatgtaactgtgctaccttacacggcttctgcagaagatatccttcgccttgatcccgatggagtggtattgtcaacgggacccggaaacccccatgacctcagaccatccgttttagaaatgattcagctaattcaaacagagattccactgtttgcaattggtctcggacatgaactctttgcaatggctaaccaagctgaagtaggcaaacttccggcagagcatcacgggatgaaccatccgattaaagaagtaattaccgatcatattatttacgcatcccagggtcaaggcttcgcagttgatcggcaatcagttgatcgacaccggttattcgtcacatatatcgatctggtcaacgataccgttcagggactccgtcatcgtaatttcccggctttttcggttcaattttttcctgatggcgcacccggacctgacgaaaccaatggcttattcgacgaatttatcgaatctatgcaaaggcggggggcttagcagtgaataaccaaatctcaaaaattttaattattggtggcggggcagatgagatcagtcatgaaaccgaaattgactctgctatttttcaagtggccacacatttaaaacagcaaggctaccaaacgatcttgattgataacaatccattttccttttcactcggaaataagcaggctattgatcaatcatgcattttgccactgacgataaaaaatttactatctgtgattcatgaatatcatccagatgcaatcttaccaaatcttggtggcatcaatagtttacgtcttgtggaagaactgctagaaacaggaattttaaacgaacaacatattaaaattttaggggttccagaggctaccatccggcaattaaataatccagtattgctaaatcaaacaatgaaacaaatgcaggcgcccattattacggcccaatctgtcaacagttttgaatccgccgtagaactcacacgaagtactggatttccggtcatcgttaagccggtcgctccacagggaagtttgacccgtcgcacgtgtcatgatactaacgaactagcagatgccattaatatcgcacttggtcaatcacgagtgggacaagcgatggtccaacaaagcattgccggttataaagaaatcgaagttgttgttttacgcgatcggttggggacaatgcttcaggtggctgggatcgaagattttgatcccattgggattcatgccggagattcgattgcctttataccaacacaaacgcttcttgaccgtgagtatcagcgcattcgagacgtagctttagcaatcacacgtaaactccgaattgtcggcatcaatcatgtacaatttgctttgaaccccagtactggtgagttctacgtgatcaaaaatagtccatactttgaccgaatgacatcattcgcggcaaaagcaaccggctatccactagcagaagtttgtgcatcactcttggctggcaaggttcttcctgaaatcatccttgatagtaactatagctaccgtagtgctctcatagaacccagtatggaccatattgccgcacgaattccaatttggccatttgatatcttacctgattccaatcaacgattaggaacgcaaatgagatcaacgggttccacaatgggaattggcagaagtacagaagaggcactaattaaggcaatgcgcgctgctcactttcactccgatacttttcggatggaagagaacgcacaactttccgacgatgagattgttcaacggttaattcatccgcgtgcaaatcgcattgtactgttaattgaggcactgcaccgaggatattccacaagtgaactagcagaactaacaaaaatcgatccatattatttttacaagttaaaaaaagtgcaacaacttcatagtgaagtagcagccaaccctcgggacatagacactctcaagaaagctaagtactatggctatagcgatcaaatgatcggcaagctatgggacgtagaagaagccgaggtaacccagttacgtgacgaacaacaaattcatccggtttataaagaagttgatccttcagcgggtgaatttgaacagcacacaaccattttttactcgacgtttgaggaagaaactgaattagtttctagcgatcataaaaaagcgctgataatcggggcaggaggctttcggcttggtaatgctggagcagccgaatactatacagccgcaatgttacagacactaaaaaaacagggttatgaaactatcctcattaacaataatcctagcgccgtatcaatgaaccaaattctatctgataaaatttatgttgaaccggttgaaactaccgacattctagcgattgcacgtgctgaaaaaccggatgtcatctatattcctaagattcgtcagcggttatgttcggagcttgagaaatacaacttaccaattgtacaattaccgcaaaacggtcggttacactcacatctctccaatggacctgaattttgttataatgcactgttcgatggtcaaaaagtttatccactgggaatcagttcttatctcattcagagtccaagtggttttggggaaccaacggcaatggtctatccagcacagctgagtgaaaatgatcaaaatgaaattaactctaacggtgaggaccacgtttcccaacaaaaagaaccgggtatttatcaaacattatttgttaaaactaaccgattacgagtcgagcaaactagggttattccactaacagaaatttcctttttatccaaagtacttcatgtagatctagtccaagccgcaattcagttgtctgatcacacttttgttttcgatgagttcaacgagcaagtaacactgccatcgtcaacccaaactgctgcgtatgccgccacatttccatttcaggcgctgcatctatttggtgaaactattcaatctaccaatgttttaggtgcggaaatggcgctaggcacaggagtcacagacgcgttaaaacgattaaatgttaatggccaatttcaatttcatgatggttcatttacgtaaaactatgcaaagcaaaaaggagttctgacagaatagtcaaaactcctttttatatcaatctatttctgcagctgctgaacgatttccagattaggagtcacataaatagtcgtttgaccctcaaatatgacaaatcctggtttacttccatttggtttccttaataatttagccggtaaatagtccactggcacgtgggctgattcacgtcctttggaataataggctgctaactgcgctgcttcttgaatggtctgttcactaggatcagaatccctaataattacgtgcgatccaggaatatccttcacgtgcaaccagatatcgttcttattggcgattttaaaggaaagacgatcattttgcagattatttttcccaactaaaatctcagtaccatcagacgacttaaacgcttccggtttgctaacttggacccgtgctttcttcttattccgagtgtttttgacacgcaaatatccttgctgttgtaactcaagccgaattcccttagtatcttccggattggccagctcaatttgtgattgaatgttttccagataggcaatttcttggttagtgattgctaactgttcattcacatgactaacagctttcttaagcttttgatacttagtaaaatacttttgagcatttcgagaaggcgttaactggttagacagttttatctttagtggtttgttttcgtcgtaaaaattaggtagtgtaacttcagttgactgtggcttgatgtctcgtaaataagttgttaaaatttcgccacgaattcgaaaatcatctgctttttctgtttccgatagggttcggtttagtttctttaccttgtttttatttttctttagttcattgtgtacaactcgaatcagctcacttgccaattgtttagtacgatcccgttgcgatttattagcataaaaagcgtcaagaagttcagacagtgtttgatagctagttaaattagcaattgtttgactgtccgcaggcggaaataccgtaaaatcaacttttccgttgacatactcgaccagagaaggcgttggttgattaaattgtctcaaaaaatgttgataggcttctggcgcgttctcactatttaacagttcgtaagcaagctccttcgcagtctgtcgacccatcccttgataagcttgttgcaactctttggccaattcctctaaatccgtaattttatgggccaattgcgcataagcttgatttgcaataaatggatttaacttttcttgttgtggcgccataatgaacgtggcacctggtagtaaagttctatatcgatttttgtctgaaccaacatgcttaatcgtatcgataattttacccgttttaacactaattagggaaatgttactatgacgagccataatttcaatcacgagttttagttcttggttatcgccaagttcgtcacgtgttgtgaaattaatttgaacaattcgatcattatcaatttgttgtacagaactaataattgcaccttccagaaacttgcgcattgtcatcgtaaagtttgttggcgttggagggttcttgaacggaacatctgtaatctgaattctcggataagtaggattagcagagatcaaaacattataattatggcgatgggcacgtactaccaaaatcatttcggcagggtagggttggtgaattcgggccactctgccagttgccagtagttcatttaattcatgaacaattgcatgggtaaaaaatccgtcaaaggccatttttcttggtacctccttaaaaatcaatccattttagtataccggtctttacttcatagtacaaaaattaaatatgattgcattatacaatatcaatattgtataatgcaatcatataaaaacatgactataaggacatggtgagacaaaatatgaaagatagtttaatcgcacttcgagacattgaaaaaaattataaaagtgtgctattaaccattacaaagcgttccaaattaactatcgcagaatggcaattactactccaaattgaagcaggttatcgtacacaagaacaactatccgacgcaacgaaattagatacatctactctcagccgtcaattaaaaaatttagtgacaaaagaaatgcttcaaaaaacaccgaccgggcgagataaacgccaactcgtatattcgatgtcacaagcaggaaaaaaagctattatagaaattgatactgcatttgctgatttaagcactcgtatttttgaccgctggaccgacgaagaaaataatctattacgtattttgctcaaccgtctcgataaaagcattgcccgtgtatccaaacagtagttatttagataataagaaatatttaattttctttaactgactttcaatttggttggttaatcaataaatgtatgctaatattgttgagatgtattttaaattaaaatgaaataagtggaggaattataaatgaaaatcgctgttgttactgacagcactgcctatctttcaaacgaagaagtggcagcgaacggaattaaagttgtcccaattcctgtaattatcgatggtcaaagctaccgcgaaggtatcgatatcacaactagtgaattctatgacaagcttcgtaattctagttcatttcccagcacttcacagccgccacttggggaaatgattgccttgtacgatggtcttgcacaagacggatacgatgccgtcatcagtattcacttatcaagtaccatttccggatttgttaacagtttacgccagattaatgaccaactaacgtccaacattaaggttattccatacgactcgcaggtaaccgttaaattaatggggtacctcgtgcttgctgccgcgcaaatggcaaagcagggcaactcagtcgaagatattattaataggctagatgacttacgtacgaccattaataatgtctttatcgttgatgatctacaaaatctagttcggggcggtcggctttcaaatgcgtcggccttcatcgggtcactattgaaaattaagcctttgcttagcatgcacacgccatctcatgaaatcgaagcttttgagaaggtacgctcaaccaaaaaagcactggcacgttgtgaggagatatttgatcaatcggtggccgaggctgattacccaattagagcaattgttatccatgctaacgacgaaccagcagccattaaatggcgcgacaaattgagcgcaaagtatcctaacatcccatttgaaatcagttattttggaccggttattggtactcatcttggagaaaaggcactagccattgcctggatgaaagacatcgatgctgattaaaagcaaaaaattatatttaagtaattgcaattattatatcgaataaaactaggaacagcatcaagcgtatatttgatgttattcctagttttattatttctgagtaatcttttcaaattgcttccgcaagagccttcttagttgcggatcatgaacgtatagataggttccatagacaccacgcttcagcaaaacattcaacgaattcataaccatttttttctccactgattcaatcatggcgggatcagtcagatcatcgcgttttttaaacgcttcgacatcagtatgtttcgtgagatcaacatctaaccgtccgtgcttggcgtctctaaaataaataggtggtccaatgatgattcctgcatagttaagatcgaatccttgacacgtgtaaatagatcccacttcatcgatggtagctggaatttctgcccagggagtttccgtataattatattggtcccagggcatcttaaattttccttcacagatataatgcttaccaccatctaatgttgaaggatacccggaagttgataaaatacgtgaaaggccaacttgctggttacgcatcacaattgccttcctcatctcttcagcgtcatcataaattctgaaatcgtagttatttaacatttcaggggttagttctgtcacagtccgtcgtagcgttagctgattaatccagtctaataattctggacctgctgacatccgaaactgctttttcagtacatagttttcatgaaagtagggtgtgagtagtgcatttaaccgttcatttgtccagtaacttttcatccgtaatacttgtgtttgatcgaaaactaagataacgacttttgaacgttttataatttcttgtaactgattatgaaaataaaagttattataatgatctggctttgatagtaacaaatgggcttcatcaatcagtacaatatctgccgcttgattgtgtttatccagctgattaataaaagtagttggccgctgataatccttttttaacagaatagtgttactaccagcaatagccttatatacttttaaaacctctggatggttaactagcaagtaattctgtgtccggtatagaatgctggtgttatcagttcgtgctagcaactggatcttagcgaatagatgggataaaatcacgcttttaccggtcccggcatcaccaaagatggtaaatacaccggtctggttattttgaagccgatcttgagtaaaattcataatctttaatactaattcacgctgctccgtagataatacaacatttggtccaatcttacgggtagctgtgttagtgatgatctgtttaatcaaaatatccttccttcaggtaaaaagtatgtccaacatgtaattgaccgtggggaagactgaaaaataggttagaattcatttttcattttctagtttacataatatatattatacaaagtagaatttaaatctagaatcaaccgatatactggctatttgtcggttaatcatcgttttactcaactctattttgctggcttcacttcgtaacttggttaacacatattttatttcgtgaatttcattatcggctccatgaagttgagtttacaacttaactttcgcacatatgtcagccaaactgcctttgctgattccaaggtctaaaaccatacactgcatgccatactatagcctttattagagtttaccgccaaatcaatcaattactgttatcaaactaatcataccgccattaagcaattaatgacaactcatcaagcaactcaatattattggtgttaaattttgtatcgatttcgtgaaaaatcgttgaaaagctttaaatttagctcaaaaaccctgattttagcttaaattttactcatttctgtataaaagagctctaaaccatggtatttggccgtaaaaagctatttttgtctataaatatgaacttttaacggtaaattacagccaatcaaatcaattcatgtaatcggctacgataattcacttgataaccgcttcaatctacctgtcattaaaatttttgttttaatgactactgcaccactactatgttatcatgaacatatgattcttaacggagctaggaggtcctaacgcaatggaaaaagatcgctatttaaatctaatcaatcaggaattaaaacaattaccttcttttattactgaatacaaaattgggactaatctttccactaccactgtttaccagtacttaactgaatttcgccgtttttttgattggctacgttcatgtgatttaagcactgcaagtaccaatgaacaaattgcccccactgaccttgaacacctaaagcgcaacgatattatgatgtatttggattacatccagcatacgagtacgacctcaaaaaagcatgatctctctcccactaccgtgaaccgaacaatcaatgccttacgctcgctctacaagtttttaacaattacggctgacgacttaaatggtaatccctacttcgaacgaaacgtcatgttgaaaatcagtgccgttaacgatacccaaactttaagttatcgagctcatgcaatcaaagcccatatgctcaccggcaatgaaaaatttgaatttttagactttatcgataatacctacattagtaaaattaataagcaagccatcagtccattcaaaaaaaataaagaacgagacctcgccttgattgcacttatgctcggaactggggttcgagtatctgaggcagcaaatattgatttagcagatttgaatttaaacgatcgctacttggatgttattcgcaaaggtggtcaaaaagatactgttcccatcgctaactgggccattccgtatttaacaacctatgctgaacatcgtgaagccctttaccatccagagaagaatcagttagccttctttttaacagagtatcacgggcgcattaatcgaattgcctctaattcaattgaacggttagttagtaaatattccacagctttcggtcgcaaaatgacaccacataaactaagacacacggtcgcatcggagatatacagtaacacgaaagatcaagttattgtcgcccaacagctcggtcaaaaagggacttcagcgacttcgctgtatactcacgtggatcccgataaacaacgggccgcactgaatacaactgatgattgattggtctatttaaagcgataatcaaaatttaaaatgataatacaagtacaaaaacagggctgataatgattcgattaagaatctttatcagccctgcttttgttagtaccgccgcgtaacatttattttgaattaatacctattcataatacttaatcgaatactgtaatagcatctgtacgactttcctacttcccttatcgcgtactttcaatcaccgtcaaaatatgagcgatctgatcacgaagatcaaccccactagcgttagaatacacaatatccacactcattattttcgtattgattaaacattatatattgacattaaccacgattaattcccaaactatcacgtgaccccagcgtcgcatcatgcgaaagccgtacaacaaggtcggcaatgctctgacgtgaaacgtcgtgtccaccaaaaggctcgccttttttcgtcagttggtaattagtatcatcaccattatcaaaccatcctggacgaatcgtcgtgtaattcaaactagaatctgcaataatatcagccgcatctcgataattctgcagaactggattactacgcaaattaccactagttcccacgttagccggaatttcgttatagatccccatagatgtgataaataataatcgccgtacagccgtctgttccatgacgcataccaactgacgagccatttttgctaaatcaccacttagtgcagcaaatactacatcttgcccctgtaatgccgcttgtagaatcgttgtatccatgacgcttcctgcaatcgcatgctctcgacactcatttaactgacctaatttttggggataccgagacattaacgttaatcgatcatctgtgttctcaaggaaatattttcttgtaacacttcctatcgatccagtagcaccgataattaatacatttgtcatttacttattcattcctctcatccaatttttgcctatgctgaatattaaccccttgcagtaacttcaaggcaagattttttcattttttcgtaaaatagcttgccttacagttactgcaacgctttatactcacatcgtacaactaaaaaaaggagtcctattaatatgaaaactgctacttttattgaacccggaaaagtaatcattcaagagctgccaaaaccacagattcaaaagcccaatgatgcgattattaaagtgttgcgtgcttgtgtctgtgggtctgacctctggtggttccgcgggctttcccagcgcaaagccggatccgttgtgggccatgaagccatcggtatcgtagaaaacgtcggtaccgatgtaaccagtatcaaatcaggcgactttgtcattttgccatttactcacggctgtggacactgtgcagcttgccgtgccggtttcgaaggtaactgcttgaacgccgaagaacagggatccagtggctttcagggcgaatacgttcgctatacggaggctaactggtcattggtaaaaatccccggccagccagatgactacactgatgaacaactcaacgacttgctggcactatccgatgttatggcgactggctaccacgccgcggctagtgccgaagttaaacctggtgattccgtcgttgtgatgggtgacggtgccgtcggtctgtgcggtgttattgccgcaaaattgatgggcgccaaacgtattatcgccatgagccggcatgccgagcgtcaagtcttagcgcgcgaatttggtgccactgacatcatcgaagagcgtggtgacgatgccgtagcaaaggtactcgaactgactgatggtggtgctgatgcggtgctcgaatgcgttggtaccgcgctatctgttgacaccgcgattcgcgtggcacgaccaggggccatcgtcggacgtgtcggcgtcccacaggaagccactaatgctaacgctgccccgttctggaacaacgtggggttacgcggtggtatcgcctcagtgacgacttacgatcgtaacaccctgcttgatgccgtcttaaacggcaaaattcatccaggccacgtcttcactcaacgttttgctttggcagacgtgcaacaagcctacgatgcaatggatcaacgacaagcgattaaatcccttctgattatcaatgattaaattcacgatactgaaaaataaaaaacatcaaaacagcctagttctcacattgaactaggctgttttagactatttttttataagaacattcctgccaacaaacaaattgtactgattaattaaaagcttcttccgtagcccgtttaccaaacataatatttacaaccgcaatcatcgataacaccatgaaccctgtcataagttctactgatcgatcatacgtcagcactgggcttgctaaacccgttgtaagcaatgtaatcacggataatccaaatgaacttccaatttgatgcacagtattaaccacacctgatgcagatcctgcaatctctggatcagtattcgctacaccagataccgtcagcggactcaatgtaaatccctgtccgattccgataatcaccattggcacggcaatcgcccagaaataaccaccttgaattttaacaactgatgccatcaataatcccaaagttgtgatgattgttccggtcatcataatttgtacattcgaaaatcgtacgtttaatcttgaaactaatgttgcaaaaataaattgcggtacagtttccggtaaaaatccaatcgcggccattaacggtgtaaagtgatacacatgttgcattgcctgtggcgttaagaagaaatacgagatcattgcgcataagaaaaagaaacgtgctacatatgcactacttcgctcacgatctacaaacaatcgcagcggcataattggttgctcagtatgtttctcctgccaaacaaagacactcaaaaagagtaaggcaattactactgttatcaacgggtggctagcaccattaattccgaatactaataaaacaattccgattacagaaagcagagatccaagccaatcaatctttcctagattcttctgccgtccagcagaaataaacttgatggttagaatcaccatgatgatcccgattgggacgttcagtaaaaatccccaccgccacgaggtatagcttgcaatcaagccgccaatgaccaagccaaaacttgcaccgaggcctccagtagcaccgtagtagatgatagcacgcgttctcatcgtaccttgataactatccatcaatagtgccagtgtcgttggagctaaaacggcagaaccaattccttgtaatgcacgcattgcgatcatcatgatcccattcacagataatccaaccatcagagagcccaagctaaaaattatcagtcccagtaagaatatccgccggcgaccgaacacgtctccggcacgaccaccaagcattagtaaaccaccaaaagtaagcacataggcatttgtgacccaagaaagtgcctgcggtcccatatttaaattctgggcaattttaacagtacttgtaaaaacaatagagttatccaataaaatcatgaaataactaactaaaataatcggtaacacgattccaaatcttgactgtttcatccttgtatatattcctcctacaatcttcatcaatagcaacgaaaataagaataatcccttacagtaactgcaaggcaagcagaatcaaccaactttcctcataaaaaagatattttgtttctgacatgttcgactaaactgcaggtctatcaaaactggacgaacatttaatgttcgtccagtcacgtttaaatctatcaagttaacaggttttaactgtttcgttagtaaaccggacgattctcgccctgtgttgacggatctgctaatcccaaactatcgttgatccccaatactggtttagcgataattcggagcactaaatcggcaacgcttcgacgggaacctgatacgccaacatagggctccgcccgatgagtgatcacgtaattaatctcatggcgatcatttaaccagggtaatctcaacgttgtatattgcaacgctgaattagcaagtaactggtctgattcaatcgccgcattcaagccattcataacctgacgtgcattccagcgaccaaattctcccggaacttcattgtaaatccccaaaatgttagtgaaaacgatgcgactaacgtgatttcgtttcattgcgttaataatgttctttgtccacacattattttgtgtgtgatcgacaacacccgcaaaaatcaaatcttgtcccgcaacagccttattaactgcattttcatcacttaaatctccctcaataaaggtaactcgagcgttattacgcagctgactcaaacggtcagcttgtcgtaaaaagagcgttaattcaatatgactaaattttgattctgacaaaatccgctcctcaattaaccgtgcaatttgaccattagccgccataataagtactttcatatcaatcatcctccaaataatagattacgagtttaacttacacccctcaagttacttgaaggcaagacttagtaactacttttgaaaaaacttttttaaaatcacttagctgatggcactatcctttatcgacaacaccgaagtaaaaattatcatgtcgtaaaaaattgatccgatcttttcgatttttttggtctaaaatttgtaacacttgaaatgctcgagcttgcgatactcgagttgctttcatatcacgacgcttttccagtggaatccagccttcagcatctcgaattcccttatcgcgaataacgtaaattgttcgttcgtgatctacacaaatataatagtaacgccgttttggtacactttgattggccttaactatcactgtttgctgttcagtagcttgaattaactgcttaacatcattaatccgtttcattaaatttcggtactgacgacaaatttgacacttctgatcatctccaatcgagtgcgtcgagtccacctcttcatggaagttagtcaagtcaatactttgtgccagcaggagcccccgatatctctttaagcgaatttttttatcattccattcttttaattcattcatgttatcacctatctgattatatgtttaagtctttgacgtacttatcacatagaatatggtatttagataaccataaaaagagcgttaaaataaactcaaggtgagaatttcacagaaattttctccatcatttgaccataaccataaatcgagcacccgcttttattcgtcggataaaaaagcatactgttgcaccacagataatccatgaccttcattttcaatcattattaatgataaaagcaaaacactctggcagcctataattggctactagagtgtttttattccaatgagaatttcacagatgattattatttttggctactttttccaagtccccatttcttatatcctagattccgtaatcaagaagtcttgtcaaaaggacttccacaaattaagaaagaaatgagacctgtttatgacaactataattttaacttccatcctaagtatcgaccatcttctcccgctgatgattgctaaatatggtgcccttgtctatgttggcctatttgccgttatatttattgaaacgggcctagtcgtttttccatttttaccaggtgactcactgctttttctatgtggttccattgccgcaatggcaacacatacgcttaatccaatctggctaattgtcctattatcaattgccgcaattgtgggtgataccatcaacttcgaaattggggcccaattcggacactatttatctagtcctcgttggcaaaaatggattaaaccaaaatacatggccgaagcacaagcgttttttgatcgtcatggaagtagtgcgatttttctgggacgttttgttccaataattcgaacctttatcccgtttacagccggtattagtaaaatgcattatcgtaaattcatcattttcaacgtactcggagccgtcgcatgggtcagtctagcagtactagccggctatttcttcgggaatattgcgattgttaaagcccatttcgaacttatcatgatcgcaattatcgtaatttcattaatacctgccattttgatggcgcttagtcgcaaaagaaaggatgttcgtatcgatgcggaaaaataaagtctggtttatcgctggtcttcttgcaacccttggttttattgtactgaccctaatggtaatgaccaagtcaacacttctcgtcaactttgatgccactatccagcatatcacgacgccaatgattacaactccaaccaccaccattttcagtagcattgctttttttggtagtcccatgattaatattttattaatctttatcgttgccggtggattgtggctcagtcacgaacgattgaccgcctgctgggtgatttgcgttcaactagggggaagtgccctcgcctacgtcattaaaaatgtggttcatcgtgctcgaccacaatttcaagtcattaaagacactggatttagttttccaagcggacatacatttaccacagctatcttggttctaacgattctcttcgttttaatcccctatgttaaggatgccgaaatccagctcatcatcactctcctatctctcatttggtttgggctcgttgcgttttcacgaatttatttacgtgcacactggccatctgacgtattaggaagcaccctactttcgctctcatggtgggaaatttctcgcctactgtatttttactttttaaaacttcaaactcacttccctaagctaaaaatgaaaggtgtgaactaaatgttatctaaattaacaattgttgttcctgcatttaatgaagaagcagtattacccgattcaattaaaacgttactcgaagttgaaaatcgcattattgaccttcagaacatcgatcctgcatcaaatttattaatcgttgacgacggttcaaaagatgaaacatggaacattatccaacgcgaacaccaactaaacgcccgtgtggatggactaaaatttagtcgtaattttggtcaccaaaatgcactgattgccggcttgaccgaagctgcaaaggttgctgacgtcatcattacaattgatgccgatctgcaagacgatccaaactcaatggttgaaatggtggccaaatatttaaatggcatcgatatcgtctatggggtacgaaataatcgtgaaacggatacctggtttaaacgcacttcggccggtattttttataagaccctcaatctgttaggggtaaaactcgtccaaaaccatgctgactttcggttaatgtctcagcgagccgtcttaactctcctaaaataccaagaacgaaatctctttattcgaggcatcattccattaatcggctttaatactgataaagttttctacaaacggacgcctcgaatggctggtgaatccaaatatccactcaaaaagatgctcgccttcgcatgggacggcctcacttcattttcaatagccccagttcgagccattctcctacttggttgctttgctagctttttaggaattatcgcgttagtctactcaactgtcactaagttgctgggtctgaccgtccacggctggtcatcactcatgatctcgatttggattcttgggggcttccaaatgatcagcctcggtgtcattggtgagtacatcggtaaattaactaccgaggttaagcaacggcctcgatttacaatcgaaaagaaacttggttaactcacgatgggtaaacaaataaaactgctctcaatttttcccttaattctgatttttagtttattcattggcatgatgtccaatttgtttgaccttcataatccatcgactagcgccttagtcattttactcagtacctcgatcattctaatctattatttttatcgtaatcgtcttcagttatcacaacgtctattgaaaaaatggctagttgttgacctgagtttaattttcattattcaactactcgttcttcactttctacccgcatcaatatttcatgatccttttcgggtcctgtcacaagctgagctcattagccatcaccaatataattggtctacctccacctacttttggcgttatccaaacaatgtttctctagtgttcttactagcaaaatggatgcaattaaccaacgtcctcaatttaaccaccaatacttccctgcatctgctgtccatcatttttctagacagctttattgggctaacactattaatagctatcaaaaaggccgcccatagtatgttcagccttctattaatgttattctttttgatctcaccgtttgcatatacgtattatcttcaagttttttattcggatttgccaattttactttttctattgattacatttattattctcgaacgttgggctcggctaacgcattatcaaaaaataatcgctggcttgattttgttcattatgatgtttatcggtcagcttatcaaaccgaacttgatagtcattgttgttgcgatcggtattttcgggctcgcattacttttggctagccaaaaggctgctcggataatcataattcccttaacgattatgattatcggcatcggggcggcatttccagccgctcgcacaattcaatcagatattcactattctcaaaaaagtcaatacacgatgccaactctgaattggatttggatgagttacaatccgcaccacaagggcacttacgtcagtagcgatgttcagcgaatgaatcggcttccaaataagactgcccgcagcaactacctaaaaacagctttaatcaaacggcttcggaaattagggccgataggcattgttgcacgttggttttctaaactctggattctactcaacgtgggaaatattcaaacctcatatacagcaggattgattgaagtccctgcatggtatcgttcttggcaagaaccggccagtctcattggcgccatcatcatgcggaccgcctttacgttactttatctcaacggtattttcgcatgtgtcacgctgcttaagaagtcattcagacaacaaccatcaattcccattttggcaacaatcgtcagtgtgggctatgttgccttccatgtcttggtttgggaaacggagagccgctacgggcaagttttgctgcccttacttctgtttatctgcatatcagaaactccccaaatccaacttcccgttgttcactcattgcagttccgtcggtggcagcgactatgtctgtcctcattactggcggtatgtattggtgcgattggctttgtggtcattaactatcactcgattctatcaccccatgctcccatcattgctacccaaagtagtgagctttccatgcaatatcatactcggttgcaaacaatcaacaagggaacaaccgtctcacaaaaaattagattgacacaaccagccagtaatatagctttatttatgcccgcggccaaaagttttaatgcgcggttggtgaatagtcaaaccggtcgtcgttattcatttatttcttccaatcatcgtttccgcgtcaataggtccttatcagctggcacatacaccattatcgtcactagtcgccaaaatcataattctaatcttgaaatcacccaaactataaactatcatcttgcgccatatccgctaaaagtgaataaccaaattaagcagcataattcatttatttatgtcgtcaaaggtatcaagtcataactaaaataccctcgtgaaattatcacgaggttgttttagttatgcaatatttttaagtgctaaccgcttaacagtctttcaccagccattgattaacctggtcagccgttactacgcttcccactagaaataacgtcggtagtattttggtggtccctttaattcccttggtagtaacatttgcagcttgtcctactgatgagcaaaaaagtcctacttgttgctgagaaaattgcgtctcttgtagatatcgcgcaattggtgtcgccagtttcccattccaaacggggctaccaatcaagatccgttgatagctgcttaacgtgggggtttcaactaattccggtaattgaccagattgatactgtttaatcgcaacatcagccgttacggacatatcctttggaaaagcatctttggtgtttaattcaaacacgtctgcgccgatgatttgtgcaatttggcgtgcaatacttgccgtatttccagttcgtgaataataaattattaaagtttggggtgcactaatcatctttaccttctttttcaacctgagcagcatgctggcgttcaatttctcgtaattcattttcagtatccaccatgtgatcactaaaatgatctaacttgtagtgcaagtgatcgatagccgcttgaatgtcatctcgccgctcttccatctcggctaactgctctttcaataatgcgatttgttcattcgtattgtcctcttgtgcttcaaataactgaatgtatcgccgtaaattttcaatactcatgccagcatctcgcatttgtttagcaaaggtaattcgacgaataatacgctcatcaatttcacgattgcctaccgaacttcgatcaattacaggaattaacccttccttttcataataacgaattgctgcagacgatacaccggtccgctcactagcttctttaatattcatatcgttggcttcccttctttaatcttacagccaccagcttacaaccttacagtaacttgaaggcaacatcaaatttaaaaaaatagccagttagcataaactaactgactactcaccctattgtcgttaaaattcttcatggacggcagggtcctggttcgatgttctaccatctggccttgtcaatgaactaataatggccatctcttctgcagttaattcaaaatcaaataaactgagattttcaacctgtcgactgggcgtagtggccttaggaatcgtaatagtaccaagctgaatttcccaccgtaagataacttgcgggatactacgttgatgtgcttgtgcaattttaccaatcgtttcatccttcagcatttcatttgctcgaccaatggggctccaatcgattgttgcaatattgtgctgatcattatagtcccgttgcgcttgattattaaaatagggttggacttcaatttcgttcgcaacaggtagtactccggtctccttttccaacttttccaagtgttctggtaaaaagttagaaaccccgatcgaacgtactaatccaaagcgttgcgcatcaattaaggcttgccatgcctcaacatacaggccttgttgtggatttggccaatgaatcagatacaaatcaatgtaatctaacccagtccgtaaaaccgattcttgaatcgcctgaatagcttggtgatattcatgaaaacgcccgggtaacttagataagaccgtaatttcatcacgcggaaccgcactacgtctaacagcttcaccaacagctccttcattgtcatagttaaaagccgaatctaaaaatcgatatcctttatttaaggcactcgtcattgcattgacaccagtatacccattcagtaagtaggttccaaaaccgacttgtggcacttgattaccatcgctaagcgttatttgcggtacatttgtctgcatatcatagacctccaagttacgaattattgtatttaataaaagcccttacaaacactatagcacacatttaaataccatacattccaattaccatcgcaatcaataatattattagcacgatggttgtaatccacacgtacaagcgatcacgtgcaacataaaaggcgtagattgacaccacgacccgcaaaactggtgttaaaatcagcagaaaaagtcccgtcataatgatggcatagggctttaaacccgccagtccagccaaaattgtctggaattggtacggatgatacgtaccagaatatccagaatgaccactaacgagaaacattaaaacaccaatcaacattaccccggctgccagaaatacgccaatttgcataacctttccgattaatcgctcagcattgtgaatttcatcttttaaatctaactcttgtttattttcagtcattaaaaggtccctccaatgcccttaattagcatctgaattcccatgtaaaatagaattggtacgaatataattcgcaaaattcgtggttgaattcgctgcataattcgggttccaatcgcagcaccaaccaaaattccaagggcaatgggagcagcaatttcaggacgtatagcaccttcgaaaaagtaaactgtcgcgctggccgctgcagtaacacccatcatcaaattacttgttgcactggaaggcttgagtggcattttcatgatcgtgtccatcgcaattactttaaataccccgctaccaattccgaggaggccactggctaagccagcaccatacatcattgcaaagccaccgggaacattagtaacttgataatcgacttgtttcattgtcaatttgtcatagtatgatccgccaagtcgtaggcgttgggacaagtgatcaggaacaacgtcttgatcggtatccagctttttctttccccataattttttaatcatgttgtagcacgagtatagcaagaagcacccaaacaatgcctctagccaaaccgcatggattaatccgactaggaccgctccggtaattgcgcccaccgtcgttgcaatctctaagaacatcgcaactctcaaatttaatagttcatcacgcaagtacgcaatagttgcccctgaacttgttgcaatcacagcgatgacacttgccccgatcgcatacttaatcggtaatcccattccaacagtgatgataggaattacgatcatcccaccaccaattccaagcaacgatcctgccgtcccagcaaagacccctaccaataacagtaacagtgcggtttcaagcaaaataagaccttccttctctatttttccctttctttacgcctctcccattgtacttgcaaatcttcaaaaggacaataaaacaaataaggatacgacgatccgcatccttatttgtttaatcttaactttaattattgccaatgccgttgaataaattgatttcggccaccattttcttcggcttcatgacgtttcggatctttcttatagaaatcttgatggtagtcctctgcttcgtagaacggctttgcatcttcaatttgggtcacaatgggctctgcaaacaaggcactatcaattaatttttgccgtgaggctgtcgcaattcgccgttgctcatcactgtttacgaaaatcactggtcgataattatccccacgatcttgaaattggcccatcgcatcagtcggatccgtttggtgccagtatatttccactaattgttcgtacgaaataatagcgggatcaaacgtgattttaacagcctctgtatgaccagtagtatgactcttaacctgttcataggttggattaactgtgtgaccaccagtatacccagatctaacactcactattccaggctgtgtatcaaatggttgaaccatacaccaaaagcaaccacccgcaaaaattgctgtttcgtaagccattttaaaggcctcccttttctatgatggaatgggtaaatcaaaatggcagtccaacaactgtcggactaccataaagcattcattaaatttatgcaaaagcatccgttaatggtggtacaacttgtttcttacgagataccaccccaggaagactcatccgattttgatcattaagcttcttaccaaatgcagcttctactttatcctttggttcgccaacaaccagtaattcagaattgctgttaagaatgtttgttgctaaaagtaagaaaatatcatagcccttagcatcattttcatccttcattacggtttcaagtgcatcttgacgtgaaaagacatcatctaaatcaacagtatttacttgtccgacacgaacttgcttgccacctagttcgaatgacttagcatcaccatcaacaagttcaagatcagacttacttgccaaatcagtacctgcttttagcatctctaaaccataagtctcatagtcgacgtctgcaatttgagctaattctttaactgctttttcgtcagctggtgtagtcgttggtgacttgagtaacagcgtatccgaaataatagctgataacatgaggcccgctaagttagctggaatatcaattccattttccttgaacaagtccaaaataatggtacttgaacaaccaactggccgtgcagtataccaaagtggttgggctgtattaaagttggcaattctgtgatgatcgacaacgtgtgtcacggttaaatcagcaagatcgctcacgctttgttgtggttcattgtgatcaaccagcataacagcatcaacttcgttaccggcttgttcaatcacccgtggtgctggttcattaaagtgcttcaaagcaaattgtgtttcagcatttggttcgcccaaggcaactgcctcagtatcataacctaatttattttggagatatgaaaatgcctttgccgctacaatggcatccgtatctggattttggtgaccaaaaactaactctttactcattggatagtctcctcctgcaataatatcgtcacctacttttgttcggcttcatcctgttctgccttcacgatgtcatcgatacgttgataataatcacgttcttcaaggaatccatcaaattcttccaagaattgtgcaatccgcggaatttgatcctttgccgtccgataaacaaatgaaagattaaacttaatttgcggctcaaaagtagctgtcataattgtatcacgatcaaaacgtgaaagaacataactttttggtaatgccgtataagaatcagtttctttcatgaaccggtagatttgcccaggctgtgtaaaccgggcaataatatcaggttgatcaaccatttgatttttataggcttctttgaccatttgatcaagataatagccaaccggataggttacccacggatgatccagcgtctttttaagcttgatcttctttttgccttccaattctgcatcatgatgaataaagagtagatcttcactcataattttcttggaatcgtatggcttccagtttttgatactatcgtctggtaaatacataatggctaaatcgatttgattgttttccaagccatcccaaatttcttttctggttaacatatggaatgttaaatgaatatcgggattagccttatagtaacgaatggcaaactcctctaatacttgtgtttcaattgaagccagaattcctaaatgaatttccccatgattagcactcgttgcctgttggatttcatcggttgcttcattcaacagatcgtaaatattgtgcgtcgtcttaagcatggtgtacccggcatctgacaacttaagtttcttacccactgaataaaataatggtgcacccactgttctttccagttttttaatttgttgggtcagtgctggctgtgtaattcctaaaatttgcgctgcttgggtataattcatcgtttccgttaattgaaggaagtatgtcagggtttttgatgaaaaaatactttcttgtttagtcttcatgcagtttactttcctttcagttcttatcttttctataatcattaaatcatagatttattataagtgatgagagatcgatttacaaagaataagcgtaaattaatcaacgtaatcagtttactacacttaacctaaagaaaagcgaaaaaaatatataaaaaatgtgatgaatttattaattttatttaaacaaccaattgtaagagtttacgccgcagcgaaattggcaacccctgggtatcagtatctaatacaaaagatccattcgaataccgtgatcctaacggatgatcgtttgtaagaacgtcttgaatgattggacggtcagtaataatctcaagggcaccttcaaacgaagctggataatcgataaaatctgccactcgatgaggattagtttttaattctctaagaatcaaaacacccttccgtgcccgtgatgttgttggaatctcttcgagtttcatctctttgtacgcaccacgagtagtaatcaaggcaatattatcaccttcgtcacacaatgccatattaacgacacaatcatcatctcgtaagttcatggatttcacaccagccgtacgagcaccgttagttggcacttctgccaaatcaaatctcagtgctaatccagtatagctcatcagcaagacagtttgattaacgctgtttggtcggtaataagtcacatttagaacaactgacgtttcttgttttagtttaatatacgtgcttggatgtttcttatagtttcgtccgggcagataatccttaaaagcagtttgcttaatatagccatcgttggtagccatcaagaatgtaccactttccttctctaaatcatcgaaggtcattgccttaataattcgttcatcatctgctaaaccaatagtctgtgaaatgtgttcaccggtgtctttccaacgcgcatctgcaatttcgtgcacagggcggtagattaaatgcccccgattagtgaacaaaaatagatgtgataatgtattcgacttagccagtagaattggataatcgtcttctttcaaaccgttatcatccgtatccgaagcactataagaacgcgtactactccgtttaatatagccatcgtgagacacaaggacaaccacatcttcgtcaggtaccaatacttcagtatcaattttaagttcctgaacctgttcttcaactcgcgttttccgagcatcaccaaactgtttttttacttgtagcagttctttttttacaacctgtgccagtttgcgatcatcgcccaaaatcgctttaaatccagcaatatctttttctaaccgcgcttgttcatcttctaattcagtcacgtctgtattggttaaccgatacagttgtaaggtaacgattgcttcggcttgaggctctgtaaacgcatactgagtaactaaattctgctttgcatcttttcggttcttgctagctcgaattgtcgcaattacctggtcaagaattgacaaagccttgattagaccggcaacaatatgtaaccgtgtctgtgccttatcgagatcaaacttagttcgcttagtgataatttccttttgaaaggccaagtaagcctcaaggaatcgtttcagtccaacccgttcaggccgtttatgatcaatcgccaccatgttgaaattataattaatttgtagatcagtattcttgaataggaaattcaaaatcccctgtgcattagcttcacgttttagttcaatcgcaatcgacagaccattacgatcagtttcatcgcgaacttcagcaattccttcaacttttttcatgatccgcatttcatcaatacgtttaacgagttgtgccttgttcacttcatagggaatttcggtaacattaatttgcgacttaccgccacgcaattcttcaatgtttgtctttgcccgaaccacaattcgaccacggccagtttgataggccttcttaattccgtcaattccttgaataattccgcctgttggaaaatcaggcgctggaataaagtccatcaactgctctagtgttgcatcatgatgggttaataaataaattaaagcatcgacaacttcggctaggttatgcggtggaatatccgttgcatagccggcagaaataccggttgctccatttaccagcaaattaggaattcgagctggtaatactgtcggttcatactcggtatcatcaaagttaagaaccatttcaaccgtctttttgtcaatatcttgcagcatcaacccagcaattttgctgagccgcgcctcggtataccgcatagcagccggcggatccccatccattgaaccattattcccgtgcatttcaattagcggtgctcttagtttccagtcctgactcatacgaaccagtgcttcataaatagaactatccccatggggatgaaagttacccatgacatttccgacagacttagccgacttgcggaaccctttatcgtacgtattaccatccttattcatagcgaataggattcgacgttgaactggttttaatccgtcacgaatatcagggagcgcacgttcttgaataatcgatttcgaatagcgaccaaaacgatcacccatcacgtcttccagtgttaattcctgaatttttgattcactcactagcgctacctctcttcatttttttaatttcgttttgatccattgaataaatctagctgatcatcttggtcattccaggtactaatggtcggttgttgagacgttattgttgtttcttcggcagaatcagtcgttgctgattcctgcttatctaaaatactgtcgtcttcctccatcgtaaattgaacattgctttcaatccatttacgacgtggctctaccttgtcacccattagcgttgtcacacgccgctcggcaagtgcagcatcctcaattctaacccgaatcagcgttctagtttccggatccatcgtggtttcccatagttgatccgcattcatttcgcctaaccctttaaaccgttggagacttgagcccttaccaaatgttttagaaacctgagctagttcttcattggtccaagcatactcaatcctggttttatcaccgcggcccttctgtaatttatacaggggcggcagtgcaatatagattttcccggcatcgatcattggccgcatgtacttgtagaagaatgtgagtaataaaatttgaatatgagccccatcatcatcggcatcagtcataataataactttgtcataatgtgaatcctcaaccttaaattcggaaccagcaccagcgccaattgtgtaaatcatggtatttaattcttcattttttagcacatcatccagcttagccttttccgtgttcaataccttcccacgaagcggtaaaatcgcttgaaaacgacgatcacgaccctgcttggcagatccaccagccgaatccccttcgaccaagaaaagttcgtttttcttagcatttttagactgggccggcgttagtttacctgatagcaaccgttcctgcttgctacgttttttaccactgcgggactgatcacgtgccttacgagcggcttcacgagcttcgcgggcacgcaaagacttacgaatcagcatttgtgcaaattcgccattttccatcaatgcatagcctagctgctcacttatgactgcatcgacaatctttcgtgcttcgggtgttccgagtttatccttggtttgaccttcaaactgtagaatacgctccggaattctcactgaaataacggcagacagtccctcacggacatcgctaccttccaaattacgatccttttctttcagtaagtttaccttccgtgcatagtcattaaacgttttagtccaagcacttctcattccggcttcgtgcgttccgccatccggtgttcgaacattattaacaaatgacaagacattttcagagtaaccatcattgtactgtgcggcgacttctacctcgacaccatctttgtcgccatcaaaatataggacgtctcctaatgtatccttgtcctcattcaagtattcaacaaattgtttaattccttcatcgaactggaaaatctcttcttgttcttgtcccacacgtttatccgtcaacgtaatcttgacacctttaagtaaaaaggccgattctcgcaggcgttcggcaagggtctgataattataaacaacggttgtaaaaatcgtcgcatccggtttaaatgatacccgcgtaccattaggatcccgtgtcttaccgactttttcaagggttccgactgggtgtccaccattttcaaacttttcctggtatttaaacccgtcacggacaatggtaagtgtcaaatgctccgataaggcattaacaactgacgcacccacaccatgcagtccaccagacgtcttgtaaccatctgcttgaccaaacttaccaccggcgtgaagtaccgtcataatgacctcagcggtaggaattccagatgcgtgcataccgaccggcataccacggccatagtcttgaaccgtaattgcattatccgcttcgatgatgacactaatttcttttccgaacccagataatgcttcatcaacagcattatcaacaatttcatatactaaatgatgcaatcctcgggcatcggtagacccaatatacattccgggccgttttcgaacggcttctagtccttcaagcacttggattgatgaatcatcataatttgatttctttttcgccactcaaaaaactccttacttcagcaaaatattatttcatagtacgcacgccttaacgatacagtcaacagttcattatatacgcatttcaaaaaaatggctaataaactacaacgttaatccttgatttgtccgcgatccttgcttaaacactaaacaatcataccgaaaaaaacagaacttgcaacccttttaacaaggtctgtatttgaattttaagacgttcatgttatgatagttgggattaaatttcaaggagccgataatgaaaattgcaataatgataataatcgcctacctcctgggttcaattccatcaggcgtctggattggcaaactcttttttcacgaagatattcgtctaaaaggaagtggcaatattggaacgactaacacattccgggtactcggtaaaaaagctggaatcgctgttttattgattgacattcttaaaggaacacttgctgccagtcagccctatctatttggcatgtcacatgttaatcctttggtcattggactttttgcttcgttaggccatacctgttccatcttcgatcattttcacggcggtaaggccgttgcaaccagtgccggtattcttctggcctataacccactgctatttttaatggccagcacgttttttgtttcaacattgttattaaccagcatggcgagcgccgcaagtatcattggcattacgctcacaacaatcgttgcactttttttacaggactggatattagcgatcattgccggtatcttgtcaattgtcgttatatggcgtcatcgctctaacatttcccgtatttttaatggtaccgaatcaatggtttcatttgggttaggaaactacttacgacataaaaagaactcataatcactaacgaccggtactcaacgtatcggtcgttttttatttcattaaaaaggggttattctgtactgcatttgttgggatgcatgactcgctaattgatgaattgctgctttttcatttagtcggccactcgcattaatctggtcagcaattccccaccatggttcaatgcagataaacggtgcttttttgggatatggtgaccagacacccacatatggtgcgtcatccaggaatactttaacaccatgattatcttggctattaagagccagttcaattgcttgtccttgcagatccaaaataagtgcatcattgtcaaacatctcacgttttagctcaagaggctgcgttaaatcgagtttttggggatgctgaatatcactatatggaccaattaatttaacttgatcataaattcgctgtggcgtgactgacagacgcacatgatctagttctcgattttcgtccagtgacacgttaaatgctggatgagcaccaatcgaaaaaaatagttcatcttcacccggatttgtgatctgatacgaaatggtcaattcatcagccttcagttgataggtaacgcggagtataaattcaaaggggtagttatcaaattgatgcattgctgacgtaagttcaaaaataatctgtgtccgattcttctcaagcaccttgaactcgctctcacgggcgaatccgtgttgatgcatcgtgtaggtttggtcctgatgctcgtattgatcattttttaatcgaccaactattgggaataagattggtgcgctgaaacgccaatacgttggatcaccagaccataaataatcgcgaccatttttttgatcttgcaggcggattagttgtgcacctgtttcactaaattcaacatgtaacttttcattattcagttctatcatcgtctacgttctcctttttagctcgcggaaaatatttttgataatcctgttgaagatgttcccgagtaacatgggtataaatttgagtcgtcgataaactcgcatgaccgagcagttcctgaacactgcgtaaatcggcaccgttatttaacatgtgggtcgcaaaagtatgccggatcatgtggggatgaattttggttgttaaactgctctgcttgatgacctgattcaaagcatattcgatcccggtagccgtaatttgcttaccataatgattaataaaaacatagtcatgatcttgctgataccggttcattaagggcgtccggcattgttcaaaataggtttgtagggctgccttggcatagtgtccaaatggaatatagcgttctttatcgcccttcccagtgaccaacatcatttggacatcaaaatcaacatgatgcatggttaaatcagcgcattcactcacccgcataccagtcgcatacaggacttctagtattgcagaatttcgggtgtctagcggttttcctgttcccttggcggccttaaacagggcatccatttcctgttcataaaagaaccggggtaacttttcttggtgccgtttaaggacaatattgctgaatggattgccaccaaccaactcatttttattgagaaaattaaaaaaagatctcaaactagaaattttacgtgaaattgtacttcgttgatactgcttctcatttaaataagtgagatatacacgagcatcaagtttatcaatatcttgccattgcttcataccaccattttccttcaaaaatgcttcgaagtggtgaatatcttccgcataggctttgactgtgtcctcagaatattgccgctcaatggtgagatattttaaaaataatactactaaattttctgccataaaaaagcccccatagtctgaaactaacagactatgggggaaatttcaatttttttaggctctatttttgaacggcttcttcgtagtcgccatttggacagacaatctgtttaccgcctttaaccttcttttcaaccaagaagtgcccatccttagggcaatttcggccgattggtttgtcccaagaaacaaagtcacaatctgggaaacgtgaacagccatagaagacgcgattcttcttcgatttacgttcaacaacagtcccctcatgacattttggacaggtaattcccgtatccttgacgatcgcttttgtattccgacaatcggggaaacgtgaacaagcatagaactttccgtaacgtcccatcttaactaccatcggtgcgccacaaatttcacaatcgattccggcaagttcatccttcatctcaattttttctacgtctttttcggcctgatcaacttccttagaaaatggtttgtaaaactcatcaactaccttaacccaattttgcttaccattttcaatttcatcaagttcatcttcaaccttggctgtaaatttcacattaacgatatctgggaattgatcctcaataatcgtattgacaatttcgcctagttcggtgggttcaaaccgccgtgctgtcaatttcacatagtaccgtcgctggatcgtatctagcgttggcgcataagttgatggacgtccaacaccattttcttctaacgccttaattaaattagcttcagaatagcgtgctggtggctgagtgaaatgctgactaggatccgtcttaaccaattgcaccatgtcgccttcttgcaaatcaggtaaaacattgtccttttctttaccagaactataaattttagtaaatccaggaaatttaatttttgatccgttcgcccgaaaatcaacatcgttttgcgtaattgtaactgtcattgtgtccacaacttgtggtgtcatctgacttgcaacaaatcgcgaccaaactaagttgtacaacttgtattgatcgttagtaaggtactgcttcatttctgcaggtgtccgaaatacagacgtcggccgaatggcctcatgcgcatcttgcgcaccttccggcaattttcccttaactggtttagttgccgcatactcagccccatacttttcatgtaggaactgtgaggcttcatgcttcgcaatcgatgaaattcgcgttgaatcggtacgcatataggtgattaaccccaccgcaccacctttgccaatgttaattccttcgtacagttgttgcgccgccatcatcgtttttcgtgttctgaaattcaatttacggttcgcatcttgttgcatggtagacgtggtaaatggtggttgcggtgaacgccgccgttcctttttgaccaccttagtgatttcaaaatcacccttacggtctaactgccccaaaattttttgaacagcttcattatcggacaggtcctgcttttttcctgcaacaccataaaatgcggccgcaaatttactacgtccctttttaaactcggaatcaatagtccagtattcttgtggttcaaatgcttgaatttctttttcacgtttaataattagattaagggccacagattggactcgcccagcactcaatccttttttaacttttttccataaaattggactaatcgaatagcccactagtcgatccaaaattcgccgcgcttgttgtgcatctaccaaatccatattgatactacgaggttctttaaacgcctctttaacggtatccttggtgatttcattaaacgtaactcggttcttaccattggcatctaattttaagatattagaaacatgccatgcaatggcctctccttcacgatccggatcagatgctaaataaatttctttagcatttttagcatccttacgtaattccttgatgacatcgcccttaccacggatggagatatagtctggttcatagttgttttcaatatcaacacccatccgactttttggtaggtctcggatgtggccaatacttgccaccactttgtaagtacgtccaaggtacttttcgattgttttcgcctttgatggtgattcgacaatcactaattttttcttagcctttgctctcggtttcgctttacgtgctttaggcttgctcgtagatttttctaccatcatcgaactccttaaaaatgacataatgtctattgtacgttaccgtaaatatctcaaccatcttatttcaaaaaaaatgcgatgtcaaatgcaatccactattttcgaaactctaggagcaaatcttcagctgtcaaaaccggttttgcgccggctgcaatgagttgattacaccccactgacatcgaatcagtaattcgacctggaatcgcacatacgtttcgattttcctgaacacaaatactagcagtaattaaactgccgcttttttcttgggcttccacaactaatagtgtttcacataatcccgcaataattcgattccgttctggaaaatgagaacggtagggacgagcccctaatggatactctgttatgacgagctgtgttcgcgccatttcggtctgcagtgcttgattttgtgtgggataagaaacatctaatccggttccaatcacaccaattgtacgtccgtgattttctaacgcggtcatatggctaaggccatcaatcccggttgccaaaccgctaactaccgtaattgaatgctggataacgcctggtaaaatgcaccgaatactctgtgcaccatacctggtattttttcgagcaccgacgactcctaacatggtcgactttaataaaccaatatcaccagcatagaataaaactagcggtggacaataaatttctcgtaattgaagcggatactgttcgtcaaaaatggtaataaatggacattgcttgatgtgctgttggacctgattatttaatgtttgactatgccaactcgtcgtaatttgcagcgttttatgctgcgtgagtccagctaactgacaaatatccttgatattaccgtgaaatggctgatcaatcattgcctgatagatttgaaactccgttttaattccaacaccctcacataaatgaagcttaagaataaattctcgaacgttaataaaaacacctcctacctatttaaagtacgagatgttttctaaaaatcactgatattttttcacaggtgaaaaagaaagtcgatgaatcggtgtaatgccttgcgtcctgagtcccgcaatatgtttctgagtaccgtatcccatattatgtgcaaaatcatatccgggataaagttgatcgtacaccgccattaaatgatctcgatattctttagccacaatactggcggcagcaacgctaatactcttctgatcacctttaattagggttgtctgtggaatatcaatttgcagcggtactgcatccacgattaattgacccggatggtgctgcaagccattaacggattcaatcattgccaactgtgtggcgtgatagatattttctcgatcaatgaagtggttgtccttaacagcaatattaacttctactgcttcatgaataattcgtagatacaattgctctctctgatgagcacttaactgcttagaatcagtaacatccattaaatcaaaatgatcgtcaatgatgacagccgctgtgaccaccggaccagctaaagggccccgaccaacttcatcaatgcccgccacatattgaataccgctttgccaaaactgcttttcatacataaatcgatgttcaaacgacttgcgacgaactaattcttgctctattcgccttttaaacgcggctagcgtagcttgaacaccctttctagggtcatcatccaacgagcaaacaaactcgctctcaaggcttgtctcatcctgtaatcgcattctaatttctttaatggttagcctagtcaacttctgttgctccaatcgtatcagctggtgattccaacgataatcgaccaagcttgccctttcgaaaatcaaagatgagtcgttcacttgcccggtcatagtcatctttaaaccctaatttagctgtaatcgccaataagacgtcagcatcactagcttgttctgacatatctgtttcggaaatatgataacggtcaataattgtctctggatgaacggttcgtaaatgccgaattgcaaacaaggccacatcgtctttaggaaataagctatccttaattgttccagatagtgccagtttgaccccaatttcttgcgtttgaaacttaggccacagcacgccaggtgtatccagtaactccagatctgcagataatcgtaaccattgctggccagtcgttacaccaggacgatttccagtcgtcgccacatttcgatttactaggtgatttaatagtgttgatttcccaacattcggaacacccacacacattgcccgaatagcacgttcctgcatacccttttgctgctgtgataaccgtttttcttcaagtacagcttgtgcttttttagtgaccaaacttgcgactttacgatcacgtgagtcaacagccagtacaggctgtccatgatgttcaaaatattgaatccatttttgtgtgacacctgggtcagccaaatcaagtttagtcaagattaacagatgtggtttatctcccattgcttttttcacttctgggttaagggatgagtatgggagtcgtgcatcaaccaactcaaaaacaatatcaaccagcgacatttgttcacgaatttgtcgtaaagctttcgccatatgtcctggaaaccattgaataattgccatgttaaattccttcctagttcattttttagatacagtcgtcaataaccagacgccgtactttcttatttctaccattataatgcacacactagcatacacgattattttttgtgaggcaatggtggagctgctccagcatttttatgattgctactccaccactactactttgtaattaacagcaggtcaaaacaatgggcattgctcctagtcatagataactaaatgcactgtgtagtactctctgtcactaatcaataatatcaatttgccaccgtttctgataaaccatacccaataatcgtctggccataaacagcttgtttttatttacatatattttcgctcgtagtacaatgtattacaccaataggaggcgcatattatggcaatgatcacagtacgagtgtcagacgacgagaaggaatggctacaatatatggccgacttctatggactaactctatccgatttgataaaaaactactcaatggatcaactcgaagatgaatatgacaagcaaactgctgcaattgcaaaaaaacgctggggcgaagataaccataaaactgtatcaatgaatgaaatcttagatgagtttggtgatctagattgagctacagattagaattcactcgcgaagcgcaacgttcacttcgtaagatggacaaacatcaagcaatactcattactcgttggttataccagcacgttgatggtgttgcagatcctcgatcatttggtaaaggactcaccgctaatcgatcaggcgaatggcgataccgcattggcaactatcgtgtcatcgttgagattcaagatgacagattagtcgtgttagcattgcaaattggtcaccgccgaagtgtctatgactagtcacctaataaggtggctatttttttacacaagtatacgggcaatataaaccagaaacctccaatctaccggttgcaatcaattattacaatcaaccgtttgttagaccctaaagctattaaagccaccctaataaaaatctgaaacctaaaaatccacacctcattaactgagatgtagatttttttggagcaaaattgagactggtaaaaaaattgtataaaaatacaagctacaaacaattggtataccagcgtttaaactaatctagttcattttttcaagataccactgccaagcggtatcaaaaactgtcattgatggtaaatagagtgcattttcctccaagtagtgcgatatttcgtcaaaatcttgagattgttttggaaacgcctgatcaagcgcagcgttatttgcaaactgttcaacctcattggcaccacttggattcttttgtgtcattaaatactgataaaagcttagccgcattagtcattacctccatcaagtttggggacggtaactaaaaatctaaacgttccctgttgtaaattaatttcttccgccgaataatgtaggttacgatgtttactatacttattcatatcaagtaaaattgtcttcttcttctgattcaatttaacccaatttggcagtttataatgatttttaatatagcccatgacatacttaatcggaatattcaaccgaccgactgagaggcctttggcattcaataacacattaccatcactaagtcgctgggggatgaaattcaaggcaaaattcaacttaaaccccaaaaatttcgtcgatccagtgatcgtagcatattttttgccaacaacaaacttatactttgttttttcattcttttgtaatcttgttagataattggcggccaatgcattaacctgggtagaattaagcttaacttgaaacgaagaattactcgtcttcaatggttgcaccgtcgtttgcttctcaactggtgcactaacttgatgaacgacgtagccggtgcttccaacaattagtaccaccaaaataataaacgcccatttccaccaattatgtctcgtttttcgattattttttcttgtctcggtcacttctactcattaccctctcttatccaactaatatgatgttgcatcgttttaaacaattgatcgctcatcttgatataacctaaatggttcggatgaaaattatcatcagttgaaatatagtcattcagattatgatttttctcgctcattactttaatggcctgcttctgactagtatcacctgtattagcttgcttatcttgtttaatcaactgttgctgagcctttttagtcgtatactgaccatgcgacataagattattaatatcaacgaaataggatggtccgtaattattcattttttctttggttacttggttccacgaatttaccgatgctgttatcgtgtcaacattggcaaagtaaacgtaaaatggattatagacactgaataagaaaatcggtgcctgaggattatagtgacgaaccgctttgaacaatttggttaatttggtcacatatttttggttagcctgattcatattacgagtaaactcgctctgatttgcaacgaaaatgtttttttgcaatgattgcattaagtcattaccaccaacggtcataacgatcacatcagccgattttaacttcgattgaaaatttttttcactctttaagcgactcaaaatttggtcagatcgatccccagcgacaccgtagttactagtatgaaccgtggtattataatttttttcgattttacttttaataatcccaacgtaaccgccatttttcttttggtcaccaacaccctgtgtcaaagaatctcccaatgcgattaaattaacgttctttttaatttgcgttttcttatgaactagtggtgccgccttttcagttgactgccgtgctgggctttggtgctgttgccacagtaacagtccgccacttccagcagcaagtaccacaattacgattaaaattttgatcactgcttttcgcaaattaaaaactcccaacgtattaagaaaggctgccagcaaataatttgcgtcagcctttatcattaaaattcatttattcagtgtaataaagtaggcaaaatgcacccatacccgtatgtgtggcaataattgggacagtttctctgacaacaatcttgatatcagggaataacttctccaatgtggccttcatcttggccacctcttcgtctgcctgaacatgtgaaataccaatggctttgacttttctaacaccactttgcattttttcgtagacgtcatctaaatacttgtggattggtttaagaccgcgccctttaagacggatcttaatttcaccatctgttacctcaagcattaccttaatattaagcaggttagacaaagctcccgccatcttgctaattcggccaccggctactaagttgttcaaatttacaacggctaaataaatttccgaatgttcgcgaatatcttcgagcttttctaaaattgcatccatctgggcatttgcttcaatcatcttagcggcttcaatcacttggaacgccaagcaacgatcagtttccttactatcaacgaccgttacttttgttttagtgattgcagcggcttgctctgcggcatgtactgtaccactaattgattccatcattgtgagacacaaaacttcactaccatcttcacctagccgatcaaacacgtccacaaatttaccaattggtggctgtgaagttttaggcaatgattttgcattcttcatcagttctgggaattgttcgttagtaattgtttcacgttctacataaattgtgccatcgatcataactgacaacgggacgatcgtgatatcatatcgtttgatttcatcttcggttaatcccgctgaggagtcggtgacgattttaatattcgtcataatttgaccacgctttctcataaagtaataatgtgttatactgatctagtcttgaagactagatcatataatttaattaacttactaacgaatagtagttaagttaagattgaaagtcaagacacaaggttgaactactttcgcacttagtatagcaaaacaacggcttaatttcattgtaaatcgacaataattaacaaggagtttattttatgcaaccacaaaaaacaaaacaaaccatcgttatcgaaattgccaacaccatcactcatggtcttggtgttggcctggcaatcgccggcttagtcctactcatcattcgtgcagcacatactggtagcgcaatccgaattgtttcattcacagtctatggaagcctgctcgttttattttatctcgcatcaacaatgttccatgcactcgtatttacgaaagcgcaccatgtttttcaggtcttcgaccactccatgattttcttgctaattgccggaacctataccccatattgtctcgttagcatcggtggctggcaaggatggacactatttggcatcatctgggccatggcggtctgtggtgtcgtttataaaagtatctggctcaatcgcgttagtatctggtccaccgttatctacatcatcatgggttggctctgtttactagccttcaaaccactgtggactagtctaacacctgtcgggttcttcctgctactcagtggtggcattttgtttacccttggcgcattggtttacacaaaacccaatgcatactcacaccttatctggcactttttcgtgcttgccggcaccatcaccatgtacttctcaattttattctacgtctagtttacaccaggtctcaaaccgataagccgcttcatttttttcatctgcctcaaagtgatcggatttaaccagccgccaattgcgataatcgattggcggcatttttgtgtcgcccttgtaagatttttcaataactgttctaatgagacaattaacaatcgcttgcgttgattcaaatacctttgcaccgccaataatataaatatcatcattagtgttatcgattagttgttgcaactctgcaactgaccggacaacttcaataccgtcttggactggcattgaagttgataaaatcacattgcggcgcttaggtaatggtcggtgcatcgaattaaatgttgtttttcccatcaccacggtatgcccaattgtaacacgcttgaatcgcgccatatctgcaggtaaatgccacggcaaatcgccatgatttccaatgtagccatttaactcttcagcccaaacaaatgcgatcatttagctttcctccttgactagacggcaacaggtgccttaattgccggtaatggcttataaccttctagtttaatatcactcacttcataactatctaaagcctttgtctcactcggtaaaatcaatttaggtgcatcttgtggggtgcgcgctaactgagtctgtatttgttcaatatgattgctgtaaatgtgggcatcacccagcgtatgaacaaactcaccgacttcaagaccacactctttggcaattaaatgcgttaataatgcatagctagcaatattaaatggtactccaagaaagatatcggcacttcgctgatataactgacagctcagtttgccatccgctacataaaactggaataacgtatgacaaggcggtaaggccactaatggcacatcttcgggattccatgccgtcacaatcaaacgccgcgaattaggattatgcttgatttgctcgacaacatcgtgaatttgatcaattgactgtccattgctagtttgccatgctcgccactggctaccgtacacaagtcctaaatcgccgtatttttgtgaaaattggtcatctgctaaaattctttcacaaaaagctcttttctcagccaaatagatttttttgaactccggatcagcatctgctcggagtccaaaatcagtcatatccggtccttggtactcatcactagaaacccactttttgaacgcccactcatcccagatatgatttttgtgttgcaacaggaagcgaatattcgtgtcaccacgcaagaaccagagtaattcactcttaattaatccaaaggcaacctttttcgtcgttagaattggaaagccttcgcttaagtcaaaacgcatttggtatccaaataatgattttgtcccagttccagtacgatccatcttctcgtgaccatactctaaaacatcatgtgccaatttcaaatactgttgttcattactcgtggttgtcactgtattgtcctcctacctattctgcgtattcactgaggtattcccaacgttcagttttgtcatcgatctgttgatcaagtgattccaactccgcctgcagtttagcaagtttatcatattgatcgccattttcttgcatttggccttgaatatcttgctttcgttgttccaattgatcaatatcatcttcaatcgtttcccattcttcttgttctgcataggttaacttggtcttttcttttgctggcttttcaaccactggcttctgctcatcatcagagttcccctttttggctgatgttgctcgtgattgttgattcaactggtctaagtaatctgtatacatacccgcatagggttcaatatcaccctgaccattaaaaataagcagccgatccgcaactttgtccaaaaaataacgatcatgtgaaactgtaattacagttccattaaacgaatctaaataatcttcaagaactgtcaatgtaccaatatcaagatcattagtcggttcgtctaacaataatacattgggttgcatcattaaaattttaagtaggtataatcgacgtttttcgccacccgaaagcttacgaatgagcgtaccatgcataaatcttgggaacaagaatcgttcgagtaactgtgtaacattaatttgaacaccatttcgatccgtcacactttgtgcaacttcactcaaatagctgatcatccgtttatcttcgtcaataggctctgtctgttgcgtataataaccaattttgaccgtttcaccaattttaacagttccactatccaatgaaagctttgatgccatcacattcagtagactagatttcccggctccgttttcacccgaaattccaattcgttgaccggcctgaacaagaagactgaaatcattaagaatttgatgatctcccagtgtcaaattagcatggcttagctcaataacatcttttccaagtcgttgttgaccaagctcaatatcaatattttgatctacctgaaccttgccaatagagtccttaagttcattaaaatgattaatacgtcccttttgcttagttgaccgagctttggcaccagttctcatccaagctaattccttttggtatagctgctgttgtttatgctctgtatctaactctcgctgaactcgttccgccttttgtgaaacataatcttgataatttcccgtgtactgatatagttctccgaacgataattcccaaatttggttagcaacttggtccaaaaagtaacgatcgtgggtaacaacaatgacagcccctttgtaggtctgtaaaaagtcttgcaaccaaaccgttgaatctagatccaagtggtttgttggttcgtcgagcaacagtagatctggttcctgaatcaagatttgtgccaatccaacccgcttcttttgccctccggaaaggttaacaattttctgagacatatcagtaattttaagttgcgttaagatcgtcttaattcggctttcagccgcccaggcatcttgttgatccatctgtgcctgaagcttcgtataacggtctaataaacgagtatcatccggatgttttcccatatcttcaactgattgttcatattgccgaatagtctcaaatacccgctgagtccccgcaaaaacagcatccaaaatcgtcagttgatcattcaattcaggttgttgcttcaaatacccgattgtgtagtcattaggcgcatcaaactcgccactttctgggctcacgataccactgattacatttaataaagatgttttgccactaccattcgtcccgatcaatccaatccggtcgttttcgttaatgataaaggaaatatccttaaataatgttttttcgccgtaggtactggttaaattatcagcacgtaatgtttgcattctctcacactttcgctatgttttttgcttcttcaagtaacgactctaatttattctccatttcaccattaaccaccgctgtctccaactgggtcaaaattgtaccaatcatcggccctggcgttaagttagcttgcttcattaactgcccgccgttgatcgccaattgctttttcgatttaatcggcagttggtcgtattgctcaagtagctcaggtgtatcaatttcgccaccaaacagattggcaattttattagcactcgctaaccgctcacgcccggtgtgatataacaatagcttcgatggttctccttcaagtaacggactgactgcactcacgatggcctgagtatcttctaatacctgattagatgtcttccaggccttcaaaaacgtagtcacttgctttccttgcaggaaaaaagcataactcagcaatgaccaaacttctgtttcagaactcaaatgccagtcgtttaacgccaatagttgtgtcaacccgctcttaaagtgagctagcatgggacaatactcgtacagatttgtctcgatcagagcactgattccatttgccggattttcaccaagtaataatttttcaagctcaacacgagttcgttcgactgcaattttactcagcagtgctgcattttcttgaattccggccaacgtttttttctcaattttaaaatccagttgactagcaaatctaatcgcccgcatcatccgcaaagcatcttcgtggaatcgttcttgtggtgttccaacagctcgaatcatacccgctttgagatccttcaaaccgttaaaaagatcaataacggtcccatcttctttcattgcaagcgcgttgattgtaaaatcgcgacgttgaagatcttcttgtaatgagcgaacaaacgtaacttcatcgggtcgtcgaaaatcttgatagccagattcagtacgaaaagtagttgtctcataccctttaccatgatcaagtatcatgaccgtaccatgttcaattcccgtatctaccgttcggtgaaaaatttgtttgatttcttctggataagcactcgtcgcaatatcaacatcatgaatcggcttatttaaaatcgtgtcacggacactgccgccaacaaaataagcctcaaagccagctgcttcaatctgttgcatgactggtcgtgcctgttcaaattcctgtggtaattttttaataatcatagaacgttctcaagtccaaccaatagttcgtgatagtcagtaattttttcgattgcaatagcaactccgctcataaatgattctcgatcaaatgtatcttgacggattgttaatccttcccctaatgacccaaacatcacttgctcatgggctaccaatccagggagtcgtaccgcatgaattcgaataccatcgaaatcgccgccacgaacatgggccagcgtttctttttcattaggattaccttgttcgtgggaaggacgcaccttacttatgagcttggcagtactcaacgcagtaccacttggcgcatcgactttttgatcgtgatgcatttcaataatttcaacatcgggcatatatttagcggcttgctgtgcaaattgcattaacaaaactgcactgataccaaaattaggtgcgatcaaaccacccaattttttctcagctgccaattgcttcaactcactaatttgttcatcagttagaccagttgttccgattactggtgagtaaccatggttaatggcaaattttgcattttcataaacggcacttggtacagtaaaatcaacccaaacatctgcatcaatgtcaatctcatcaagacttttaaaaatcttagttgttgtatccagctcaattgctgttttttcttctaatccgtacacggcaactaattcaaatccgtcatgttgttgaaccattttaacggccttttggcccattttaccgttataaccggcaataattactttagtcatttttttcgctcctatcgttaatttcaagctttatcttaccagatttcaagttgtaagtgaaacccgcttttatgatggtttacgctgcggtttttgcagcgggatgttttttatgctaaagttaaagtaactttttacatttaactttagcaggaggaacgcatatgccgtatccctatcaaatcgatttcgtccgttttttaagacatcaacaattggcttctgcgaccatcaccagttataaccaatcattatccgaatttttttcttttttgactaccacaaataccggcttcgccgaccatccaactgttaataatatttttgatcgtgacattgaagcctatctcacctggttaacggatcagcaacaggccaaagcaacgaccatcaacaagatcctttcacaaattaatcgttattttcaatttctctttactcatcatctcacgactcagttgcctaccatcagcattcatggtccgaaacgcgatacacaagcaccatttcaaactaagtggttggccaccttaccgatcatccttgacgatgcgcatgttcaccactatacgcggctaacactcctattgctgagcaagggttacaccgtccaagaatttcttcagccgcacttttacttaacttggcagtctctaccagcaacagttgaacatgagcttacctttcgtgaatcattccaaacattcattaccccattgcaacgtcgtcaacatagtgccgatattttcttaaagcagcgcttagaccttgccaatccacgactaaccaatgctgccctgcataaatacctcaaaaaagacagtcagtaccttggattttcaatttcacccaaggtactgcatcaaagttatattctgtctgttttacaacgcgaatctggcttatccgaccaacaattagccacaaaattgatgttggatccacaagcactacagtactatcaacatttactgaccgacttaagctaaataattgagtcttttttaaaactcgtcttctgtttcttccaataataacgccatttcgctatcgtctggtactaattggacatactttttgagttgttcaagcatggtttcacgttgccccatttcccgatagaaatagaccgtttgcttaacaaattcaggttgatcattgaaatacggtaatgcggcgtcatagtatttttgtgcctgatcatactgatcttgatcttgatacgaaacagctagattccaataaatttgtggatccgtctgatcagacttgaccgctggtaatagtaattcaatattttgtgcgtattttcgccgtttaagtaataaattactatattcgatcgtaatcgcaatattttctgggtccaatccatgcgctttagaaagatagcgttccattagctcctcatcgtccaaatgactcgccacagccgccgcctgctgatagagttgttcattatactgatcgactccaagtccttcttgaagcgccgttagtgcctctgaataacgctctagtttttcatatgcttgggctaaatagggataaactgttgcgtactggggatcttgttcctgaagatctttaaacacctcaattgcagcctcatactgtttcaattgtagttgtgtaaagccggtctgaaaccgaatatcgctagattgaaattctggttttacctgttttaaatacccaattgccgtttcgaatttaccactctgtgcgtaggaaatccccagtcgtcccgccaaatcaacttgcgcaaagttagtctccccctgttcgattagagagaaatagtacggaatagccgtctcatactgtcccatcatgtaataaaattcggccagagcaaataataccaccggttcctcaggcgcttggttataagcttcgattaacttttgctcagaaacttcaaataattcctgtgtttgatataagtcggctgccaccaatagagattgcacatacgcattcgactcaggtttaatttgatccagatacgaaagggcctcgtcgttgtttccttcatcgatggcaatatctgctaatgcagtccgcagctgatcctcatccggatagcgttctaaaagctttagataagttcgttgggcttgccgcacaaaaccaaggccgtacaattcctctgccaggctatacagcatgtcatcgtcatcatggcgcagcgcacttgcaaatgactttttggcatcatctagttgcccactagaaagttgatccaacattttttcagaatacgtcattaaaaaacatctccttagttaaaaatcactcaatcgatcataccaattttttcattctaaagcgaatatttcagtcaattactcattatttatgtaaaaaagaagccatgactaaatgagtcatagctccttttttaaaaggattaccgattatttaacggcgtcctttaaagctttacctggcttgaatgcaggtaccttgcttgctggaatttgaatttcttgtccagtttgaggattacgtcctttacgggcagcacgttcacgtacttcgaagttaccaaagccgatcaattgtaccttttcgcccttagctaatgatgcttgaactgagttgaatactgcgtcaacggcagcagttgcatctttcttggttaaaccagttgctgctgcaacgtcgttaactaattctgctttatttgccatgtaatttcacctcccaccaaagtagtaagatgcctatgggcatccacaaaatttgatgttaattttggttgtcaaaattaacgaaataatgacggaacaccgtatcatttctaaactcaacattatcatacgcaaaccgcgctggcaagggcttttcagacatttcaaacgaaaaaaaggtaaaaatccactttaaattccatcattattaaaattacactaagatctagtacaatcccttatataattggattagtcaagcctttcgtctccgttctcaaccttcggcgattcacgcctttttatggtgttattttcccataaattactactttgatacaaaaaaggggccaccaaccgactaatttttaaattggggggcaaaatgggggcaagcttcaaaatatgtataaaaatacggtcttgaaatcatcacaatttcaggaccgtatttatggctgaaagccttgtcctacttacgtcgacgcttgatcaaatggatcggcgtaccggtaaaatcaaaggcgtttctaatttgattttctaaatagcgttcatatgaaaaatgcatcatatccggatcattaacaaaaatgacaaacgtgggtggctgcactgacacttgtgtgccgtaataaacccgcaaccgtttcccattagaactgggtgctgggtttgcagccaatgcatccataagcacatcattaagcgttgccgactggatccgtttagtatggtgttcatatacctgcttaatcagtggtggtagtttaataaggcgctgcttggtcttagcagaaacaaaaacaattggtgcataacttagatactgaaattcatcacgaatgatttgttcaaacgcctgcattgttttagtatctttgttttcgacagcgtcccacttgttaacaacaatgataacaccacgtccggcttcatgagcataaccagcaattcgtttatcaaactcacgaatgccctcttccgcattcaacaccactagtacgatatcactattatcaatcgccctcattgctcgcagcatcgcataccgttctgtattttcgtagatcttgccttgcttcttcattccggccgtatcgaccatcgaaaactctgtcccgtcatccgtggtgaacttcgtatcaatcgcatcacgggttgtcccagcaacgttagaaacaatcacccggtgttcaccgagaatcgcattcaccaaagaagatttaccaacatttggtcgaccaatcaaactaaaccgaatgctattatcttccacattttcagcatcatccggaaattcagctacaaccgcgtccaacaaatcaccaactccgataccatgaaccccagaaattgggtaaggatcaccaaaccctagtgcatagaagtcgtatacctcacttctcaattccatgttatcgactttattaacagctaaaacaacgggcttactagaacgatacaaaatttgcgcgacttgttcatccgcatcagttaatccgctcttaatatcgaccagaaaaacaatgacgtctgcttcatcgatcgcaatttcagcttgttgccgaatttgagttacaaacggttgatcggaaatctcgattccaccagtatcaatcaaatcaaattgctttccgatccattcaccgtgtgcataaatccgatcacgcgtaactccaggcgtatcttcaacaatcgagatacgttccccggcaattcgattgaaaatcgttgatttaccaacgtttggtcggccaacaactgcaactacaggttttgccatatttttcaccttccttcgaacaaaaatgaagctgggacatatatcccagcctcttttttatagataattttaaaaattactttttaagttcatcaccgatgagatcaccgagagtaaaaccactttcctcttcaggtgcatttgcagtgacgttgtttgaacgactttgacgacgttcttgatcacctgatgcttgtggcttttcttccaaggccttgatagaaaggcctaaacgttgttgatctggatgaacttcaagtactttaacttgaacctcttgtcctggcgtcaacacgtcagcgggagtagcgatatgtttgtgtgaaatttgtgaaatatgaacaaggccttcaacgcctgggaatacttcaacaaaggcaccaaaacttgtcaaacgcttaacagtcccggtaagaacactaccctcaggtgctttttcagcaatatcatcccatgggccaggcaatgtttgtttgattgaaagtgaaattctttcacgttctggatcaacagacaataccttaacactaaccttttgaccagtcttaagaacatcagaaggcttctcaacacgctcgtaagcaatttctgaaacgtgaactaggccatccacaccaccaaggtcaataaatgcaccaaagttagtcatccgtgcaactgttccttcaacaacttggccggcttcaagagttgcaaacaattctttagctgccttttcgtgttctgcttgaacaattgccttgtgtgacaagatcaaacgattttcactaggttcgatttcaacaatcttgaattcaagtgtttggctcttgaattggttcaaatcttccacaaagtgatccgtaatcattgatgctggaacaaatccacgaacacctgcatcaacaactaatccacccttaacaacttgtgttacaggcgctgtaattgtttcgccagcttcaaacttcttttgaatatcgtcccaaaccttgcgtgcttcaagacgacggtgtgaaagtaagtaacttccattttctttatcgttaccgatctttgagataactactaaatctaaaacatcgccaactttaacttgttcattaatatcttcaactggctttgttgataattcctttgcaggtacaacaccttcaacgcccgcaccttcaataccaacaattacttgacgatcgtcatcaagagccaatacttcacccttaactacatccccaacatttacttcttcaacgctattcaatgcgtttaataagtcgtttctatcttcattttcagccatgaaaaaaatttcctccttgcaacaatcaactctaccctatatgatacctaaaattcgtcgataatgctagtatttagcacaattcgtgctgtttttttgtaattacatcactaatcttctcaacaacctgctcaattgacaaactcgtcgtatctaatttctgagcatccgacgcctgtgtcagtggagataccttgcgcgtagaatcttttttatcacgcagttcaatctcttcttgtagctgattaagtggtgtatcaatgcccttgaggacattttctttgtaccgtctgactgcccgttcatgagcactagccaccaagaaaattttaacctccgcggccggtagtacagtcgtaccaatatctcgtccatccatcacaataccgccatgtgacgcaatttcacgttgttgtcgcactaattcttcacgaacagcggcaattgcagctaccgtggatacgttattggttacctctggctgtcgaattgcctcagtaatatcttgagtaccgaccagcactcgttgaactggatcacccggttgaaatataattttggtttgttttgctaattgtgcaaccgcaatatcatcagttaagtccatgtgttgctgaagagcagcatatgtgattgctcgatacattgccccggtatcacaataaatataattaaactgttttgcgactaatttagccaccgtactcttgccagcggatgccggtccatcaattgctacctgtaatgcacttaccatactcctattccactcccaaaaattatttaacgcgcaactgctgacctggtgtcagtgaagtactagaactaataccatttaattcacacaattcttgaaccgtaatgccattattgacagcaactcggtaaagtccttcaccagcaggcaccgtcacatacttcttatccccatcactactgctagacgacgatgaggacgacgaagaactagcactactagaagaggcttttgcgctggttgactcctttgctacacttgacgagcttgatttagatttgctcgcctttttagtactggtgctcttcacgctcgttttttcacttttagacgttgaagtcaccttcttgtgagaagaagatgactgggccactgcttccgttccggaatcaggtttattaaacgaactttggtgatcaatccagtaaacgaccggtgtcgcagcaaggacaataataatgacaatcaaaattgtcgtaatcatcgaattatgggttgtctgcttacggtgctttgtccgtgacaaattaccttcttgatctaaatcctgatcatcgttaaaggttttttcccaaggctttttttcttctttgggttggtcttcacgtttgtcactcatcaggtgatcccccttttttttccatcctttttattgtatcataccagctttcacaaaaaattaagattttacaaaaaacagatgatctagttttttttgccacgaaactgagggctgtgttgcctggcttagtttcggatcggtttgtaagcctaaccgctcaatcacattatctggattatcatagtcacaacaatttggccggtgagaaagtggtgcttcatcaaaatactgtaagataactgaccgccgacacgttgttgcccgaatgtaactcatcattatgtgtaacgcttgttcagattgtaaagcacgttctttgaaaattctagtaatttctgcggccggatagtcattagccacgtaatacgataaaatctctcccatttcacctaaatcatccggattaatttgctgattaataacgccttctattacccgttcattaggtaagtttccgaggctgagctgtcgcggaatctgctcatccccctcgctatacagcaaaattgcaatgctttgttggccgtcacgaccagcacggccaatctcttgcacataactttccaaattagcagacaggtgataatgaatcacatatcggatatcttccttatcaattcccataccaaacgcattggttgcacaaatcaaatctagctcgttattcataaactgatgttgaaccttataacgggtaatttggtcaactcctgcatgataggccgctaccctaagtgaggtctccgaatttaattgctcggcaaatgcggatgcctgtttgcgactcgaaaaataaacaatccctgctccctggatatgagttacaagttggattaactcggccgatttatcctgttgatccgtacattcacgaacagctaagaaaatattactgcgattaaccgatctcaccacatgttctacccgattcgaggttaatcccagacgattgatcacatcggcctgaactgctttagttgccgttgccgtgagcataagcaccgttggatgattcagtaagtcaattgtttggtttagcatcaagtactccggacgaaaatcggggccccactgagacacacagtgggcttcgtccaccacaaataggctaatttgcgcacgccttaacgcggcgatgactgtcggttgagccaaaacctccggagaagcaaatacaaatcggtactgagcgatcattcgaagcgtccgttgccgttcactaaccgactgtaatgaactcagcataacaactcgcttttcgccccgttcatgtaaccgtgagacctgatcttgcataagcgataagagcggcgacaccactaatacggtgccgggcaataagtagcctgggagttgatagagtaatgtttttccggctccagtaggtaaaacggctaatgtatcctgcccttctaggacggcattaacaacttccgcttgtccctcacgaaacccatcatacccaaattgattatgtagtaccgtcttaatctgtgcctgtgtgatcgtcactggaaataaagctcctcataatttgatatagtcgaaagtaaaaaaaagcatccgcagtatccgtttcttgttcctgaaactgccaatggtcaatctgttcatccccataccgtgtcaccaactgagtctgctgactagatgacaacacccaatcatatggaaagttagcgccctcaaaaattgcggcttcaagaagatgttcccttaccgtcccaatctttaaccgccgagtacgactaatctgctgaatggataatcgttgttgaaaaagtgtatatgtttgtgccgcactattcgacataggcgttaaactactcattggtgctatcaactggtaaagagcaccacttttcagatgcagaccatattgtgccaagcccgcaaaaagatcatattgcatcaaccgtgccgtttcaacatctattgctagtcggtctgccagctgagttaatgcttccccagcaacttcatgtccaataaactggcccaccataaaatcggcttcttcatccgttaatgtcgctaagaaatcggccagctcttgcttataggtcagtactaattgggccttgttttgatgagtaaaccattgcttaacagctcgcagatcatcatcattaaacgaaaacggggcatattgtcggctttcgtagctatactcggataccacctgagtagcaagtagtagtcgttgaatgacctgatccacgttcatcagtaaataggccgcttgataccgtggttgataatgagtgctgtaaaattgccgctgttgtgcttctccacgagcagttaattgagcctgctgttcgacaatcgttatcagtcctgcatcgagtaggttctgccaagcgatgtcaaactgcctgcgtgatactttgcgtcggtaccctagccacggtaaaatttgatatcgcatcccccaaaataacgttgcaaccgtgcgcttatttactaatatattttcaatcactcgaatacggcgtgcttgttgcgcagataatagcatgatcaaatagtccacggttgtccctccaaaatcagataccctaagcataaagaaaagcctggtaaattaccagactcttgctttaaaagtttatttttgttttgctaaccagccttgcattcgactggcaattaaccaaaagacaacaccaattaaaattcctttaataaggttaaacggtacgacgccggccattaccaacgttggcaacgaaatcgtaagtttcattcctaaaaccgtcatatatagcggtaagaccactaaccagtccagtaaggactcgataacggttaaactaagcgtagctaaaagaattccaataatgtagttcgatcgctgtgacccatggcggcgattcaatgcccaattaaatgggaaaatcagcgtgcatgaagcaatgaaactactggaaataccgatcaattctgggatggacatgccatataccaaggcgtgtatcaaacacttcaaaaacgtaatgccaaccgcgccccatggcccataaatgaccaacccgagcagcaccggtacatcagaaaaatcgatcttaagaaatggtgcaatgggaattattggaaactccacaaacatcaacacaaacgcaattgcacccaacaacgccataccgacggtccgatgcacattaaatactttcaccacaattgaaacctcctgagaggccatcttcaatgataatgaaaattcactataaaaaaatcgtaaatcaaataaaagatttacgactaactaaatagtggaaatcttctttataccagactatactgtcggcacccagaatttcactggattcaactacgcacacacgtaggtcgcgggctatcaccgccggtcgggaattacaccctgccctgaagacgaacctattaaattttttcgtacagatctgtacggctaaatcatagcagataatcccaagcaatacaacaatttcgttatagcttttttagttgcatgacttcacttgttttgagtcgtcgccactgtccagctggaaccccagccagtgtcaagaagccataactttcacggtgtagtttaagcacttcatgccccacggccttcagcatttttttgacttggtgattccggccctcatggatcgttagttgtacaattgtcgttccctttttagcatccgtagccgtaatcttcgctttagcagattttgtctttcgtccatcaactatcacgccaagtcgcagttgttttaaatcatcattggttacttgtcctttaaccttagcgacataagttttctcgacttcgtacttaggatgcgtgagcttattcgccaattcaccatcgttagtaagcagtagtagccccgtcgtatcataatccaaccggccaactggataaatgcgtgttgtaatctcgtcatcagctaaaatatcaacaacggttctacggtccttatcatcgtgagccgttgaaacaaccccacgtggtttattcaggagatagtattctaatcgctggcgtgaaaggggaaccccatcaaccactactaaatctttggccgttactttaacgcccaattcagtcactaactgcccattaactttaacatggccctcttgaatcatcttttcagatttccgtcttgaagcaacgcctgcctcagccatgaccttttgtaatcgttccattctaattatcctcacgttttctattttcaaatgcctgcaaaaagagatcgccgttcaacgcttcattatcgatatcatcaatctgtggtaactgtggcagcgcatcaattccggtcaatccaaagtaatctaaaaagtacggtgttgttgcatacagaaacggtcggccaggcgcattcagtcgaccgtgttcttcgatcaagtttcttaaaattaacttctgcaatgtcgctgagctttgaacgcctcgaatttcatcaatttccagtctagtaatcggttgccggtaggcaataattgctaagacctcaaggagagctggcgaaagtggcgttgtcagtggcacctcaaaatactgcttaacgatcggtgcaagtgtttttttagtcgctaatcgatatgtttgatcactttccaatacgattagcgcgctctgctcatcatccgcatacttatgcgtcaactgttcgaccatcgtctgaaccgccggacgcataaaccccgtaatcgagaccaggtcagtcaatgaaattccttcatccccactaataaagatcaggctctcaatttgtgccaaattgttcatgttcaaactccttactcttaggacccgcaacgatcaatagtgggcccaaacgttgctgttgatcgactcgcaccgcccaatgtttgcatagctcaagcaccgccaaaaaagtcgtcactagttcatcccgggttgtttgcccttcgaaaagtgcctcaaaaacggttggtccctttttgactgcggttaacaccactttcaacttctctgaaatgctaattcgctccgtttgtacggtttgactcacgggttgtgccaactgtttgcgtttcattacggcgacaaaagcctcttgcagctgttcaatgctcacaccaggggcgaccttaattccctttatgtcatcaggaattgccgccgcagaacgtgtaaactcctgttgccgttgttgttctttttcatgcagttgctctgctgcctgcttatagcgcttatactctaatagttgatcgaccagctcttggcgtggatcctcaaccggttcttcttcaacaaatgtttcatcttcatcaattggtagcaacatacgactcttaattgccatcagcgttgccgccatcacaaagtattcccctgcgacctccaactgattatcctgcatcgcatgtagatattctagatattgtgccgtaatttcggtaatttgaatatcgtagatatccatttccgcacttttaatcagatgaagcagcaaatccaatggtccttcaaaatcactgacccggattgtcggttggtgctgatactcttgaattatttcgtcagccatttagcgtcttcccccagttagtgatgagtggctgggtctccatcgttcccacgagtttcttttcagaatacttatcatgtaccgcattcaacagcgcaaaaatattgcgtcctgtccgatcagaaggtgtgaaggacagccttctgatcaacacatactcgtcgccaatttccaagcacacgattccaatcaggtgttcatccgcattgcgccatagatacatcggtcggttagcactttgctgataccacgccatctcagaattcaaatggctcaaatctttaagatcgggaataaacgataacaatcccatggcaatttttttatactcatctcggtaattaactaacatgtaatccccttctacgcgttcaagcccgtggatgatatttctgataaacttccgttagccgtttttgagaaacatgcgtatatatttgtgtcgttgaaatatcgctatgtcccaacaattcctgcacaatacgtaaatcggccccattttccagaatatgggttgcaaatgaatgccgtaacgtatgtggtgttacattcttcgtaatttgggctcgtgccacatgcgccttcaaatttttccaaataccttgtcgtgaaagctgtcgtccatgtgcgtttaagaacacgtagtcactagattggtttttgagcaatacggggcgaacttccgctaaatagcgttccatccaatcaagtgcgacctcgccaatcggaatgatccgttctttatcacccttacccaggggctgaatcaatcccatctcgagatgcagttcatccaaggttaggttcaccaactcgctaacacgtaacccggttgcgtacatcacttccaaaatagcgcgatcacggatcccaagttttttactcgtgtctggagcggccaatagccgatcaatttcagcacgtgtcaaaacctgaggtaagtgttgtccgcttttgggtgtatcaaccttcagcataggatcttcgctaatcagtccttcacccgctaaatagcgaaaaaaatggcgtaatgttgataccacgtgaatgattgtatttttagctttagcttgctcttgcagcgttgccaagtagttaatcacgacatatcgatctacttcacgccagcttttaatttgctgtgtcgtcagatactgtgcgaaagccaccaagtcttgataataactggtaattgtattttctgagaggccgcgttctacccgaaggtaatgaagataatcctctagctcattttgcatgctgagtgccgtctttcattattttatcgctttaaaactaaaaatccgttcatctgttcaactagaccacgtttaagtaaattaccaattgctcgtttgaactgccccttgctaatgccaaaaatgtctcggattactttgggatccgttttatcagtgtagggtaactgttgattatgcgcatgttccagcattgccaaaagcattgctgcatcatcgccaattgcttcataggctcgcggcttcattgataagttaagcgtaccatagtccgataccccaattacccgtaccttaacatgttgtcccaaacgtggttcttgatcacgctcacttggatgaataaaacctaagtaataatcatcagtcagcaccaacgtgcccgccatcttcaaccgataaaccgtggccatcatgtctgcgttctttaaatctggacgagcccggttagagattgcctcataaattggttcatcagccagttccccccagagtcggcccttatgatcaatttttaaagcaatcattaagcgatcaccattttgtggccaaagctgtttcaatgatggtaaatcgtccaatgataccgcaatatccttattctttaagccgatatttacaaacacacccaaatctcggcgaaccgaaactacggtgccatatgcataatgatcaaccatgacctgaggtatgtctaatgtcatctgtaactgatgatcattattttcatagacaaacccacgcacttgtccaccaatatgaagtgctttttcagtctcttctttcagcaggctgtaggtcaccccatccttttgtacaaaataataatcatgattttcatcaatcatgattgcagtaacgactttacctaacgatgtatttaacaatattttatccctcgacttttctagatacccttattttacacgtcaaaagcacaattgaaaagcgtcatcaattgatcccaaaaatttacgcaaaataaaaaccgtttaattctgcaaaaaacagaattaaacggttttagaaatctttaaattacttgatttcttgaacacgcatcatgttagtagttcccttttgatctacgggaacaccggcaacaacgatgatcttgtcacccttcttagcaaagccaagttcaacggccttctttgaagctaattcatacaaagcgtctgtatccttaggtgcttcaacaacgtatggttgaacaccccagttgatcataagaccgcgttgtgtgcgttcgtcaaaagtcaaagccaaaacattagcatctggacgatacttagaaatcattttagcagtgtatcctgacttagtagcagcaacaattgtcttaatgttcaagtcactagcagtcttcttaacagctgaaccgagtgcttcagtaacgtcagcagtatcgaaatcaaatgtttcagtaccaaaacggttcaaagcattttcagccttaatgtcaatccggttcatagttgcaacagattctactgggtagtcaccgttagcactttcaccagaaagcattgttgcgtcagtaccatcaaagacggcattggcaacgtctgaagtttcagcacgtgtaggacgtgggttttcttgcattgaatcaagcatttgggttgccgtaataactggcttgccaagcaagttgcacttgcggataaatgtcttttgaatcaaaggaacattttctgctggaatttcaacacccatgtcaccacgaggaaccattaagccatcggcaactttgatgatttcttcaaagttatcaataccttcttgtgattcaatcttagggaagatttgaacatgttccatgtgcttttcagcaagcaatgcacggatatcttcaatgtcttctggcttacgaacgaatgaagcggcgataaagttgatttcgtggtccaagccaaaacgaatatcgctatcatctttttcagtgatccctggtaagttgattgaaacacccggggcattaacacccttacgtgagccaagcaaaccatggttttgaacagtacatactaattccttagtagcatcgtccttttcgtcgatcttcatgtcaatcaagccatcatcaaaaaggacgtgtccaccttcatgtacatcatcgtacaagccagggtatgtgacagcgatcttttcgtgagtaccttcaattgagtcatccattgagatacgagtcttatcaccaatgttgaattcgatcttaccttctttttgaacagtagtccgaatttcagcacccttggtatcaagcataataccaacagtcttgccagtaatctcttccgccttgtgaacgttgttcaaacggcccaggtgttcttcgtgatcaccatgggaaaagttaaaacgaaaaatgtttgcgccagcattgatcagtttaacaattgtatcaacgtcagtacttgcgggtccaagcgtactaacaatcttggtttttttcataagtgaaatctctcctttgagtaagttaggtttgcgaaccgctcaccttttgtacagatgttatgatatcactttttaaatttgatgtctccattttctatcatttttatcaatgaaaacggctccaatctcaaactaatccttaattcatcagtttaattaagtatttaaataattaatctaatcaattatttttaagtaatttaagcaaaaagaaatgggagcctaactaattgcttatcttagttagtctcccacttcatcctaaaatcgaaactgttaattcactcgtgtgtaaattcttaatctaaaatgctaaagccaaggctcgaaatatctttatcgaagcccttgaccgtatcgattgaaacttgaagagaagatttacccaccttgtttagtttagccaaaatcgttggtggtacagtaatcacatcaacccccattgcctgagcctgataaacattaataacttcacgcgttgcagcccatagaagtttagcagaagggtgcttcttagttaatgtcacactttgcttaacaaagtctgttggatcctgtcccgtatcggctacacgaccagcaaaaattgaaattagtgatggcacatcatcattcacgtttgcaagcgcatcctcaacctggtccactgttgcaattgcggttacgttaaccttaataccagcatctgataaggctttgatcaatggtccgttgctcgtcccattcgctaaaataatcggaattttaacaaaaacatgatctcccagtgcagaaattgtttgggcttcctttttcattgtttcatgatcactaccaaatacttcaaaagaaatactgtaatccggaaattcactaatcacttgcttggcaaattccatataattggtaattccagctttcttcattaaagatgggttggttgtaaaaccagtcacgtagtcctttttagcgtcttcacgcatatcttcaataatcgcaccatctgaataaacttcaatatcaaatttttgattcataaccttattctccttttattgagcagtgttatttaaattttgtaatactgcattattagtgccaatgattttgaccaaatcaccgataatttgtgtactatccactagccactggttctttggttgaattactttccggtcggtaaccggattgaataggataactggaatgggcccttgatgttgtcgaataaactcgtgaaggcgagtttgaacttcctggttctgatgtttcgcatcaattcttagtacccatcgcttacctgtttgcgtgtttgctgtcgactgatggtatttaactgccagttgctgggctgcttcgattgaggccgcaacgatttgaagacctcgattcagttccacacggccacgaacaacaattatttgatcttggtctaataattgctgtactcgtttaaacaacttgggaaataccgtaatatcgacagttccagactgatcgctgccagaaacaaaggccatctgatcaccacgcttagttcgaatcaccttgacatgtccgacaaaaataatcattgtcaccgtcatattctcacgtaattcagcgatcatcgttgtcccaagttggtgggccagatcagtatactgatccaccgggtgtccggaaagatatgcccctaagtattgttcctcaaacgtcagacgcttggttaacgaaaattccgcccgctctgcaatcgtcggttttaattctttgaacaggctcaggctcgcacccgttaattccacactgtcgagtaatccggtaagtgcttcaattaactcagcacgattatagccgagaccgtcaaaagctcctgtataaatgagtggctccaagatttcctttttacgccacttcgtatccattcgctggataaacgacaaaagatcttcaaacgggccattgcttgttcgttcattgacgattgcctcgacaaagtctcgacgcatccccttaatcacgcttagcccaaatataatggcatccccatggaaggaaaattgtgcctcactacggttaatgtcaggtcctatcactttaacccgtcgtttcttgatctcggctaaatatcctttgattttagccggattattagccacggagtttagtagtgctgtaaaaaacgcttcgggaaaatgagtcttcaagtacgccatctggaaagccatctttgaataggcgactgcgtgtgaccgattaaacccataacgtgcaaattggtcgatatagtcaaacacttgctcagctaccgcccgtgaatgccccattgcctgtgcgccagctatgaacttatcttgcatctcatccattacggcttgctttttcttgctcatcgctcgccgtaataaatcagcttctccaagtgaaaaaccggcaagttgtgaagcaacctgcaatacttgctcttgataaaccaaaattccgtaggtaacgcccaaaattggtttcagggactcatccgggtaggtaacaggttcctgaccattttttcgtttaataaaatgatcaatattttccattggtcccggacgatacaacgcgtttacggccacaattaattcaaagttatccggatgcaacgacaccagtacgtttttaatcccattagattcaaactgaaaaataccgtttgtatctccctgctggaacaactgcaacgtttcttcatcagccaacgaaatttgagccagtgagaattcgggcgtttcacgttgaataatggccattgtctgggcaacaatcgttagattacggagacccaagaaatccatcttcaataatcctaacgattctacagtgtccttcgtaaactgggtcatcaatagtccctcaccaccatcttgtagcgggacaacgttaattaagggttcatctgacaatacaattcccgccgcatgggtcgaataatgacgcggtaatccttccaagcgctgcgctacctggtacagcagctggtttttagtagtttcaccaacgagcgtccgtaaccccatcgaatcttgataggcctgattcagaccaatatgcaactgattgggcactgctgcactccacgctgataattctgactgcgataagccaaatactcgaccaacatctcgaatcacttgcttggccgccagtgtaccaaacgtaatgatctgggcaacctgcgtatgaccatacttatcatgcacgtattgaagaacctctccacgccgattatccggtaaatctagatcaatatcgggcatctgggcgcgttgaggattcaaaaaacgctcaaacagcaactgatactgcaacggatccacatccgtaattgctaatgcatacgccactagcgaaccggctgctgaccctcgccccgggccggtcgtgattccctggtcatgagcaaaacgcatgacatcccacacgattaggaaataatcatcaaatcccatctcgtgaataacctttaattccttagccagtcgttgggtataatcggtaaccgtaataccaggcgcaagggtgcgttgcttcaaccctgacaagcaaagctgtcgtaaataatgctgtgaatcttgaccattagttgttggaaaggcaggcaatacaggcggttgaaaggtaaacaccacttgacactgttcagctacttgttgcgtacgatatactgcctttgataattgggcagcttcgtaggcggcaacctccgtcgtcatatcacgcagataatgtgttcctaactggtgtgctaaactttcaggctgttgaaacttacttccctgatcaattgagcgtaacacttcaacggcaaaatggtcgtcggcattaaggtagccaacccgatttagcgcaacttcctcggtatgagttgcatcaaccagttgatgaatcgattgccgtaaaatgggatccgtatatggattcacaccgatcaaaacactctgttcatctgcatcactttgccattgcacaagtagatcacgtgcttgatcactatttccctgctgcacgagccggtaaacatccccattcgttggatgaattacaaagacgtgtgccagcattggcttgacttgggaataagtgagccgtgttttttcatcaccggtattttgtagcgtcgacagcttcattaaattctgataaccctgccaatcctttgctagcaaaacaactgggacggtcacaccttcttcagcaacactattcattcggagtgttaacccaataatgggatgaatgtcagcttgccgagcagcattgtaaaactcaacggcaccgtataaaacgtcctcatcagtcaacgctagcgaccgataaccacgttgtttggcagcagacaccagctggtcaattttagttgtactattaagcaagctataactacttaatacttgaagtggcacaaactccatcattatcatcctctcaacgtaattataccaaagaccacccccagtcatgaataatgattctcgtgattaatctataccaataccatcaatttcgatgataacagctttaatattgatggtttattgttgaattgtcaagtgtttatcacagtaaattatcgtttataaaaatctataccaatttaagatgaatccattattttttcctttgtctattttcagatttagtgataaactaaagtatgtaaattgagagggtgagtaaacatgcgtcttatcgttcagaacctggttgctgccttttgggcattcatcttaggtgaaattttgggttacattggtagtcaacttgatttattgactatccaaccgctcgaaatgggaattattgctattgtggtagcattagctggggttaacagcttttactacattactcgtagcgctgaattaaaagaagattaaattaaataataaaaaagtcatggcaatcattgccatgacttttttattgaccttgttcgaccgtcaactccgcaattttgcgcaaaacatccacggcctgctccatcacctgtaacgagataaattcataacgtgaatgcatattttcgccacccgcaaataaattgggcgttggtaatcccatgaacgaaattttcgatccgtccgtaccaccacgaaccggataaataacgggcgcaatgccaagatcaatcatcgcctgttttgcagcttgaacaacagccatatgtttttccatcacttcacgcatgttgtaatattgatccgcaagatgcaaagaaattcgtggctcatcaaactgttggtttagctgggcaacaattgcctgtaactgttgcttgcgatgctcaaacaactgacgatcgtgatctcgaataatatagttcattgttgcatgatcgaccgtcccggctaaatgatccaaatgataaaagccctcacggcctgcagttaattcaggacggtcatgcttaggtaacatatcatggagattcattgcaacctgcaatgcgttcaccatcacacctttagcagtcgccgtgtgtacatctttcccttgaatttcaattttagcctgcgctgcattaaacgtttcgtactccagttctcccaatgggccaccatcaaccgtataggcaaaatctgcatcgaaatcctgaacatcaaaaagatctgcaccggtcccaatttcttcgtcgggaccgaacccaattttaatcgcaccatgtttaacgtctggatgttcataaaaatactgtgccagcgccataatttcagctaccccggccttatcgtcagcaccaagaagtgtggtaccatcagtcgttatcagcgtatgaccggcatactgttttaaggccggaaaatcctttaaggagagcacatactgtcccgctttatcgagtaaaagatcggtatggccatcatagttttcgatcacctgtggcctcacattatgcgcattaaagtcagccgtatcaatatgtgcaattagcccaatggtttgcactgcgtccgtcacattgcttgcaatcgtcccaatcacatacccatttttaggatgaatatgaacgtcttgcacaccaagttccgtcagttcctgagccagttgctgagcaaacttaacctgcgtttgtgttgaaggaatcgtatttgaattttcgtcagatctagtttctatctcagcataacggataaaccgttctagcaacccatcgtacttcgtcattgtatcgcctccacattttaaacaaacgtaaatggatcggtattgagctgtgacgcataaatatcaaccgcccaatcattttccgtacaccattgtgtgaatatctgttgtaaatatgatttacaaatgcattctatatgatgcccgggatccactgtgactaaatcatgtgcaatcatgtcatgaccaacgtgatacgaaacatcacctgtcacgtacgcgtctgcaccttttttgagagcatctaaataaaactggccccctgagccccctaaaactgcaacacggttaatcatccggggatgagcaggctgaattaggcgtaatccacgaataccgaacgtttgtttgcaatgctgggcaaacgtcattgcatccatcggttgcgacaaattaccaacccgtcccattccgtacggtagtcccgtttcaggatcaataccacctttaagtaacggtatcgtctgttgcagtcccagttgttgtgctagccaatcattcatgcccccattggcattatcgagattggtgtgcgcaccgtacacaattatgtcatgtttgattagttgggcatacattgcattctgaggatcccttaaatctaaatttttagctgcatggaacaccattggatgatgtgcaaaaatgaaatcaacatgatgtgcaatagcttcatccacaacttcaggtcgcacatctaatgtagtcattaccgttttaacctcacgccgcggatcgccaagctgaaggcctatcggatcaccgtcttcggcaattgcagggggggcaaaccgttcaaaacgctgaattaaatcctgaccaatcatgccagcacctcctgaattgttttgacctcgcttcggaacgtcttaattttatctaagggcggattttttgctgcttccatatgctgaatagattgctttaaatgtgttaactgttcttgccacttagcttgaaagacatcactttgctgttgcacaagatatggaccgaatagtagctgagcctctgtatacataatcggatcagtggctggctgggcgacgataatttcataagtatgcccatcttcagcaagaatttcttcagcaattatctcgtaatcatgttccattagccacttccgtagaccgtactcacccacattaggttgcagaatcattcgagttactgtcgataacttagctaatccatgctccaaaattttagtaatcaatgtccctcccattcccgcaatggtaagggtatcaatctgatcatccaagttaacggcatctaatccgtccgccaggcgtgcggtaatcacatgatccaaattttgactctttatttcatgaaccgcattctcgtacggtcccttaacaacctcacccgcaacggcaaacgaaatttttccttgtaaagctagaaaagccggcaaataggcatggtccgaaccaatatcggccatcctggcgtgctccggaacatacttagcaactgttgcgagtcgttttgataactgttttgcgtccatcatttcacctcaataaaagtttaatcaaaaaaaaggaagcgtcaatcgctatccgtagccgagagagtcttccaatcttgttaactattctaagaaatcctttagttgttttgaacgtgatggatgacgtaactttcttaacgccttagcctcaatttggcgaatccgttcacgggtaacaccaaagaccttcccaacttcttcaagtgtccgtgtccgaccgtcgtctagaccgaaccgaagacgaagaacattttcctcacgatctgtcagggtatccaaaacattttccaactgttcctttaacaactcataggctgcatggtcagcaggactagttgcatcctggtcttcaatgaagtcgcccaaatgtgaatcatcctcttcaccaattggggtttcgagcgatacaggttcttgcgcaatcttcaaaatttcacgtactttttcggttggcatatccatttcggcaccaatttcttcaggggttggttcccgtcccaaatcctgaagcaattgacgctgaatccggattaacttattaatcgtttcaaccatgtgcactggaatacgaatcgtccgcgcctggtcggcaatcgcacgggtgatcgcctgacgaatccaccatgttgcgtaagtcgaaaacttgaatcccttgcggtaatcaaatttttcaacggccttcatcaagcccatgtttccttcttgaatgaggtccaggaattgcattcctcgcccaacatagcgtttagcaattgaaaccaccaaacgaaggttagcttctgctaattcttgcttagctgtttcgtcgccttcttcaatccgaagtgccaattgtacttcttcttcggcgctcaacaaattaacccggccaatttctttcaagtacatccggactggatcgttgatcttgacaccggctggagccgaggtgtcatctaattcttttttagatacctcttgtgctttcaacgcccgtggatctggttcaccattttcatcgacaacgctaattcctgagtcctcgacattttgaattaagtcatccattccttcagcaaccagaccgaaaggcgtcgcaattttatcggttaattcatcatacttaatcgttttcttctttttgtattcacgaattaatttaccaacggcagaatcatattttttttggtcgaaatcttccttgttagagataaccttgtctttatcttttttgacatttttagccatttaatactctccttatgatcataattgctgttgctttcttaacaaatcaatcaattcaatcgtcaactgttgctctaattcttggtttttcaaatgagacgcctcatgcaactgcatttttttgctctttatttgctcttcaattggtgttttttgcataatgatccgtatataatcattgacggcatcaatgttagcactttcatccgtttgaattagctcaacctctaccaataactgctgcaatcggtcatccttaacgtaatcaacaaattctgacgcaaggtactcgctatgtgtctcaaaataactggccgccaataaataaagagtttgatacgtttcatggacaaaagcaaaattatcaatattttgaacgtgcacccaaataccatgatcatgcagcatttgcctgaggagcattcgttccgcaacctgtgtttgatcaagtaccggctgttcttgctgatatacgggcgctgtctcaacatggttataattttgttgtgcttgctctcgttgcacctgttcatcgcgctgccgggttaactcccgtaactggcttgttaaattggccttatcgagtttaaactctgacaccagttgattaacataaacatcctgttcaatttcatttggaaccccagcaataatttgtaatgccgcatttaaatagttgatttggtcggcttcgttttccagatttagcccctgcttaagatgtcgcaggctaaatgcaactggggtctgtcgagcatccatcaaccactgtttaaatttttctgcgccatattgctgtaaatactcatcagggtcaatacccgcgggcatcgaaacaacttccaattgaacattcgtcgtttgcccttgaatcatttcaagcgcccgtttagttgcgttttgcccagcctgatcaccatcatagcaaacatcaagattggaggtcacccgttcaatcatgctcacctgttcttcggtcaaactggttcccatcgaggcaatcccattggtaactcccgctcgataggccgcaatcacatccataaagccttcaaataaaatcaatttttgttcccgacgagctgctttacgcgcaatatcaaaattaaatagcacccggcgtttgttaaatagtttcgtttcaggactatttagatactttggcatgtccgtattttcagttgacaataatcgtcctgagaaggcaatcacttgcccactaccatttttaattggaaacataattcgatccacaaaacggtcatacaactcgccctgttggttttgtgaaaaaaggcccgtttgctgtaataagtcggcgtcggtttgccgctcgtgaaaaaacggcaataatagtcgttgaggtggcgcaaagccaattccaaaatcattgataatttccgcactcagtcctcgctgctttaaatagcttaacgctgtagcgccagcttgagtgttaaccaaaatatgatgataaagcttagccgctaactcgtggagctcaataagctggtgatcgacactgttgacctgttgaccaccatcaaattcactctcttgaacagattgcggtagcgcaatctgattatcttgtgcaactttaataactgcttgtggaaaggaaatgttctcaatttccataataaatttaaaaacatttccgccacgaccacaactaaagcagtgaaaaatttgcttactctcattgaccgaaaaagaagccgtcttttcatcttgaaatggacacagcccaaacaaatttttaccagatttctttaattgcacatattgcccaacaacatctgcaatattaacggagtttcgtacctggtcaataacttcctccggaatcctggccaccatcaaaacacctcggttcaattgccaatagctacgaaaagccgctttccaatcggaacgcgactctgttcacactcacatttatacatgatatatgttaacacaaactactatattgtcaatcaaaacaaccttgcccgaacatctttgtcaagtcctctgcgcttacttcacgatcaacgcatcgagattagcaacggataaaatcatatttgatagttttttcaactgtttcaatcgattatcacgcacttgttcatcatcggccataatcatgttctcatcaaagtaagcatcgatcgcagtgcgaagatccagcaatcccgttagcttagccgtcacagactgcgccgcaaagtgatcgcttaatgcagccacctggtcatgtaaagctgtttcggatggattttcaaatagcttagcatcaaccgttaactgatcttccgcaaaatttgccttctttgaaattctcattactcgtgttaaagcttcaaccgaggctttgaagccatcagtatttttagctgtatcaattgcctgctgtgcttcgatcacgttttcaatatctgactgtgtgctttcagtagcagcttcaacaatatcatgacgaatgccttgatgactgaagagttgcttaatccgatccttgataaagtcactgacctcgtttgcatgaacggtcacatcaaatgttggaaccacagatgccgtcttcattgcatctgaaaatgccgaagcaatgttaagtaatggcaagtgccattgcttatcagcaataattctgacaattccaaatgcctggcggcgaagtgcgtacgggtcattggaaccacttggaatcattccaacagcaaagaaacttaaaatagaatccaacttatccgcaattgccaaaattgaaccaatctgagtttctggtaattcgccttctgccgaaattggcatgtaatgttcgcgaattgcggttgctacggccgctggttctcccttaagtaaggcatacttttcacccataactccctgaagttcggcaaattcaccgaccataccagtggttaagtcaaatttataaatctgactagcacgcttcaattgagccagttcattatctgttaagttcaactgttgcccaaacatagttgctaaaaccgatactcgctgcattttttcaaacattgtactaattttatcatggaaactaacgtttttaagacgctcaacgtactcgttcaccgtaacctgttgatcctcttgatagaagaattgtgcatcctcaagacgagcggttaacacacgttcattaccgcggaccacattatctaggaattgatcatttccatttcgaactgaaataaagttcggcagcaaagctcctgcttgatcccgcgcgaaaaagaaacgttggtgatccttcatcgaagtaattaaaacttcatccggtaactcaaggtacttttcgtcaaagtgaccgctaaacgctgttggccattcaaccaagttattgacctcttccagcaggtcttcatcgggctgaacatgccatttgttatcggttgcgatcttttcaatctgctgccgaattaattgctttcttgcatcttggtccgcaattacaaactcgtgttcaagtgccccttcgtagtcagttgcttgattaagcgtaatatcatgacctaagaaacggtgccccttagtttggttgccggtggcaacgtttaagattgaaaatgggattacttgcgaatcaagtaatgccactaaccatttgatggggcggacaaattcaaacttatgcgttgaccacttcatcatcgttgggaagttcattgccatgataatgtctttcaacccacttaaaacttcatttaccgatttaccggcaatatgtttttccacataaacgtattcagttcccttaatttccttaaatgtaatgtcatcaacactcaggccttgaccacgtgtaaatccaatcgctgctttagtccaattaccatcagcatcctgtgcaattttctttgcggggcctttaacctcagtatcaatatctggttgtttatcggccagatccgtcaataaaatcgccaagcgacgtggcgtcgcatactgcttcaattctccaaattcaatacgttgttcctttaagtatttcgtaacacgttgtgctaattgctcaatacttggtgttacaacatgtgcaggcatttcttcgacgccaatttctagtaaaaatgaatgagccattttacttttcctccttatcgtcagccaataatgcttgtcgttttgcttcatccttgatcagtgggaatccaagcttcttacgttctgcaacaaaggcccgcgcaatcatccgggctaagttacgaattcgcgataaatagccggcacgttcggtaaccgataccgctccccgtgcatctaacagattaaaggtatgactacactttaaaacataatcataagctggatgaacaagcccggctttaattaatcgttgcgcctcagcctcgtatgactcaaagaattggagtagcatttcttgattactcatttcaaaactatactttgagtgctcatattcaggttctttaaaaatatctccgtacaaaacgccatccgtccattcaagatcaaacacgttattaacatcttgaatgtattgtgaaagtcgttcaagcccgtatgttacttcggcagcaacgggatccatttgaagccccccgactacttggaaataagtaaactgggtcacttccatcccgtcaagccaaacttcccaaccaacaccagcgcaacccattgatgggttttcccagttatcttcaacaaatcgaatatcatgttccagcggttcaattccgagttcccgtaaactattaagatacagttcttgaatattatcaggagatggcttcatgatgacttggaactgatgatgttggtataaccggtttggattatccccatatcgaccatcagccggacgtcttgatggttccacataggccgcattccaaggctctggtccaattgcccgcaagaaagtataggggctcattgttcctgctcctttttcagtatcataagactgcatcagcatgcacccttgttgtgaccaatatttttgtaacgtaagtatgatttcttgtaccggcaatttttttgtcatcactagttctcctctcaaaataaaaaacctgtaaagattagactaatgccaatctttacagggacgatatcattcgcggttccaccctgctttttcacatcaacgtgaaacagcttcattgtaacgcaactgttaaagtgcctaaaattcaaatcgcgtggctttcaccttcccacactcgctaaaccttgaattatttttacttcgtcattgctgccatatttaatttctagttaatcatagtcgacgtctttcaacttgtcaatcgtctttttgttttggctttaatggtgaaatttgctccgcccatgaatccatttgatcaataaatcgtttacttttcaagcgcaaaccaacaccttcatcgtaaatctcgtcaattacttgccgaagcttcttttttgtatccggatgaactgtgatcgattttaattgatccagatccaaaattgaaaatcggcggagatagtagatggtccgttgatcaacatggagccgatgtggatccaaatgatagtgttgctgacagatcaccccgccatatttgagcgaataatcaaatgccaaatccgttcgaccacagacactacatccctgccaattgggggcaattccaaacggtactaataattgaatttcaataatattagcaatgactgcagcatctagcccatcgtcaattaacgttaacgcctgataaatttgatgaaaccaccgtcccaacggtttttgatcagtgaatgcactatcaaccaacgctaaaacataggttgcataagcatttttaacaatatcttgcgtaatttgataaaaatgcgtggtttccattgtggtattaataaaactcaatccatcttggttaaggaccccagtatattgaccacttgtaaacgggagaatatcggcggctactcgcgatccctttttcttagcatttttgacaaaaaacatggtcttaccaattttgtccgtcaaaattttaactaataaatcccgttcgcgataatcacgtcgatacatcacgataccgttaaattcttgcacagaaccactcatcgacgtcacccccatcaaccaaccgactaaaggctaataatcatttcgacgataaccgtatgacttgagcattgaccccttgtcacgccaaccatcgacaacttttacccataacttcaagtaaaccttgtctcccatcaatcgttcaatatcttgccgtgccagtgtgccaattttctttaacatggcaccacctttgccaataataatccctttttggccaggacgttcaacaataatcgtggcactgacatcgatggtatgctcatctcgacgtttgatctgctcgatatcaatggcaacagaatgcggcacttcttgccgggttagttgaaataccttttcccgaattaattcagccactacaaatcgctcaggatgatcactcacctgatccgcaggataatactggggtccatttggtagcttctcaactaactcttgaatcagtgttgacacattattcccatttaacgccgaaattggaacaattttttcatacttaagtgcactttcaaattgcgttttaacgtccaatagccgttccggcttcacctgatctatcttattaataaccaagtaaatcggttgatgcacctttttcaatcgttcaataatgaagttatcaccggcacctttattctccgtcgcattcacaacgtataaaactgcatccacttcatccaatgcagataacgtcgaacgttccatgaagtcacctaacttagtctgtggcttatggatccccggtgtatcaataaacacgatctgtgcatcattagaagtgtaaattccctgaatcttatttctggtcgtctgggcgacgttactcatgatcgccaccttttgcccgataacttgattgagcaacgtcgacttgccgacgtttggccggccaattaaagcaacaaaccctgatttatagtttggattatccatttttactaccactcattctaaaaaagtttaggaacaaaaataatgatcgccacaacaacagcaaacgtagccgcaagtaaaacacttcctgcagctacgtccttaatttttttggccaatggatcataatgatttcgaacaatcaaatccgttagcgattcagcaatcgtattcgcgaattcactgaccactacgaagaaaatggctaaggcaatcattaaccactccaactctgaaattttaaaataccaacccgctccaaccgcaacaatcgccgctagtaaatgatagcgcatattacgttcatcacgaataaccgtccaaatgccaacaacagcatgcttcatagcttggacaaaatgtcggtttttagttgtttgcttatcgtttaagcccataatcatccaagatctttctttgcagggtgaacatttctttttcatcctcaggcgtctggtgatcatatccgttcagatgtaaaaaaccgtgtacaactaaaaatcctaattcacggtcattggagtgacctaaaaacttggcctgttcagcaattttatcaactgaaacaaaaatatcaccaatattttcgggaatttcagcagcaagctcgtcatccatcaccaacggaaaatcatcatctgcattatcttcaatcgcaaaactaatcacatcggtcgcccgatccaccccacggtattcgcgatttagttcctgaattcgatcattattaacaaacgttacagacatttccgtatcgtctcgtaagtctatataccgacctgcatactgaaggacatcttcaactagcttaactttctcatttgcaacatgctgtgttgtttgatcgtaaatttctaaatccattattcttcctatcgtttcgtagtttctttttcatacgcattaatgatacttgccactaccgggtgccgcaccacatcatccgcactaaagcttacaaattcaatgtttttgatattctgtaaaatcttctgagcattgactaatccactacgtgttccatggggtaaatcgatttgtgaaatatccccgttgaccaccatttttgattcaaacccgagtcgtgtcagaaacatcttcatctgcgcatttgttgtattttgagcttcatccaaaataacaaacgccccatcaagggtccgtccacgcatataggccaatggtgcaatttcaatcacgccacgatccatcaagcgttgtgtatgctccgcacccataatttggtacagtgcatcgtatatggggcgtagatatggatcaaccttttccttgagatcaccgggtaaaaatcccagactctcaccagcttcgacagctggccgcgttaaaatgattttctcgacgtctccacgtttcaacgcactaactgccattgccacagcaagaaacgttttcccagttcctgccggtccaattccaaacgtcaaatcattttcttgaatggccttgatatactggcgttgaccgaagtttttaactcgaattgatcgaccttggcgatccttaataatcacttctttatacaaatcagtaaagtaatctaaggtcccccgatcggccatcttcatcgcactcacaacatcagtactgttgaggcgaattccattctttaataactctgccaacttccgtaaaatcccgagagtttgctcaacctgcaaatcatccccattaatttttaattcttcaccaaacggtcgaatcgtaacgttcatgccttcttcaagaagtttcacaaattgatcctgcgttcccaaaaggcccatttcaacttctggatcactcacacgaaacgttttttcgactgaacttgtagtttgctcgctcaactaagaatctcctttaccatgtaatcaatacagataaattttaccacatcggtactaattagaccaacgccaggattacggttacttcaataagcctttgaccgtttggttaactaatttgccatctgcttgaccctttaacttaggcataactgcacccatcactttaccaaagtcagccatactttgagcaccaacttcagtcactgtatcagccacaatctgcttgacttcgtcttcagaaagctgtgctggcatatacttttcaacaacggtaatttctgctttagtttgggcgcttaaatcttcacggccgcccttatcaaattcagctactgaatccttgcgttgctttaattcacgcgataaaacggcaacttcttcatcgttagttaaatcgtgacccaaattaatttgttcgttcatcacggctgacttcagcattctgacaacactcaaagtagtcttatctttagccttcattgctgttttcatatcttgatttaatgtttctagtaaactcatgtttgttgtcctccacattaatttttattagtattttatcgtaattaaaagcaaatgctcctgtccgaatgaaaactcattcgattcaggagcattaacgtccaatattaaaagcgtttcttgttcttacgtttccgagcagcttctgattttaacttgcgtttgacacttggcttctcgtaaaattcacgcttacggtattcttgtaaagtaccgttctttgaaaccgtacgcttaaagcgtcgaagagcgtcgtctagagattcattcttgcgaacgactgtttttgccatatgaattccctccctccgagcttaagattacacggcaaactatacataattaagacatagtcatactgctgtagattattatacataattacgattttatcgtcaacacagcaagtaataattttatcatctgtaatttaccacaggaatgtattatacaggaaatatgctctaattgatagcacttttcgctatttttttcgtaaaatctggatcaaacttttgtgttaccagcatttcaatctcccgcccatatggcgccaccttatgtttctcgtcaattggaatgtacggtgtttccaaaatcttaggtacattttcgagttgcggatggtgagcaatgtaatttaaagtctcaaatcctatggtccccatcccgatgttagcatgccggtctttatgtgcgccacgttcatttttggaatcattcaaatgtaatacctttaaccgatcaattcccacgacatgatcaaattcattcaaaacaccatcaaaatcattttttacatcatagccagcatcattggtatgacatgtatcaaacgtgaccgataatttttgattatttgtgacaccgtcaataatagttgcaagttgttcaaagctaattcccacttcactgcccttgccggccattgtttcaattgcaatctgaggaatttggtcaggtgtaataacctcgttgagtcccttaataatctggttcaatgcttgatccgcacccgcgccaacatgagcaccaggatgcaatgtaatttgagtggccccaactgcttgtgctcgaacaacttcctgccgtaaaaagtcgactccaaaagcgaaattttgtggttttaccgtatttcccaaattcacgatatagggtgcatgcacaacaatatgtgacatgtgatgagcacgaatgaattcgtttccctttgcgatattcatttcagaaatatccttacggcgcgtattctgcggtgcacccgtataaatcataaatgtgtttgcttggtaactagcagcttcctgtgcagcacctaataacattttaggggccttcatactaacatgcgatccgatcagcacattatcactccttataatttaggctcatagaaatggcccataatttgcattgattcagtgatggacacaaaggcccggggatcagactcttcgattgctgatctcaaatcgtacatttcataacgcgaaatcaccgtaaacaagatggccttttcatcatggcgatacgcgccttcagcaccatgaacaatcgtgattccccggcgaatatggttttgaatactgtcagtaaccgactttggccggtcggtaacgatcataacctgcatgagttgttggcgagtatacaccatatccatgactcgagcattaacaactaatccaacagccgaatacagcgcatatggccaaccaaatacaaatccagccgcggcaataattaaaacattaaagctaatattgattttacccatcttggcaccggttttttggcgtaacacaatcccaataatatccagtccgccagtcgaaatcccataccgtagtgacaatcccgtaccaaatccattaatggcaccaccaaagattgcacaaatcaatggatcatgtgtcagcgtcactggctgaataaagcgcatcataatactagctaaggccactgaaattatggtaaaaatcgtaaatcgatggctaattttgacccatgccaaaataaatagtggcacgttcaataaaaacagcatcagcgcggtactcagctgaataggggcataccgagcagttaacgtgttaatcagctgtgcgagtcctgtaattccggatgaataaatatggcctggtgtccagaaaaaattgaccgcaattgatactaaaataccataaataaacgcagtccctgcccggccaacgtactgatgacgctcaattaacttttgtaagtcttccattttttacctttccattctcactaatctctcactactagtctgattataacaaaccgctttctaactaacacctcaaaaaaaggtgcatcatcatcgatacacctttttttgcatgattcatgcttactattttggtctagttctcgtcgttagggttgacgaagaggcctagttccatcaattgcttgtcggcaaccgtcgatggtgcctcggtcattggttctgtggccttagagttcttagggaaggcaatcacatcacgaatgttatcccgcttagcaagtaacatggcaaaacgatccagaccaattgcaaggccgccatgtggtgggaagcccatgtctaaggcattcataaggaagccaaaggctttttctgcccgctcaggagtgaatcccaaagctttcagcatcttttcttgtgtctcccgtgtatgaatacgaattgaaccaccgcctaattcatagccgtttaagacaatatcgtaactctgtgcatgcgctttgtgaggatcttcaccctcatcaagatagtgtagatcttcttcgttaggcatcgtgaatggatggtgcgcagccgtccaacgtttgattccttcatcatattcgaacaatggccagttaacaacccagataaaggcgaactctgattcgtcaatcattcccatttcgtgagcgattgctttacgcaagtaacccaacgtatccgaaacgattttaaagttgtcagcagcaaataggattaaatcgccaggcttagcaccgacagccgcactaatctcatcttgcttaacctttaaaaacttaccaacggggccagtaaagccatcttctgtaaccttaatccaggccatccctttggcaccaaaacgttcaatataagctgttttagcatccaagtccttacgtgaatattgtgcagcaccgccaggaacacagatcgcttttacaaaaccaccattcttcaacgcgttctggaaaactttaaaatcaatatccttcaccacgtctgacaaatcctttaattccatgtcaaaccgaatatctggtttatcagaaccaaatcggtccattgattcttgccagtcaattcgtggaattggtgtcgtaatatccacaccagcagcatcgtgcatgacttgcttgagcaatccttcagtaatctcctgaatttcttcagcagataagaagctcgtttccatatcaatctgtgtaaattcaggttgacgatctccacgcaaatcttcgtcacggaagcaacgtgcaatttgataatagcgatcaaacccggcacccatcagcaattgcttaaagatctgtggggattgtggtaacgcataaaaatggcctgggtaaacacgtgatggtaccaaatagtcccgagccccttcaggagttgacgcagttaaatctggcgtttcaatgtcgtaaaatccattgttatcaaagaaagtatgtgtagcacgcgtgatagcgttccgaatcttaagtcccttttgcatttcagggcgacgaaggtcaaggtaacgatacttcaaccgcagttcgtctgaaacgttaatatcgtcttcaatgtagaacggtgggtttttagctgctgctagtaagttagcctcatggatttcaatttccaccttacctgttttcatctttggattaatttcgttgtcggcacgtaacttgaccgttcctcgagcttcgatcacgtattcattccgaagttgatcagcaaccttccatgcatcttcgctaaattcttgactgaagaccaattgtaaaatgccttcacgatcacgtaagtcgataaaaatcaacccacctaaatcacgccgtttttgaacccagccctttagtacaacttcttggttagctaacgtttcgtcaactaaacccgcataatttgttcgtttcattactattctcctatatatttatcgtaaatttctggaaatttcgtgtataaatcatctagtggcaacgaaacttcttcactcgtgaccatcgatttaaaatgcgctgtccggctttccagttccgactgcccaattgtaatcacaaacgacgcattttccttattggccgacttaaattgtgcctttggtttacggccaagaaaatcacggttagctgagaaaccaaaaccacgaatcgcctgtactagttttagcgtttcaacgttggtttcatctccaataccaacaacgtagacatccaattggtgaccatcaggaacttcgattcccttatcagccagtagcagcatcaaccgttctaatccaattgcaaatccgacacctgcatcatctggtcctcccagttctttgaccagaccactatagcggccaccaccacaaacggtggtataaccatgaccaagcgctttagactgaaccatcacttcaaagatcgtatggttataataatccagtccccgaaccatggttggatcaacaacgtagtcgattccaagtacatctaatagttgtttaacctgttcaaaatgaccacgtgcttcatcagtcagataatctaaaattgaaggcgcatcagcaacgaactgctgatcttcaggttccttgctatctaagacacgcaatggatttttctccaagcgttcctgtgaatcggcacttaattcatcgtagtgtggcttcagataatcgatcaaggcctgacgatagtcagcacgactttgcgtgtctcccaatgaattaacagccacccgtaggccatcaatccctagttgcttaaagtacgctagtgccattgcgatcacttcaacatctaaggctgggctatcactgccgaatgcctcaaccccaatttgatgaaactgtcgctgacgaccagattgtggtcgttcgtagcgaaacatcggaccgatgtaaaatgccttgtagggcttcgtgtgttctggtccgtacaacttgttttcaacgtaggcccgaacaacccccgcagttccttctgggcgcaatgccacatggcgatcgcccttgtcatggaaatcatacatttccttagtgaccacatcagaagtgtcccctgctgaacgggaaaagatttcaaaattttcaaataatggtgttctaatttcacggtattgataatccgcaaacaataagcgagccgtctcttcgacaaaatgccatttctcagattcttctggcaaaatatcagcggttcctttaggacgttgataacgcatgcatatcctccttttactcttttatccgtgaattactcacgaataatcgtatacccatgggattcgtttaaatagaattaacctaataaaatataaaaagcacccttgaaatacaagggtgcttgacgcacggtaccaccttagtgttactcattgataacgtctaatttgacgggataattccatcctccgaagtgtcaacctcaccccaagtttacaaaactttcagcactgttttgctctctaaaaaactttcttggtgaagccctcttcatcatcggcttaatctatttaaattccacaatcaaaattactcgaatttacggctaaagtcaacccatattctgaattagccttgcttttacccctaaaaattcttaaacttatctgaaaagaacataattattaaggagtctgcttatgtcacactttcgtcccactcgcctccaaatcatcatcacaacccttttcgtggtgcttgcattgggattaaccttcgcccttacccgtcaaaaaactgtcgtcgtaagtgtcgaaaacgtcaatgtccggcaaggccctggtttgaaatataaaaaagttaaaaccttaaaatcaaaggaacgactcaacgtactcgctgaaaaaaacgactggtacaaggttcgaattaacgatcatcaatttggctggattgcaagctggctagtcaatcggcgcgacaatctcaaaaaggccactaagttatctgaagcaacaattgtcattgatgctggccatggtggttgggactctggtgcagagtataaaaccaacagtaaaaaagcacagtacatggaaaaaacatatacccttaagatggcgaaactcgtcgctgccgatttacgaactaagggtgctcatgtcattctcacacgagatagtgataaatttgtggggctcaaggctcggcccgccctcgccgaaaaagtccacgccgatgcatttatcagcttccattttgactcctcaccacaaagaaatgaagcatccggcctaacgacttactactaccataagggggaatcaaaaaaattagctcggaccttaaatcggcaattcaatagtcttccgctaaccaatcgaggaatcggatttggtgatttccttgtcattcgtgataatacaagaccggccgttctttgcgaaatgggttatattaatgacacccacgactttaaatcaatcaagagcacgacttatcaaatgaaagtcgcccacttggtcacccagggactgagcaattactttaatgaataaactagagaaaggatgagactcatgtttaatcgtttagattcaaattggctatcccaactgccactcaatcatattcaatcagcggtcgctgtcagtggtggcgatatcaatgacgcttaccagatcaccactgatctgaaaaactattttttgaaggtccaacctcatcacccagcatcttactttgatcatgaagaagccggtctaactgctctggaagctgctgtccaagtcccccatcccattgcaaaagggcaaattaatggggatgcctatctattacttaattggatttcaagtagtaatggtagtcaaagcgacttggggaccgcagtggcccgtctccaccagacacaccgtcagcaatttggttttgatttcaatcatcagtctggtaatttaacaaaaaataaccattggcagtccagctggacactcttctacactgagcagcgtttggatatgctcgcacaggcggctgcacaaaatcacgtttggaatacctggcgtcaaacccatttcaaccaaatgcggcaggcattcatcgactactacaccaaccatccagtccagcccagtctattgcatggtgatctatggtctggtaactatatgttcgatcaaaatcacacacccgtattgatcgatccagacgctttttacggtgatcgtgaattggaccttgcaatgacgaccatttttggtggttttgatgatcatttttaccaagcctaccaaacccaatatccattggcccccggtattaacgaccggttaccgtggtatcaattctattatctgtgtatgcacttaaacctctttggtgagtcatacggcgatagtgtggaccgaatcttaggtcgatactaactaaaaagacatcctttcacttcacgtgaagaaaggatgtcttttttgatattaatccatgggtattgagtctaattgcgtctagctgtacctagtttacataacataaattatttgaagtagcttattttatcaagggtaataactctgacatttggtgaatgctctgctccggttgtaccgttcgatgaattaaatcatcaggatcaaataaaactcccgcaataccagcattatgtccagcttcaatgtccaggttccgatcacctaccattacggcatcttgtcgatcaacctgatgtcgatctaataaatagttcaatgaagtgggatctggttttcggggaaaaggattctctgctgtgacaaagtccgtaaaaagattcgtaatttcatcatgatccataaacgttaatgaactaccgtttcgatgtgttagtaaatagtttgctccaccacgcgaaacgattgtctgtagtacttcacggacacctttaaaaagctggggatgttgcagttgtttttctagtggatagtaaatagcttctaatgccagcctttggatatgatattcacgcgcatactgatcaaatgccacgcctaaactttcctgccgcatcagctgataaatatgatgtttctcaactggtatttcaaaatgcgttagcgtcttagcgaaagacaataccattttgggataagtgtcatacaaagtaccatctaaatcccagaaaaatgtcgtatacatcaagctctcctatcctttcttcggtttagccaagcttacttttcgtaaataattgtcgttggaccatcgtttcccagttcaatttgcatttctgcaccaaaatgaccagtttcaacgtgaacgccagcagccctgagcttctcattgaacaaattatacaggggttccgcaatatccggcttagccgctagcgaaaatccaggtcgatttccatgcttggtatctgcatacaaagtaaactgcgaaactgacaaaatggcaccttgaacatcgtttaagcccaaattcattttaccatcttcatcttcaaaaattctgacgttaatgattttatgaactaagtaatccagttgctcttctccgtcttccggagcaaacccgaccagtagcatgtaaccaacgccaattttaccaacaacttcttggtcgatcgtaacttgggcatggttaaccttttgtaatacaacgcgcattttattttcctacctaactagaataaattaatgaattgtccgctttacaacataaacatctggaatattttttaagttatccataatgtgttgcaaatggtcacgattgcgaataccaatggaagcattaatcgtcaccatcttatcatggtcgacctttccattgaccgaattcaagaacttcgtactattattaatggacttcaaaacatcattcagtaatccattacgattatagccttggacctctaaatcggcattataattggtcttatcaccatcgggattctcccacttaaccttgataatccgctcaccatgttcttctgccgctataatattaggacatccaactcgatgaaccgacacaccacggcccttggtaatgtaaccaacaatttcatcacctggaatgggactgcagcaatggcttaaacggaccaataaattatcgaccccttcaataataacgccgccctgcgccgttgaccgtttcttttcatggtgcacttcatcttcggccaatgttttgtgttcttccaacaatgcccgctctgtttgccgttgcttatcgttttcaatttgttgccgcgcatctttggacattcggttagccacccctgcaggttgtaaatcaccgaacccaatagcggcaaacatgtcatcatggctactataatgcagctgtgctgcaacttcagcctctttatctggcgtcatgattccatgagcattaaaaccggcatcacgaagctttttttccaccatttcatggcccacgacaatattttctttacgatcagcctgccgaaaaaactgcttaatcttgttacgggcgcgtcgtgttgaaactagatttagccaatcacgactgggaccagctgaagaagtcgacgttaaaatatcgacaatatcaccattcttaatttcatagtccaacggcacaattttaccatttactttggcaccggttgtcttgttcccaacttcagtatgaattgtgtacgccatatcaagcggtccggcacccttcggtagctcaaagacatcgcctttgggggtaaacgcataaacacgatccgcaaaaatatccccctgtaccccctgcataaattcatcagcatcactgctttcactttgcagttccagtatttctttgaacagattgagctttttaccagattcgctttgtttaaccccgttagtcttgccttctttgtatgcccaatgggccgcaacccctaattcggccacttcatgcatctcatgggttcgaatttgaatctctaatggacgcccctctggaccaacaaccgtcgtatgcagtgactgataaccattcacctttggcatggcaatataatccttgaatcgccccggcattggtgtccagctagtatgaatggctcctaggaccgcataacaatccttaatcgaatccactaccacacgaatggctaacaagtcataaatttgactaaattgcttatgcttagttaccattttacggtataccgaatagatgtgctttgggcgtccataaatttccgtatcaccgcccaattccaaatcactaatcgcacgtttaatatcttcaatcgcgtgattaatatattcaatgcgctgatcccgacgagaattcattagatgcacaattcgatagtactgttgtggatttaaataccgtagtgaaagatcttctagttcccacttgatagtactaatccctaaccgatcagcaattggcgcgtaaatttcgagtgtctcattcgcaatgcgtcgttgcttatcaggacgcaaatgctgaagtgtccgcatattatgcaaccgatcggccaatttaacaatcatcactcgaatatctttcgacatcgccaacaatagtttacgatggttttcggccatctgctctttattcgacttatacttaattttactgagcttcgtatcgccatccacaatcatagcaacttccggaccaaacaaaatacgcacatcttccaacacaacaccagtatcttcaacgatatcgtgtaaataaccggacacaaccgtctccggatccatgtgtaatttggccaagattcctgctacttggatgggatggataatataaggctcacctgaccttcttcgttgatcattgtgagctgtttcagcaaagtggtaggcactttcaaccatcttgacatgttcttcattcatgtatgaagcaacaatattttttacatcttcatgggttagattcttttctttaggcattattcaccaacttgctttccaattagtttatccaaattctcgtttgattaattatacatgtaaccaataattaatagcaactatgcctgctgtttcgtcattgaatagctaaggtacgctacaccaagataaaccagcgcaaaataatacgtgtactttggcaaatatagataagcaccaatcaagtagcataccggaaaaacaaatagcttccaccagccgagccgttgcttggtaattctaattccagaataaatggcatagccaccgtttatcagaatcaaaagtaagataacggatgtcacacgatggataaagggtgcgtactctccgagcgccgtcagcacaataccaattataattgaccatccaaataatgatttatcgagtgtttgccaaaatttacgtccatatgtcatcgatcatttctccaattcaaagtagtaagaaattgctgccagtaaatataatggtgcagtttcggttcgtagtattcttggtcctaatccagctggaataacatcacgatcagttaatcgcttaatctcatcttcagttaagccaccctcaggaccgataacagccaatagtgtatcaccgttttgcatttgatgaaacacacgagataaatttgactgttcaccttgtttcgccgactcctcccatgcaacaatttgatgttcagccgcagcctcattgaccgcctgtaacaaatcggtttgataaacaacttgtggtatcacagttcgatgcgactgctcggccgcaccccgagcaactttcactaatttttcaatttttttctgtcgccgatcggaatgccacctagagattgaccgttccgcctcgaaaaaaataattttattgaccccaagttctgttgccttttgaacgatcagctgtgccttttcccccttcggaacaccacacgctaatgtgacattaactggcagttcactggacgtcgttatttcatgatctacctgtacccaagctcgtttcccgtcaactttaattaactgtgcaacaacttcgaccccatcatccaaaacgaattctgctaaatcccccacttgtgcccgcatgaccgtcacaaaatgatgagccacctcgctggacagctcaaaaccaccatctataattttagtttgctttaaaaaataacgttgcactttaattcacctattcgtcaggcaacggcttccgcgcaattaccccgtaccaatctttaatctgcattttttcttcgatcacaaagccctgattttcaatagcttccgtcacaacttgaattttatcagcaataattcccgaacatagaaagtagccattgtttttcagattctcaaacgcttgcggaactaatggaataatgatttcagctaaaatattagctacaatcacatcaacctgctcatgaatgccggctaataaatcattagcagccactttaatcggttgcgccttaggattaagctcaatgttatctaatgctgacttaacggccacgtcgtcaacatcgtaagcattaacctttgcagctcccaacaaacgtgcggcaatgcttaatacacctgaacccgtaccaacatcaaggaccgtttcgttgccacgaagcgtcatttccagtgcctgcaacatgagtttagttgttggatgagtcccagtcccgaaggccatccccggatccagatagataacccgctcatcgtcttgtgcagcttgatactcttcccagtcgggaacaaccgttaaatgcctcgtcactctgacgggatggtaatactttttccaagcggttgcccaattttcatctgagacggcgctagtgactacttctccagcaccaggatctaacccgaattccttaagtgccagaacccgttgtttaattgtcggtaaaatttctggtacaaaaatattttgtggatagtaggccgttacagctgctcccttttctaaatggggaatgtcgtttggatcaataatttccccgtgggcaccaaacttacccggccgtaatttttcaaaatctttcgcatcttctattttaacaccggttgcacctagatcatttaggatgaaactaactgcttcgacggcttcactttcagttttaactgttacttgtgtccactgcatcgagtgtcctcctcgtattgttttataactcaccgaaaaacgaatatctacattttatcatataaatcaaaaaagcgtgatcaaccaattgtctaatcacgccccccgagttattcaattgttagccctgttcagacttttccttctcaacctctttttcttcagctcgcttttcagcaacctgttccaggtcttgataatttgctggctcatccgcatacttcaaaatatttgactctaaatggcgctcaagataagaaaccaattcagcctcagttttgaatttgcgtggatgatgctggcgatgcagtcgaagatcaatttcattgattttcaaccgtcctgtccatgtatgggagtaacgaatgattacccgattattcaattcatttttcccaaaagtgaaaacataaacatgttgtgaaatcatcatcggtcgaatatattcttttttgtatttcaagtcatgtttacgcatgaattgtttggttttgtttagcatggtaatcacctcctaccgattaacttttaagttaatatcatactttattaactgtaacatgtaaaccctttttttgtgaaatatttttgatcgcaatacttacaattatcaaattcttaattccaccttgtaatctggttcactaataggattagtttaccataattattctccatttagcgcagtttaaccgatttaattagattagtgtgaattgtccctatttcatatctgctttcaccaatagaaaaagccgacttttgtcgactttaagtaaaagttgcgatttaaattccgttttttcgttttgcttctgtgtgaatcaaatgcttctgagcacggtgtgccggtgcatggttatgtgtgttcttgattaccttttcaggagcatcagtctcgctcgttcgcttgtcagcacgccgagtacttgcgtctgtcttcttttccggttttttcatagtaaaaacctcctatggtcaatcgcgaaagcagcttattatttatataagtaatactatatgatgtttttcaaaaatgcaatcaataaccactaaaatattaatctttcaacatttgtacttaactaatggtagaaaaaagacagccccggctaagggttgtctagtatgttgcaacttgcactcttgggaagtgcgcagaaaaaacactgcatccgaatggatggttagttaaatcagtaaaatctagcaaaaaactgattcttctttattctaacggattacatgatttgatgtcacctatttttaagatttattgcgtcacatcaacatgaaaaatccaatgttggcaggatgttggcaaaacgtaaaaaaggactaactccaaaatcgagctagtcctttaatcgttgatatgacgctattttttgtgtgcttcttcttcgcccgtctgcaaaacggccataaaggcctcttgtggaatgtccacaacaccaacagacttcatccgtttcttacctcgcttttgtttctccagaagcttagcgcgacgatcagggtcaccggtatgaatgcgtgcggtaacatcctttcggtaggctcgaatattagttcgagcaataattttagcaccaatcgcagcttgaatcggaatttcaaagttttgtcgtggaataattgtcttcaacttcgccgtaatttcacgaccccgctgagcggcgaagcttcggtgtgcaataaaactcagggcatctactttatcaccattaagtaaaatatcaattttcaccaaatcgccagcacgataatcctctaactcgtaatccaatgatgcgtatccacgcgtattgctcttcaatttatcgaaaaagtcataaataatttcagacaacggaatatgataaataacattcacccgaatatcatccaaatattccattgtttcaaagatcccacgtttacgttgacacagttccattacagcaccgacataatcatttggcaccataatctgtgccttaacatagggttcattaattgttttaatagcagctgcatctggcatttcagctggattatccaccgctttttgtgtaccgtctgccaaatcgatacgatatgtgacagagggcgcagttgtaatcaaatctaggttaaattcacgttccaaacgctcttggacaacatccatatgcaatagtcccaaaaagccacagcgaaaaccgaatcccaatgcttgggatgattccggatcaaaagttaaggccgcgtcgttgagttgcaatttttcgagtgcttcccgtaaatcattaaacttagcattgtcagtcggataaagacctgaatataccattggtgtcatttttcgataacccgctaatgccttatccgttggatttttagcatcggtaacggtatcaccgacttgagtatcctgaatatccttgatactggccgtaatgtaaccaacatcacccgccatcaacatctcggttgctaacggcttgggcgaattaacgccgacttcagtaacatcatactcagtgccaccattgacaagtcgaatccgatcacccgccttcacggttccctcaaagactcgcacactaagaaccacaccacggtaatcatcgtacactgaatcaaatatcaacgctttcagtggcgcggttaagtcgccatcgggggccggcacatttttaacaatttgctccaaaatatcctcaatacctattccagccttggcgctcgccaaaaccgcattagaggcatcaattccaatttcatcctcgatttgttgccgcactttttcaggttctgccgatggtaaatcaattttgttgattaccggcaatacttccaaatcattgtcgattgctaaataaacattggccagcgtctgagcttcgacaccttgagccgcgtcgactaccaatacggcaccctcacaggcagccaatgatcgtgaaacctcataagagaagtccacgtgaccaggagtatcaattaagtgaagggtgtacgtttcaccatcctttgcatgatacttcaatgccaccgcgtttagtttgatcgtaatgccccgttcacgttccaaatccattgtatctaacagttgatcttgcatctcccgcttagataccgtatccgtcaattcaagaattcgatcggccaatgttgattttccatgatcaatatgggcaacaatggaaaaattgcgaatatgtttctgtcgttctttcatttcctgtaaattcatcgttaaactcactttctccgtgtttcactcttctaagtataacaatgctttccatacatctcaatctatatccaaaacccactcaaaaaaagagtgtgacagcacagccacacccttaattcgtttgattaatcatcgaaagcatcttttaacttgtcaaacacgctttttttaacacccgaaacgcgttcaccactagcagcagcaaaagccgtgagggcctctttttgccgtttattgagattcttcggtgtttcaacgcgaacggtcacgtgctcgtcaccattccctttaccgttgagtttgggagcacctttaccacgtaagcggaatttagtttcagtttgcgttccagaaggaacctttagtttaacgtcaccatgaaccgttttaacctgaatttcatcccccaaggctgcctgtgaaaaactaatcggttgatcaaagtagatatcagccccatcacgacgaaattcacgactcggcgttacatggaaaataatgtaaagatcaccgtatgggcctccattggcgccagcttccccttggttttgtaaccgcatttgttgaccatcgtcaacaccggcaggaacattcacctttagttcatggcgctgtgcaacatgtccggagccaccacaagtagtgcatttttctttaatttcttttcctgtaccaccacaaacatcacaggtcgtttgtgtccgcatccggcccagcggtgtattctgaatcacatcaatcacaccgcggccaccacacttcgagcaggtcacgggagaagtgccttccttagcccctgtaccatgacaagtttcacattgcgcatcacgattatacttgatagtggtcgttttaccgaagattgcttcttcaaatttaagcgtcatcgtatactgtagatcgcgtcctggttgtggtgccgacggatcgcgccgacggccaccaccgccaccaaagaactgactgaagatgtcatcaaaaccgccaccgccgccaaaaccactgaagtcttgaccgccgccaaagccaccaaacccttggccttgtggtccagctgatccatactgatcgtattgctgtcttttttgtccgtcactaagcgtctcgtaggcctcgttaacgtccttaaacttttgctctgctcccggttctttattgatatccgggtgatactttttggagagcttccgatatgcttttttaatttcatcctgcgaggcatccttagacacacccagaacatcataataatctttttctgccattatggtcctccaaaacaattactgcattatttataccacattttgttagacgaagtaaaagccaaagtccacaaaatgtcctttggccttcactaaatctaatttaaataacactattccttagcaaaagcggcgtctagacaaacactacttcttgtcgtctggatcaacttcttcgaagtcaccgtcaacagtcttaccatcgtcgcctgatttgtcgcccttatcgtcggcggcaccatcagcaccaccttgagcctgttgtgcttgttgataaagtttaacggaaagatcttggacaatcttgttcagatcatctttcttagtcttcatttcttcaacgttgttgtcttctttagccttcttcaatgcatcacgtgcatcttcagccttcttgacttcttcgtcagaaaccttacccttcaaatcttccaaggtcttatcaacttggaacaaaagttggtcaacttcgttattcaagtcaacttcttcacgtttcttcttgtcggcttcttcgttttccttagcttcgttcttcatacgttcaatttcttcatcagttaatcctgaattactcttgatcgtaatcttttgttccttgttagttcccatatccttcgcagaaacattaacaatcccgttcttatcgatatcgaatgtcacttgaatttgaggaacgccacgtggggcagctggaatatcagtcaactggaagttacctaacgtcttattgtcagcagccattggccgttcaccttgtaaaacgtggatgtcaacagccggttggttatctgcggcagttgagaaaacttggctctttgaagttggaattgtggtgttacggtcaatcaacttcgtgaagacaccacccatggtttcaattcctaatgaaagtggtgtgacatcaaggagaacaacatctttaacatcaccagtcaacacaccaccttgaacggcagcacctaaagcaactgcttcgtcagggttgattgagtggttaggttccttacccgttaaatcacgaaccatatcttgaacagctggaatccgagttgaaccaccgttaaggatcacttcatcaatttcactgaatgataatccggcatccttcagggcattcagaacgggttgctttgtcttttcaacaaggtccacagttaattggttgaacttgacccgtgataatgatttttccaaatgcaatgggcctgcagcacctgcagagataaatggtaagctaatttgagcttcgcttacaccagacaaatcttttttcgccttttcagcagcatctttcaaccgttgtaaagccatcttgtcttgctttaaatcaacgccattttcttgtttgaattcatcaactaaccagtcaatgatcttttggtcaaaatcatcaccaccaaggtgtgtatcaccattagttgagagtacttggaaaacgccatcccctaattcaaggacagaaacatcaaatgtcccaccaccaagatcgtaaaccaaaatcttttcatctttgtcttgcttatcaaggccatatgctaatgatgaggccgttggttcattgatgattcgcttaacttccaaaccggcaattttaccagcatctttagttgcttgacgttgcgcatcattgaagtatgcaggaactgtgataacggcctggttaacttcatcgcctaaatagtcttcagcatactttttcaagtactgtaagatcattgctgaaatttcttgaggggtatatttcttgccttcaacttcgacagtataatctgcttcgcccatgtggctcttaattgaaacaattgtgttggggtttgtgattgcttgacgtttagcaacttcccctacttgagtctcgccatctttaaatgaaacaacagatggtgttgtccgactaccttctgggttagtgataatctttggttcgctaccttccatcacagcaactgctgagttagtagttcctaaatcaattccgataattttattacttgccatatttaattacctcttcttttagtcatttattattgtgcaacgacaaccattgccggacgtaaaacccggtcttggagctgataaccggcctgtaaaaccttcacaaccgtatctggcttttgatcaccttcaacggcaacactttggacagcttggtgaacggatggatcaaacttttggtttaatgattcaatctctttaacaccattcttagtcagtgcctcactaagatgatcatgaaccatttgaatgccctttttcaactgttgtccactctcgtcatcaacgtcaatttccagggcccgttttagattatccatcactggcaaaatatcttttgctaaagattgaccgtcatacttaaggatttgggcctgttcttttttaaaacggccattcatattttgaatttcagcttcggctctcaagtatttatcctcaaagtcgtccgctttttgctttaattcatcaattttcttttgttcatcagatacttgatccgccgattggtcatcggccgcagttgcttgatcatctgtctgttttacatcttcagattgtgcttgctcagccgcttgttgtttttcttgatcggcttgtttgtcagtcatttaacattcctcctactgatcataataatgatgataataatctaacaattgacgcgccaattcttgacgaaaggcactgacaatgccgatagttcgtgaatatggcattcgtgttggtcctaacacagcgataatacctttgccatactgatccacgtcataggttgcagtgatcaaactaaagtcatccaataacttgtttgaaatttcactcccaattcggacatgaatgtcatcatcctcaggatcaaggaattgtgacaggttctcatttttatcaagcatgccatacagttcctgtaaatcattgggatcatgattatgcgaaaaaccaagtaggttcattcgaccaccaacgaaaaatcgctcggatgccgcatgtgataaaatgctatcaaaaatccccagtaagccgtcaggactatgcatatactgcacaacctgcatcggaatatctcgttgcagtcgcactaaaacttcatccaacggcagccccgcgagctgatcattaattaaccgaatgacggcctctaactcctcggtattcatatctcggggaatggcgaaggtctgattctcaacatcccccgtatcggtaaccaagatcgccatcacttgatggtttcctaacggcaccagacgaaagccactcaggcgagcatgtttttgctctggtttcaaggtgaaggtcgtgaacgacgtcagatcagaaagaatatcggctgaccgtgagacaatttcatcaattttatgaaaattagacccaaatgaattacgaataattgccatatcattattatcaataaccatcttttgatcaagaagatgatcgacatagtaacgatacccttgagtcgacggaatccgaccagacgacgagtgttctttaacgagtagcccctgttcttcaaggtctaccatttcatttcgaatcgttgctgaactaaccttcatcggtaaatgttgcgctaaaacttttgacccgaccggttgaccggtaacggtatattggcgtacaatcgcttgcaggatcgcatcttgacgctgtgttaacatcattatcacttcctttttagcactcgaaggttctaagtgctaaacacaatgtataatataccaaccacccgaatgaaagtcaagaaaagacactattttagaaaggatttctaatgaaacataaaaatcagcgctacgttcaaccacaaaacgtacacgatgcaatgatgacaatcgaaaaattgtttaatcaataccgccatgcacctctgacgcaagaactactcagttaccaccaaaatttaattggtcgcctgcaaggagatatttaccaagaggctgttcgcgaaaacaatgccgcacaattagcagccctaaccaccatgattcagctcatgcagtcatggactcgaacccgaatgacaaaccagcccttccacgctaaaatgaagcactttaaatttgcggctgaaaacactgtacaattcaaacgccatgttattaagaataattcaaccagcgggcaccgatcatcccgccattaaaaaaattcgagcaaagtaaatttgctcgaattttttgtttcttatatcaaagaatatgtttgttgcatcgcttgtgctaatgcatgtttagtatccagctcatcatgctccaactgttcaatcaacgcctcaacggttgtatatttaatctcatcccgtaatcgcgcaatccatcgaactttcacgttttcaccatagatcatctgtttaaagtcaaagagattgatctctaacgtcttcggccgctgatcaccaaaagtaacattataaccaattgatgccatgccatcgtaccagcgatcaccaatttgtaattgcaccgcatagacaccgacactcggcattcgttcttcttctggccattcaacattagcagtcggaaagccaagcgttcgaccacgcgcttccccatgaacaacaacccctgttgtttgatagcggtagcctaacaagtcattgaccaataccatatccccattatcgatagtctgtcgaattcttgatgaactaatttttaatcgcttatccatttgtgctggaacttctacaatatcaaatcgttgttgactgtagcgcggcaaattttgcatcgtggccaccgtttttggaccatatgtgtggtcaaacccggccaccaccgtatccgcatgaaaaccgatcatgtactgatcaacaaattcttgtggttttagtgctgatagggcagaagtaaaactaacaacatagactaggtcaacccccagttgttgtagcagatccaacttacgattaacggtcgaaaggtacgtaactcgtttcttactggcctgatagacaattgctggttggtgatcataggtcagcactgccaaaggtagttgcttttgctgagcaatttttttagcttgttcaatgactgcttggtgtccgcgatgaacaccatcaaaaaagcccattgccaaaacaactttcccggtaggaatttgatcgggattaaatggatgtctaatattaatgacctgcaagatgaagtctcctttattactcattttactaatctaagttcaacattttcagtggctgataacaagcatgttgtgtatttttctgataaagtgctcgaatttgatgatcaaattcaatcgcaacgattgggtcgtcgacaggcacctcgctaagcttgagccaaattccgttcttaacaccggcccatatgtcgcccgtaatcgtcacgcgtggaaattcatccaacgcatagtccagtgggaacatgatttcatttaacgaatcagtcgcaactgctgcttcaatttccgctaagcttttggcttggtctaagctaaagccgccactcttaagtcgtgttagatcgctcataacacccggataccctagatgacgcgctaaatcaactgctaaggttctcacgtatgttcccttactacactcaacaacaaaggaaactgtttgttgatgttggactgaatcataatgactactagttaattcaaacttagtaatcatcacttgtctttccgggcgaaccactgtttctccggctcgtgcgtattcatacagtttacggccattaaccttaactgctgaatacatagggggaatttgggtaattagccccgtcatcgtctgcatctgatgttcgattttctcgacttcgatgggacgatcaactgacgcagtctcaaccacctcgccatccaaatcttcggtcgtcgtcattttaccaatcagtaattgtcctcgatactgttttcctgatgccatcaaatactcaacgaccttagtcgccttaccaatacaaattggtagaacaccatcgacgttcggatccaacgttcccgaatgaccaattttcttcgtgtgtaaaatttttcttaattgattaacacaatcatgactcgtcatgccgcgttctttatacagtggaattattccgtccataactttatctttcctccaactaagctaatattatagcataataaaaacaatcatctgtgttaaaacaaatgattgtttttattttagtcacgcttatgcatttcattgattagttgatcaattcgcgaaccatactgtactgaacgatcacgttcaaaaatcagctctggggtcttaaaaatattaagacgtgaaccaagttcgctacgaattaatccagtcgccttttcaagaccggtctgcgccttctgaccatccgaagccttatcagataacaaactataaaaaatcgttgcttgttgtagatcgcccgttacatcaacacccgtaatggtaatgccttgtacccgtggatctctgacccgcttcaataaaatatcgtcaacttcacgttgaatttcttgacttaagcgtccgacgcgataacgtttatctggcattggtttcctccttaaaagttaacctacttaaccggaacttctttcataatgtatgattcaatcacatcattgaccttaacatcattgaagttttcaatcgtcaaaccaagctcatagccttgtttaacttccttaacatcgtctttaaaacgtttcaaacttcctaacttgccttcatacacgacaacgccatcacgaatcaaacggatgctggcatcacgggtaatggcaccagaagtgaccattccaccgacaattgtaccaaccttcgaagccttatatagttcacgtacttcaacttcgccagtaacttgttcctcgtatactggttcaagcatccccttcatagccgattcaacctcatcaatggcattgtaaatgacacggtgtaggcgaatatcaacactaccactatcagcctgagacttagcttgtggcgttggacgaacgttaaatccaatgataatcgcgtttgaagcttctgccaaggttacatcactttcattaatcgcaccaacagctgtatggataatgtcaaccttcacaccatcaaccttaatcttcttcagactttgtgctagggcttcaacagaaccttgaacatctgccttaatgatgacaggaacagacttcatctcaccctctttaagagagtcaaacaagttgtcgagtgtgacgtggttcgtgttagcacgttccgctacaagcgctcgtttagcacgttcttcaccggcagcccgggccgtcttttcatcttcaaagacaataaaccgatccccggcttctggcacatcactcaatccagtaatttcaattggtgttgaaggcgttgcttctttaatacgacggccacgttcgttggtcatcgtccgaacacgcccataagtattaccgacaacgattggatcaccaacgtggagcgttccgtgttgtaccaataaggtcgccactgaacccttgcccttatcaagacgggcttcaacgacagaaccagcggcgtgttgatctggattggcctttaattccatcacttcggcttgaagcaagatcatgtcgagcaattcatcaagattcttaccaaacttagctgaaatttcaacaaagatggtatcgccaccccagtcttctgggattaacccgtactccgttaattgttcagtaacgtgtgatggattagcacctggcttatcaatcttgttaacagcaacaataattggagtcccggcagccttggcatggttaattgcttcaaccgtttgtggcatgacaccatcgtcagccgcaacaactaaaacagtaatatcagtgatattggcaccacgagcccgcatttcagtaaaggcagcatgcccgggtgtatcaaggaacgtgatctctttgtcgttgtacttaacttgataagcaccgattgcttgcgtgatcccaccagcttcaccttcagtaacatgggtatgacgtaacttatcaagcaatgtcgttttaccatgatcgacgtgtcccatgaccgtgacaactggaggccgtgatactaaatgatcggtattcttttcttcttcatcaaagaacttatcaatatcagcaacgtcaacctctaccttttcttgggcttcaatgccataatcagcagctaagatttcaattgtatccttatctaacgactggttctggttaaccatgacacccaacataaagagtttcttaacgatttcggctggttcccggtgcaaaattttacccaaatcctgcgcattcatcccaactgaataaattaaggtttctggtaacggacgatctttacgaacagcaactggcttgttattcgtctcacgaattcgttgattcttgtttttctttttattcttcttattgaatcggttattgttccgattgtacttactattgttattattcttcaaacttccaccaaagcggccgccgttactgttattatgttgatggccagcattgttactccctgcattatttcggctattgttgttttgtccgcgacgatcgttgttattagtacgttgatcgttagcccgttgtgaaccattgtttgaaaaacgatggttgttattgttagtcgtgcttggttttgtcgaagtactattatcgcgacggtggttgttatttacttgaccattgccactctgagaattccgacgttgttgaccatccgaacgatggttattgttattaccattacttcggttttgtggtcgttgttgaccattatttgaatgtggccgcgtctgattactatgcccattagtttgactgctagtcgtcgatgactttgctggttcatgacttctaacaggatgttgactgtgcgtattatttgaacggttgttggttgtcgacgttgtttgagcttttttggaacccagtgctgaacgaagctccttcgcttgttgttcatcaactgatgacatatggttcttaacactcatgccttttttcttagcaacatcaaggacatccttactttcaaccttgagttccttagctaattcataaattctttcttttcccattagctcacgctcctttatttacatatgcagcagctcctcaattttatgggcgaacccagattgagtaattccatagacggtccgagcttgacctgtggcagtattcagctgttgcttttcaaatgtgatatcaaatggcacttgataatagtgacatttatcctgaaattttttacttgttgtcttaccagcatcactggcaatcaaaaccaattgcaccttctgagacctaatcgcttttaatacagtatcttcaccagaaattagttctccagctcgtcgcgcaattccaagtaaatttaaaattgactgtctatttgtcattgccaaataattctcttctggcctgttgatgatcgacatagttgattaattcatcataaaatgaatcttcaatctttatgccaaacgccttgtcaaaagttcgcaacttctgtgcctttttggcaacatcaacattaattgaaacatacgctcctcggcctggctttttgccagttggatccaatgaaacctcattctccttgtttttgacaattcgaataagttcctttttaggcatcatttcatcagtcacaatgtccttgcgcattggtaccttacgttgcttcatcgctcttcaccccgcttggttattcgtcttcttcaatgcttgttgacgtatcgtcaactgtttgatcatcactaacttcgtcttcatctgcatgatcagtttgtgttccttcagcaatcgactccgcctcagattcaggcttgatatcaattttgaagttcgtcaggcgagccgccaatcgtgcattttgaccctttttcccaattgctaatgacaattgataatcaggaacaatgacggtacatgctcgttcgttttcttcgtcaaaaattacatctaaaacctcagctgggttgagtgcattggcaatatattgtgcgggatcatcgacccattcgacaatatccatattctcgccacccagttcgttaacaatttcttgcactcgttggcctcggggaccaacgcaagtaccaactggatcaatattggcatcattcgagcggaccgcaattttagcacggtctccagcttcacgagcaatcgaaacgatttccacgactccatcataaatctcaggaacttccttttcaaataatcgcttcaaaagttccggagctgtccgactgacaaacacttgaggtcccttagtgctattttcaacccgactgacaaatacttgaattcgatcatgcatcttgtaattctcatttggcatttgatcttgcttgctcatcacagcctcaacgctaccaatatttacataaatgaagcggctatcctggcgttcaacttcaccagttacgatttcattttcgtactgactgtacttttcataaatgacactccgctccgcttcacggacacgttgcatgatcacttgtttagcagtctgtgcagcaattcggccaaagttttgtggggtaacttcaaaacgaatttcatcgcctaattcatatccccggttaatttgaacagcttcttctaagcttacttccaatcgatcatccgcaacttcttcgacaaccgttttgacagcgtaaaccttgatattacctttacgagcatcaaaatcaacctcaacgttttgagcctgaccgtagttacgcttgtatgcagaaactaatgcagcttcaagggcatcgataacgatttcctttttgattcccttttctttttctaaggcgtctagggcaccaatcaactctttattcatgattacactccttctactctaaaacttaatcgctaatcgagccttagcaactttttggcgtggaatgacaatttgcttatgccgtgttttaacgagataatctaatgttaattcgtcttcagtaacgttttctaaggttccttcgaaaatcttggcaccatcaatgggctgatacagtgaaacatgaatatacttaccaaccgcacgatcatagtcgtcaggctttttcaaaggccgttcagcaccaggtgatgaaacttctaagaaataggcttgtggaattggatcgggatccaattcatctaatttttcacttaataaatcactaacttgtgcacattcttcaatgttaataccgtcttctttatcaatgtaaactcgtaagtaccagcttttgccttccttaacaaattcaagatcgtataattcgaaatgacgttcctctaaaattggagttaccaactgagtaacagtttcgataacactactcacaaaaacacctccaatatttttgcactaaaaagagcgagcatcgctgctcactcatttacgagttttaattactctactaatctatcacaaatcaatcatttaatcaaataaaacccgcgaaagcccatcgattaaaacaacgaaagctggttttcatctggcaaatcatctaagacatgattatttgtcataaattcgatcaacgtcttcgaaacttttcctcggttagccaaatcttcctttgaaaggaattcacgttcttcacgtgctgcaacaatctgttttgcaacgttaagtcccagaccaggaacagctctaaatggggcaatcagacggttaccgtcgatcaaccagttggaagcatctgaacgatcaagatcaaccatttcaaattcatatccccgttctagcatctcattagctagttcaagaatcgttagcagtcccttttcctttgcagaagcatcgttacccttatcgttgatttccttcatagcggctttgacagcatccttgccgtgcgccatcgccacgatatcgaaatcatcggcacgcaccgagaaatatgaacaatagtaaacaagtgggaaatagaccttaaagtacgcaattcgcagtgccattaaaatatacgccgccgcgtgcgcacggggaaacatatacttaattttcaaacaggagtcgatataccaatcgggcacattcgattctttcattttagcttgccaatcgtctggaatcccacgtcccttacgaacatgttccataatctgaaatgcaatttcagaatccattccatagtgaatcaaatcggtcataatgttatcccgacaaccaatcacattcgcaattgtggctgtaccattcttaattaattcttccgcatttcccaaccacacatccgtaccatgggaaagacctgagatttgtaatagttctgaataattgcttggatgagtttcttcaagcatcccccgtacaaaccgcgtcccaaattcaggtacgccaagtgttccagtcttagaaaagatttgatcttcgtcgacacccaagatctctggactcgaaaacaggctcatcactcccggatcgtcagttggaattgtctgaggatccactccagaaagatcttgcaacattcggatcatcgttggatcatcgtgtcccagaatatcaatcttcaaaatattgtcatgaatagaatggaaatcaaaatgggtcgtctgccaagccgcagtttgatcgtcagcaggatattgaaccggcgtaaaatcataaatgtccatataatccggcacaacaatgattccggccggatgttgtccagttgtccgtttgacacctgttgcacccttggcgaggcgatcaatttctgcattacgaagttgttggttggtgtcacgttcgtatgctttcacgtacccataggcggttttatcggcaactgttccaatggttccggcacgatacacattcttctcaccaaacaataccttagtatagttatgcgcaatcggttgataatcaccagaaaagtttaaatcaatatctggtactttatttcccgtaaacccaaggaaggtttcaaatggaatatcgtgaccatctttaaccattaaagtcccgcattcaggacactccttgtccggtaaatcatatcctgaactatattcacccttcgtatagaagtgtgtatatttacactttgggcaccgatagtgtggtggcaacgggttcacttccgtaattcccgtcagcgtcgccacaatacttgacccaacagatccccgtgaaccaaccaagtagccatccttatttgattttgcaaccaatcgttgcgcaattaaatagatgaccgaaaatccattaccaacaatactcttgagctcccgatcaactcgcttttgaaccagttccggcagtggatcaccataccattctttcgccttgctaattgtacgttcctgaatttcatcctcagcccccaccatcttaggcgtatacagcttatctttcagtggatggacatcagcaatcatatctgcaattttattcgaattttcgactacaatttcatgggccttatcatcccccataaatgcaaatgcgtctaacatttcattagtggttcggaaatggacatctggtagcatctgccgatttaacggatttcccgcctgggaatgaatcaaaatttttcggtaaatactatcctctttattaagataatgaacatcccccgtagcaacaactggcttacctaactcatcaccaatttcggtcatgttcatcaaaatttcttctaggtttgcatcgtctttaattaattcatcttcgatcaacggtgcatataccgccttgggctgaagctcaatgaaatcgtaaaacttagctttttccagcgcttcatcacgccccttttgcatcatcgaagtaaatacctcgcccgaagaacaagccgttcccagtaataatccttcacggtacttttttaactgactacgtggaattcgtggtactcggtagtagtattcaacattcgaaagcgatactaatttaaaaagatttttcaatccaacctgatttttgactaagatggtcacatggaacggtcgcgcatgacggtatgcaccattatcactcatatgttcatttaactgatcatgaaattgaatttggtaacgttcttcggcatccttcaaaaacagatgtaataaatgaccagtagattctgcatcaaagattgcacggtgatggtgttccagtgcaacgccaaatttcttagctaaggtattcaatcggtagctctttaattctggatatagaaaacgtgccaatgtcaacgtatcaattattggattcgcaattggttgcattccatgacgcgcgtaaccggtattcatgaacccaacatcaaacgtcacattgtgtccggcgacaatacagtcaccacagaactcacgaaatagtttaaaaacttcttcttccgattttgaaccgcgcaccatatcgtccgtaatactagttaaattggtggttgtttctgacaaatgaaaaccaggatcgatgaattcctcaaactcttcaagaactccgccatttttcattttaacggccgacaattcaatcactttatcatagatcgcagatagacccgtcgtttcaacatcaaatacaacgtacgtcattccttccaaaggaacatgcgccgagttatagccaatcggaaccccatcatcaacaacattggcttcaagaccgtaaatcatcttaataccatttttttccgctgcatggaatgcatctggaaatccttgtaccccagagtgatccgtaatggcaattgctttatgcccccacttagccgcctgtttagcaaaatcaccgattgaattagtagcatccatcgtactcattgaagaatgcaagtgtaattctacccgtttttctccctccgcagtatcttgacgacttggatggttgacagcattaatatcataggcattaattgttagatcacgcataaaagtatcttcttgaactggtccccgaacctttatccagtcaccttcattaattgcgtcaaattgcgcttcatcttcttcattacgtgaaaactttttaatcgtgatggatgatgaatagtccgttatctctaggatcaacagtttacgctgtgatcggagggttcgcacttccttactaaaaatatagccttcaacaattaccgatcgttcttcctcagtaatatcttcgagtcgacgagtttcaccattgtcgctgattgtttttccaagtttcacaggacccgtaacctcaaccgtgtggttttgttggcgcgccccagctgccttaatttgagcggcagctttagcagccagttcggcatcttttttaacttgttgtgccttcaatgcttggatttgagcctctgaagcactttcatccaccatcgtgtgaatcgaaaatttgggaaatcctaaatttctgtacccagtctcgataggacctaacgcttgattaaccagataatttctgacaatttcgttttcagccacgaacatcacccgatcatctgtcacatttggcacaccacgactacatagttcctgcaacatcggtgatgataaaccactatttgaaatcacgtatcgccaataatcggcaatcaagcgctgatcaagtcgttccatctcagtactaatttgccagttaaccgttgcaatatccgcaaaaccaagctttaactgtgtcgtaaattgcgaaaacaaatcaaatggcaaaacattttgaaagtgaaaatgaaattcccacgtttttgactgccgatgaacaaccacttgctgaattgatgcctcggcaaacgcctcattttggagatcctcaaaatgaatttgttgtaataatttttgaaataactcatgttgtcctaaactcaactatttgacctcctaagaaaaaaacgatgtcgttcaattagagtcagtaaagcttctccaactatcactacatcgtctttttattaaccatttttttggtcgtcagactttaagagaatttgaatcgtattgacgagttcatcttcacgcacttcaattgtttcgccagtcttacgaattttaacttctacaatgccctcagctgcttttttaccaatcgtaacacgaattggaattccaattagatcagaatcggcaaacttcacaccagcacgttccttacgatcatccaacaaggtttctaacccagcctcttgcaagtttgactctacggaaagtgccaacttgttttgcgcatcatccttaaagttgattggcacaatatgaacgttataaggtgcaattgcgttaggccatacaagcccattttcatcagcgtattgttccgccactgcagaaagtagtcgggtcatgccaatcccataacatcccataatcacgtcaacacgtcggccgttttcatctagcacttgtgcatttagtgattctgaatagcgagttcccaacttaaaaatgtgaccaatttcgattccacgagtgaatttaagtgttcccttaccatctggtgccatttcgccttcttgaacaagtcgaaaatcaccaaactggtcaacacgaaaatcgcgaccgatatttgcgttaatgtagtggaacccatcctcatcagcaccgaccggtacgttaaccatatcttcaacgtattggtccgctaaaatagtcacgtcttcaccaacaccaacgggtcctaatgatccgaatgaagcatgcaaaatttcggcagtctgttcaggcgttgccatttcaagatcatcagcatccaaatagttggttactttcacctcattaacctcatgatcaccacgaacaaggaccatcactggtttttcgtccgccatatagaacagagtcttaacgacaccactcgtttcaatctttaaaaattcggcaagttcttcaaccgttttaactcctggcgtttcaattttttctaactcaagtggtgctgcgtgtgatttatgactgacaaattgactcgttgccatttccaaattagccgcataatcactttcatcagaatatgcaattgtatcctctccaactgctgcaatagcggaaaattcttgtgagccactaccaccaattgcacctgaatcagcaataattgtccggtacttcaacccaattcgattaaagattcggttataggcgatggccatgttgttgtatgcttcatctagcccttcttggttgacactaaatgaataggcatccatcatactgaattcgcgtccccgcaaaataccataccgtggccgatcttcatcccgatatttattttgaatttgatacaacgtcaacggtagttttttgtatgacttaatgctgtcccggataatttcagtaaaagtttcttcatgcgtaggtcccaacacaaattcacgatcatggcgatcgctaaacttaaataaattatcaccataggtttcgtaccgacctgtttgtttccacaactcagcaggtaaaattgcaggtacgaccatttcggccgcatcaatcttttctagctcttctcgaacaattttctcgacctttgtaactacccggtatgccagtggtaaataggcatgggccccagctgcaacttgataaatatagccggcacgaagcatcattttatgactcaatgcctctgcatcacttggaacttctttaaccgttggaataagaatttttgactgtcgcattaatataacatcctccctaattatctaaagaaatatcgttgaatatcattccaagttaccaaaatcattaataacatcaacaaaccaaacccaattaaggtaacaattccttctgctttctctggaattggctttcttctaattgcttctaatatatttaatagtaatttgccaccatcaagtgcaggaatcggtagtaaattgacaatccccaaattaattgaaagaactgccaaaaaattaagcactcctgtcactccaagagtagttgcttgcgaggttccggcataaattgcgaccggaccaccaaagtcatttaaattaaatccgtgtgtaatcatatgacccaaaacaccaaagatcaagcttacaatcgtcgcaaactgcgtccagccatacgaaattcgcgctgtaaagctggtatttaattgctccgtcacaccaatttgacccacggttgttttaccctgcttaactgtctttggcgtcaccgtcattgtcagctttttagatcctctgtgcacagctaacttcaatttttgtccgggatgtcccgaaatttgagtcgctaagtcattccaatttgaggtttgatattgattgaccgaaactaccttatcaccagactttaatccggctttggcggcaaccgatgactgattaacttgtcccaacacattgctattcgtcgggattcccggcaacataaatcccaatccgataaacaccacaattgctaagataaaattattcatcggtccggcaaaattagtcatcattcgttgcaataatccggcagactggaactgtacgtcccggggtgcaatacgtacctcggtaccatcctgttcaacaatcgttgcatcatggtcaacatggaaatgcttcagttcactttcatcaccattaacatagccttcaatatacaactcatcaactaaatcagaatcgacaacctgcattggaataccactaaatagcgttgttttctggctggcattaatcatggtcacaacgtcatcatcacccatttgcaggctaacaggtgtcccaggcttaagtgtatcttcatcatcatcctgtgatccagccatgcgaacatagccacctaaaggcaatatccggattgtatatgttgtcccattctttttataccaccaaactttgggtcccataccaattgaaaattctcgtaccaagattcccgctttcttggcaaagtaatagtgcccaaattcatgaactaaaacgagaatcccaaaaacaatgatgaatgtaattatcgtaactatcaaaggaactccttcttacctgttttgactaaataattcctagcaggtacaaacacggcattaccaacaacatgctatcaaatcgatccaaaatgccaccatgtcctggcaaaattttaccagaatctttaacgccatagaaccgttttagtgcagactcaatcaaatcaccaaactgaccaataatcgacaaaattaatgtcaggccaaccatgaccacccaactgtagccgacgggaaagaaccataaataaactgccagaataattgttgcagcaacggttccgccaatcgacccttcccatgtcttattgggactaattcgcggtgccaatttatgtttaccaatttgtttaccaatcatatatgcgccactatcagtcagccatacgattaacattgcaaacagcaatgtcgtaagcccatctgctcgggcactaatgaaatagtggaaaccagtaccaatatatagcattgccaacgtcaagacaccagcatcatcaaatgtaaatcgttttttcttaaccaccgtgtgcaacaaaattagcatcacaacgacataaaataaaaagaaacggttcaattgacttggcaaccaagttaaccaattatctggaacaattagcaaaatgacgccaatattactaaaaatagcttcaaatgacacgagaagcatctttttcatgattaaaacttcatctagtgcgataattcccaataccaaagcagctaaggacagtggtactcgtccatatacgattaacgggataaaaattatcagcgcaatcactgccgttataacacgttgtttcatctatttactccattcattattcaaatttgagcattattttgtcaagccgccaaaacgacggtgccgtccctgatactcaataattgtttgtttaagcgtttcttcgttaaagtctggccaatgtgtatcgacaaagacaaactcactgtacgccaactgccacaacataaaattactaatccgttcctcaccacttgttcgaatcattagatcaggatcttcatagtctcccaattggcttgtcatcatctgatcagataaaactgactcatcaatttggtctatctttatttgaccatccaccgccatttgtgcaattttctgagttgcacttacaatttcatcacgaccgccatagttcagcgcaaaattgagcaccatcccgttgcattctttggtttgatcaatcgcatcgtaaactgctttttgtgtcccactcggcagttgatcaatatctcccattaccgatacccgaacattatgcttgattaaatcaggaacaaaggtattaaaaaagcgaattggtaattgcatcaggtagttcacttcgtcatctggtcgcttccagttttcagttgaaaaggcatacaaagagagtacctttgcaccgagcttacttgcagcaatcgtcactttcttgaccgtctgcataccttctttatgcccagcaatccgtggtaaatggcgtttttgggcccagcgaccattgccatccataataatggcaatatgagcgggaatacgatgcatatctaactcaatatccggcgcctgttctgaatttgattgtgtttttttaaactttgaaaacactgctgtctctcctattctgctatatcgaatacaccatattctatcaaaaaaacacgccataaactaggtctgataacaggcgtaacaattatttaaccaaaaatccctctaattgtgtgataaatcaacaattagagggacttggtcagggaatgatttaacttaaccctgcattaattcctggcccttatcggcttcaatttgttcaagatccttgatcgcattgttagtcaacttttgaacttggtcttcaagatcatgaaattcatcatcattgaagtctccagctttattgcccttcttcagagcatccattgcctcacgacgaacatttcgaaccgcaacttttgctttttcagtctcagctttaacgtccttgactaattctttacgacgctcttcagtcaattgcggaataactaaccggattgcattaccgtcgttagcaggtgtcaatcccaagtctgaagcgaaaattgcttgttcgatggcttccagttgcgttttatcaaacggtgtaatcaaaagcatccgtggttctggaattgcaattgatgcaacttggttgaccggtgtctgtgctccataatagtcaacagtaacacggcttaaaatactagcattggcacgtccagcacgaatgttacctaaatcgcgttgtaatgcttcgccagactttttcattttatcttttgcttccgacaaaatttccttacttgttgtcatcttgatctcctccaacggttgtcccgattttttcaccacggactacacgcataatgttaccagattcgtttaggttaaacacaaccagcggaatatcattatccattgataatgaactggcggttgaatccatgacgtgtaagttcttctcaatgatatcaaaatgtgacaaactttcaaacttaactgcattttggtccttattcggatctgctgagtaaacaccgtcaacaccatttttagccattaagattgcatctgcattaatttcagccgcgcgtaatgcagcggttgtatcagttgaaaagtatggacttccagttccacctgcaaaaatcacaatccgatttttctccaaatgacgaacagctttccggcgaatatatggttctgcaatttgacgcatctcaattgaagtttgaacacgagttggaacaccaattgattcaagactgtcttgcagggcaagggcgttcataattgttgccagcataccgacataatctgcctgggcgcgttccatccccatttgtgcaccagcttcaccacgccacatgttaccaccaccgacgacgatagcaacctgaacacccatatcatgaacttgttttaattcttctgcaacagtcttaatcactggtggattgattccaaagcctttgtctccggcaagtgcttcaccactcaactttaggattactcttttgtacttcatgtcactcattatgcagttcctcctacaggattaccttgatgatccattatatttcgccaatacgcttcagaaaaaaagacgtacagactgtacgtcttcgggcaagattagtctttgatctgacccataacttcttcaacaaagttatcagctttcttttcgattccttcgccaacttcgtaacgaacgaatgacttcaacttgccaccctttgattcaacatattttgccactgttacatctggatccttaacaaattcttggtctgccaagctaatctcagcaaggaacttgttcaaacgaccagtaaccatcttttcgatgatttgtgctggcttgccttcattttgtgcttcaacagtcaacacttcacgttcatgatcaagacgatcttgtgggatatcttcacgagaaacaaattctggattaacagcggcaacatgcattgcaacgtctttagcagtcgcttcatcagcgccttcaataacaactagcgcaccaattcgaccacccatatgcaagtaggcaccgaagttttcgctatcgctcttcttcaatacttcaaaacgacgtaagctaactttttcaccagttacctgtgttgtttgaatcaaatcatcatttaaggtgccattttctgaaggcaaagccaatgcagcttcaacgtcagcaggtgcttccgcagcaattttagctgaaaccttttcgattaagtccttaaattggtcaccaccggatacgaagtcagtttctgagttaacttccacgattgcagcagtattaccgttaaccttgatgtcagttaagccttctgcagccacgcgaccactcttcttagcagctttggccatacccttttcacgcaaaaagtcaacggctttttccatgtcgccttcggttgcgacaagcgccttctttgcgtccatcataccgacaccagtttttttacgtaattccattacttgtgctgctttaatttctgccattttaataatctccttagttgggtaaagtttggtttacaaaaaaaggcgtttcatgttctcaggccaatacggtcctaatcacaatgaaacagcctaagtttaactattaaattaaattacttgccttcaacagtcttctttagatctttcaatgatgcaccagttacttctgcaggcttttcttccttagaagcagcttcagcagcagcctggtcgtcagcaccttggttaccttcaataacagcatctgccatctttgcagtaatcaaacgtacggcacgaattgcatcatcgtttgaaggaatgattacatcgatatcatcaggatcggtgttagtatcaaccattgcaacgattggaatgttcaacttttgagcttccttaacggcaatttgttccttatgtggatcaacgatgaagatcacatctgggatgcgaggcatatcttcgataccaccaaggaatctttcaagcttttcacgttgcttgttaagaagagaaacttccttcttaggaaggacatcaaaactaccgtcttctgccatcttcttaagatctttcaaacgcttgatccgtgtttgaattgtgtcccagttagtcaaagtaccacctaaccaacgatggttaacgtagtattgaccggcacgagttgcttcttcagcaatggcgtcttgtgcttgtttcttagtcccaacaaacaaaacaacaccttcatcagcagcttcattcttaacaaagttgtaagctgagtcgatcatcttgactgttttttgtaaatcaatgatataaataccattacgttcagtaaagataaatggcttcatctttgggttccaacgacgtgtttggtgtccaaaatgaacaccagcttctaataattgcttcatgctaataactgacatgaatatacctccaaattgttttttcctccccgacgctcgattaagctaagcactcattgagcacaactcagctcatcacaccgggtgtgaattggctttaatcaccgctaattagtatacaaaaaaggcccgcttaacgcaagtctttttccacaattaatccgttgaaattagattgtcagcggttcctgtctcaattaattgccgattattatttaagctgacttcaaccatgtttcggactgcaacatcggtataaaaagcggtatgtggtgaaatcaaaacattatcccgattaaacaagttattgaactcggggtaatcaatcttttgatcgcccaaattacgattaaatactttaatttcatcttccatcacatccaaagcagcaccaccaataatgccacgatcaagtccatcaattaacgcttgttcatcgatcagctgtcctcgagcagcattaagaataatcacaccagggttcattttcgcaattgccgtcgcatcaatcatatgctgtgtcgatggaaatagcggaatatgcagtgtgatgaccgttgcttgacggtacaactcatccagtgtatcaacatagagcccttgtcgttccaattcaggattatgaaacttgtcataggcaattacttttgcaccaaatccctgaaaaattcgaattgcacactggccaatgtgccccgtaccgatcacgccaactgtttgttggttcagttctttcgatatctgtggtgcccaacgaaaatcatgtttttcaaatttctgtgtatattcctttgtccgacgaagcagttgcatcaactgggtaaccgtaaactccgcaattgcttcgggtgaatacactggtacattggtcagtttaatccctaatttagccacttgctttaggtcaatattgtcaacaccaacgtttctaagtgacaaattgtagattccaatttcaaccattcgatgtagcatccggttcgaataggacaattgttgaaacgcaactattccatcatatccccgagcctgatcaacggtttcttctgttaatagctgatctgtaagttgtacatcaatatgattttgttcttgccactgctcaataaatggccgttcatcatcgcgaacaccatacatcatcattttcatctggtgatacacctccaatttaattactactagatagtaacagatcactaaaatgaaagcattgaaaacgcatgactaatttcgatactgttgccaatcaatctgatgctgagctaagaacagctcctttgccctgcgtgattgatgtttaaaatagtactcggcactaagggctgctgattttgtatcaaaacgttgcgaatatattagatgaagtggatgacgttttttaactcgtgtatacttcgcaccatgccgctgttgatgtgtttcaaatcgcttcataacatctgtagaaaaaccgccataaaaggtatcgtctgcacaatacaaaacataaaaataataagcttgattaccgtttgccatagagcatctctctcacttctggcccatattgatcatcatcttgagacacaattagcggcggtaaaattttagtaccacccttgcgtccatctttaattgcctcaatcaaaaccatgttagcattgcgaccctgtttgggataaacaaaccgaatttgttttggtgccaagcgatgagctgctagcgtagataaaatttccggcagtcgatctggccgatggactaagtacccatgaccattcatctttagtagtccactcataatctcaatgaccgtatccaaattagttgtcaattcatggcgtgcgattgccaaatactgatttggattttttttgctggctggttgatccgtaaaatagggcggattgcaaactacgatgtctgcactatctttgggaacttgactgaatgtatccgcaatgtccatattcaaaacttgatagcgatccgctaattggttcaatgccacacttcttttggccatatcagcgagtcgaggctgtaattcgatttccgtaatttgcccacgaattttctcattcaaaaacaaccccaccgcaccgttaccagcacataagtccactacccgtgtttttagtttttgatcaggccgaacaaaatcagcaagcaataccgcatctaaagagaaagaaaacacctctgggctctgaatgatcttaatattttggctgtatagctggtcaactcgctcaccatcatgtacataattttgttcgtttagttccataactcgcaccttttttctgttaaagtaacttgcaactgaagctttttttctgcatacttagcaatgtgtcaaaaatacaacagcaccaaaactattgtaggagtcttgtatatgttttattctattcttcgcgtcatcgtccgtgttttactctatattgttaatggtaagccgcactatttaaaccgcgaaaatttacccgagggtaattatatcttagtcgggccacatcgtacatggttcgatcctgtctactatgccttagctgcttcaccaaaaaagttcagcttcatggcaaaacaggaattgtttaaaaatcccattgttcgttttattttgaaacacgttaacggctatccggttgatcgcgaaaatcctgggccttctgtaattaagcggccagtacggctgctgaaaaattctgaactttccacaatcatcttccccagcggttcacgctattcagaccagttgaaaggtggcgccgtcgtcattgcaaaaatggcaggcgtccccttgattccaaccgtctaccaaggaccgctcacttttaaatctctattcacacgtcaaaaagtgaccgttgcctttggtcaacccattacaattgaccgtaaaatgaaactcagtgatgataatcagcacctagtggagcaacaaatgcaaactgcttttgatgctctcgacaagcaaatcgatcctaattttcaatatgtcattcctcaaaagcaccaaaaataacctttgtcataaaaaaaaggggccggaattccggcccttttttatttacctttttttgattgtgcttgcattgcctgcatcatttggtgcagttttttattggaaggtttttgtcccatttgaagcatcatcgtccgaagcatgtcttcattaatgggtggattgtttttcagatagttttccatgtacttacgtgcaatgaaaaagccagctaccaaaccgatgatcaatgcgatcactacaattaaaatccaaacgccggttgccaagttgcatccccctttactaattcaatatataatgttacacaaaaaagctgccattgaaaagaaaaacttcacattcaaggcaattttctttaatcgtcacgcaatccgcgatcacgttgtatctttcttaccttctcaggggtaacttctttcccatctttatcgtacacctgtaacatttcaatattacttctgaacgcttctctgaagttcgccaaaaattcagctcgtagcttcttacgttcagcagtttcttcgtcagttaacccgaccgttttagccttatgtgccagttcattaatcctgttacgaagtgcaaattcttctggtgtttcgctcaatatctctcacctcacttgaaaatccgttactaagcttctcctatcataatcaatcgttggctactgttcaagccggacgtttaaaaaagttcaaaataagcgaacacacgtttgaaactttgctaaatgtatgctactctagtgttattaaagctatttaggggtgtcgaaatgtcaaaaactggcgaaagcaaacaaatggcggtgcttcgattcattcatgatcgggttaccgcacagggatatccaccgacggttcgtgaaatttgtgcggccgttgatttatcatctacttccacagtccacggtcatattaaccgtctcataaagaaagggtttcttcagaaagatccgactaagccacgggcactagaaattacacctgatgggttaaacgaacttggtgtttcaaaacatcaggaacaaattcctctgcttggtgtcgtcacggctggcgaaccgattttggccgttgaagatgctacagattattttccgctgccacccacaatgaacgaggaagacgagcttttcatgctaacaattcgtggagaaagtatgatcaatgccggtattttaaatggtgataaagtaattgtccgaaaacaatctagcgctaacaacggtgaaattgttatcgcaatgaacgaagataacgaagcaacttgcaaacgattctacaaggaagcagaccattatcgactacaaccagaaaacgatacaatggctccgattattctaaaccaagtctcaattttgggacaagtggttggtctatatcgtgatgagatatactaaacaaatacataaaaagcagttaacacaattgttaactgctttttattattgaattaagtaaattcgcttttgatcttgctgcccctgcaacacgtatttttcatgatcctgtgacaaatctaaaaatacatttttcgaattataaccaatctgcgcacggaatagccgttcatattccggcactgacacttgctttcttgccataatcagtttttcaacatcagcctgtcgaaccatttctttaaaatcagcctgtaatatcccggtgaaaaattccccctgcgcaccagaaccatagctaaacaatccaattcgatcaccggattgtaaattatgactacgcgtcaataatgacaacagcgctaaatacaaagatcccgtatataagttacccacctggcgactcaacgcttgacttgcagccaattgcgttctcatgagaacactatgcggatcattttggtcacctaatatcgcatcaagagctttctttcccatcttagtgaatggcaaatgaaaaatcatggctgccatatcactaagtgtttgatcagtaagtgtttgatatctttcccaagttttttgaaaaaagtcaatatacacgctagttgaatatttaccgtcaacgagtgcctcactcgcataaagcggccgccaaaaatccatgacgtcctccgaatagggcacgctaggcccctcaattgctagcactctcggctcagctgaaatcatcatcgcaatcgcaccgccgccctgcgttacctcgccagaggtttcgagaccatagcgtgcgatatctgcagcaatgattagaaccttctcgtccggattgagactaatcaatcctcgggcaaactgtaacgcagccgtaccagaataacatgcttcctttacttcaaccgcacgcacaaatggatctaactgcagcaactctttcacataaatcgccgccgcctttgaattatcaattccagactccgtcgctacaataatggttgaaatttgtttgcgatcttcgtcagtcaaaattcgatccgcagcattagcacccattgtcacaatgtcttgagttggtgggataactgcttgcttttcctgaccaattccgatcaaatacttgtttggatcaactccacgtgcctgtgctaattcggttaaatctaaatatagcggcgtcgtgtaaaaaccaatcttatcaattccaattttcattcattaaatcctctattaacatgacatctcgccgtatagggctaggctctacttcatctgttcaattttttccaatagttgtttattaaccaatggtggtagatagtctgatacgtctttaccttctttggcatactttcggatcagagtgcttgaaacatgctgatacttgggatcagtgagcataaaaaccgtttctacccgactgtccaagtgcacattcattgaagcaacatctcgttcacgctgaaaatcagtcgtattccgaagaccacgaattaaatattgtgcaccaatccgatccattagtttaacatttaactcattagccgtaatcaccgtgatattgtcatatggtgacatcaagtatttgacttgttcaacccgctcgtcaacactgaatattgtttcttggtcgattcgagtattaacaaccactgccaactcgtcaaacaattgacttccacgcttaataatatccaaatgcccacgtgttaacgggtcaaaccctcccggaaaaattgctactttcatcataacctacacgcccccaccattcatttcgagtcaacgcttattgggtttattatatcacacgtcccatattgtcatgatgtttaattcacactggcatagtcaccataaaatttagatcaatttacggattcaaaactattttgcaattttcaatatggtcattcgtatcggcatacagatacaataaagagcgttatatgtatactacaattatttaatttgtatattacataattccggtataacagcaatcatcaaactgaacttttcaattatccatgatactcaattaatattttattgagtattttgacactgatctcaaagaaccaatttgataaaatagattatattttactgtccattcaaacggaatactcacccatatcaataactatataatttcggttataattcgctgaccccaaaaaattatctcactttcaaatgtgttaacttagttgaaaaaattatccaaaatccacctgaaacatttttcaacatacattaaccgcccatttacgaatttctatcgatccgcgtacatcacttagacatgcttgattacgctacaaagccacggcccacagatgaagtcataactatttaaacctgaatagaaaaacaacagaaaaaacgcctcacgtaccgagaaccatttggttaacgtaagtgaggcgtttattatcaaatcaactaaggagagtacaggatttgaacctgcgcgccggtattagccggttcgccggatttcgagtccggtgcattaccactctgccaactctccacaacagatatcattatatcaactgattaccaattggtaaaggtgtttacaccgctaaattaaattttttctgtttttatgactaacacacaagaaattaacattaacataaccaacacaacgtacaccacgttttggatatttcctaccggattcgcagcaaacgccatgccgtacaacgatggaccaaacgcggacatcaaatagccacctgattgtgccatcccagataatctagccgtttcatagggtgaatttgttttaaccgcaaacattgtcattgcagtcataaaaaagaacccgatcgcaattcccagtaagaaactttccagcatccaaaacaacattgaagacgtattctgccaaaataacatgcaacttgccgttagtccactcacaccggcccctatcgtcaacacgattaatacttggttagtagccgttgttaacaggttaggtagcacaattgaaagtggtaggccaatcaatgcaaagcaggccataatcaggccagagttcccagcactgacatgatggtactgcattagtgacggcatccacgctgtgaatgtatagcttaacgtcgcctgaccaccaaacgttaataaaaatggccatgcccgtcgattgcgccacagtttagcggattgcgtctttgttgtttgccattgttttgaacgatcaaccctaattttttcatcaacaaagcgataaatcatcccccacccaagcaacgcaattacaggtgtcaataggagaatccccatcatcatcttccaaccaaatactcttgaaaccggcgccgtgattaaattaaaaacggtattaccaaaaatcattgcaaaggaatacatcgtcgtgtacagcccgatcttgtgtggaaaataggccgttaccatcgatggcataaaaacatttaagtgagcaataccaattccaatcaacacggtccccagaatcatcgttggcattgtcatcacgagtctgagaagagacccggtcacaatagtccccaatgccatcaggagggccttcttgagtccaaaataggccattggttttgctgcaaagttagatagcaacatgaacatgaccaatggtagtgttgttaaaatgcctaagctactctggttcacattcaatgctgtcgctaactttcctaaaaaaagcggtggtgttgtgattggtgcccgcatgatgaatccaattaaaagaataacgactaacattgccgctcccattattttagttttcttcatccacaaagcatctcctctttttaattaagtacaattcagtcgtaacttactaatgataacaccacttattataaattagaaaacaaaaaacgaaccttcgagttatgactatctctcacaaccgaaagttcgttaatttttattgtattagtcgtcgccaagttctttgtagtcaaagaagtcaaacgttgcaggtaaatcatacccagcataatcaactgcagctaagccgacaaatgcaccggtaaagaagccaccatagttttgtaagacataatcatctgaaagcttggctgcatccaatgtaactggcactgcatgccatgtttcaccatcaaatgaatattcatacgtatactcaagtttccgtactttggtccggaaccaaacgtactctgttccttccggaatttgaatggcatcatctttcaggaatgaagtgtaattgttgttgtcgttttgagcaacttcaatcacatgacccttcttttcatcccatgtaatgtatatccatgaccagtgcttatcattgtagaagttcactaaacctgccatttgttggtaagtaaatggatcgaacttgacctttgtttctgcatcaaaattaaaggcttgccatctctgtgccaagaatgatacatcaaacgcactggccagtgaacgacgaccgatcaacttcaattgaccatccccatacgagcccgtttcactcgtaaacggtacgcgtaacgtattccagtcaatatctaaggtttcttgatcaaattcatcatggcgtgaatggtcagctggtgccttcgtttcgatggcatctttaggcgcatcaacttccacttgaccgccatgaccaccaacaatccgaggccacccttcatcgtcccattcaaccttttgaattgacgtttcacggcctaatgggcaccagccacgaggatcatgtgacgattcatttggatgattcaatggccgccccatcaatgatgcgtagtaccactcgccacctggagtgcttgccaaagccccatgtccttgtttctgaatatagaaatctggcgtatcaaaattagtaataaatggtccatcaggttgtgtttcaaacgaatgggcatccaaagtcttcgaacgtgataccacttcctcatgagtccaaactgttccgccttgagccgcaaataagaagtaataaccattgatcttatacagatgtggcccttcaaccagtttaacgtccgtgccatcataaatggtccgtgcagtttcaggtttcagcttcatagttgctgtatcaaattcagtcaacgtaataccatcgaatggatgatgatattcgcgatgatcccatgtctgttgaacaagatatttccgtccatcatcatcatggaatagagatgcatcaaatccgacaccattcacacgaattggatctgtccatggaccatgaatatcttcggccgtcgtcaagtagttggtcatatccttaaaggccccttcagtgaccttaacatccgtatagatcaaccaaaactttccatcggcatacgataagtcaggtgcccaaatgccaccagatgcaggattacccttcatatccagtaatgtcgttgttgaaagtggtgatggcaacaaattccagtgaacaagatccttcgactcatgtagccgtactccagggaaccattcgaacgttgagtttgcaatatagtatgtgtcaccaacacggatgaaactcgggtcggcattaaaaccaggtaaggcaggattcttaatcttcattgtgcatgtcctttctacaataaaataattttttctagttaatcaacttacttcgtaattctaaagtttaccttcagctttacgttcatcaatttctttgttgatccggacaacttctggatcagtcaatgggtaacggctcataatccaaattgcaacaattgccaaaataattggaatccagatcattgaccatgtaatcccactaattgcagcagcactttgggttgctttggtgccatcgaaatggaacgcagcgttgatatagcctggaataattccaccaagtgcaagaccaatcttgaagaacagacccatcaaagcattgataataccagcaacacgcttctttgatttgtattcaccgtacgaaacaacttctggaactaatgcccacatgtaaccagttgcggcggtaatgccccattgttgtaagaaacggccgatataaccaagtgcaacgctatctttgaaggctggcaatgaccatgcccataagactaattgaccgataacgaagagaatcaagaaaatgtagaagaattgtttcttaccaattttcttacgaacgattggccataagaacacaaggaaaatcccagggattgaaccaactaagttaattgatgctaaccattctggatgaccgatgttgtattggaagaagaaggcttcagtagtgttaccaaagaacataaatgtgaaggcaatcaggaagaacattcccaaaacaagcaaaggtttgttccgttttaattcagcaaataaatcagagtacttaacattatcagtttcttcttgtgttggtagcacacgttctttaattcctttatacgtgaacatcaacataatgaaaccaataatcatgtaaatcgccatgacggtaaagtatgcgccaccagcatgtggtgaggtatagtcacctaagtttaaatgaattccgaagaaaccaatatccttagaaactttatcaggtgaagccaattgaacaaataatggcaagaatgtgtaaacaagtaagttaccaatgttagcttcagtcatccgtactgtcgtcaatgttgaaacttcgtcgttgtcccgagtcaatgacgcatttaaagcaccataagggatgttaacgattgaataagtcaacgcagttagtagataagcaataaatgcataaggaacactaccacgaattgaatcaattggtaagaataagcaagctgagaaaatcgtcaatggaattccggcatataataggtatggccgatacttaccagacttaaatgtgtgacgatcaataaccgtccccacccatggatcccagaaaacgttgacccaacgaacaaccaagaagattgtggccccagccgcagctgagatcccataaacagtagttaaataaaatagcaacatcgaaccgatagtcccaaaaataaggttttgggccagatcaccggcaccatatgaaatacgttcgcgccaagataatttcgcaaattcatcatttacgttagtcttcggattagacgccataattgcaaaccttcctttcacttgtcaataaatgacactgagtaaaacagaattaaatactgatagcgctatcaaaacagttgttagttttgttagtttttaaaaccaactaacgagcaaaaagtattctgcaggatttacttttcgcctaactcgtgttgatgacttaattgtattcgcttacagcgattcggtctagagctgttcctaacgacattttgtcaaattgtgaactacatgtgaactttatctctaattaaaaaggattcagcctttgctgaatcctgagatgtctattcaaaaaatccgctgtccttaattgcacgaacctcccgtttatgaaggacctgttgttgatacttactaggtgttaaattcgaccattttttaaattgcttactgaaattagacaggctgttaaaacccgtcatgtaggcaacttcctcaatcgaataatccggaattccaagcagcattttggccttactatacttttgttcctcaatgaagtgtagcggcgtactcccatataccttccgaaaaacgcggtgtccataccctgtactgatgtttaaagactgacaaatcgtccccacgtttaatgattcgggctcttcattttcaatcccgttttcaatcattgtagccattgaacgtgcgacctgtgcctccctttcagtatactttgacgtactcttgctactaaattcggggagactatgaatgatctgaattaaaaaattatagaatgtaatttcaatttttaaatcccgttcttcccggcttaagtcgctcttattcgtgtatgtgagcatttcctgcatcgtcgtcacagctacttttgctaactcattatccgcatgaatcgcaatattcgcaatgtcacgaataatttcagctcttaatttcaagctttcgatattgaaatgaatgcagcaataggtcatgctctctcgcttactagcattaaaattaacgtgtaaagttccaggagaaataataatgatatcccctggcccatacgtaaccggtgtttgattcttaatctgtgtcgtttgatgaccgtcgatcacgcacatcaattcaaatgcttgatgtttttgctcaaagaaagtccatccgccggccaccgttcgcaggtgaccaccaaacatatgcaaactagattcaattaccggaaacggtgtaaatttagccatacctgcatcccccaaactttgcgaaaacttccacactacctaaattgtattcgttttcaactcatcagtctagcagttattgtatctggaatttgtcaaatcatgaactacttttggtttttcgcaacgatgatcgaactcccacacctggtttacttatgatctgctcagcgtataataactagtgtttttaataaaagttcggagtgaattaacatgtctcaattatcaaacgcaccacaatggaagaagaatatgtatgcactctggttcggaaactttgcaaccggcgccggagcaagcatgagccttccctttttacctctgtttatcagtacaatggacaattttccaaagtgggagctcacattgtacgccggcatcgcattttcagttacatttctgagccaggcaattgtatctccactctggggaaagctggcggatcgaactggtagaaagccgatgctcttacgtgcggcggcggccatgaccatcaccgctacactaaccggcctatctcctaatgtctgggttctaattttgctacgcttaattcaaggagcgttctccggatatattaacaacgcatacgcattggtggcaagcgaagtacctcaggaacaaagtggtcgcgtcatgggaaccctgacaacaggcaacgtcggtgggcaactcatcggtcccatcattggcggcgccattgccggtatctttggttatcgaattccttttttcctgtttggcgcatttatgttactcgcgaccttaattacattattcggcgttaaggaaaattttgtgccactacctaaagatgaccaccatcagacagaaagtgcctttgccggaattaagcagattcatgtcgtatgggccatgattatttcatcaatgctaatccaagcggctaccaactctatcaatcccatcatcagtttatttgttaaagagctgatgcataatcaaggtaacattgcctttgccagcggcgtggtggccgcaatgccgggaattgcaactttactctcagcaccacgtctgggatcactaggagatcatattggcccgcaaaaggtcttaattggcggattattactttcaggtttagcctttacacccatgttctttacgactactgtcctgatgctcgggatccttcgctttttcgttggtatcgccgatgccgcattgttgcccgttacgcaaaccgttatgacactcgacacgcccaccagtgcaatcagtcgtatttttagttacaatcagtcattccaagctattggctctgttattggtcccatgctggcctcaggagttgccggaattttagattatcgttacgtatttttgatgacgaccctccttgttatcatcaatctgcttgtcgtcctgtgggcctatcgtaaggatggtattaaactaacaagggccaagtgaaaattaaacgcctgtgcaatttgcacaggcgtttttttactcaaacaagaccttaattccgtatactaagttataaatgtatagcacaacatcaattactgcaatcactcctaacaataacaacgatactgcactcgtgctaaacacatcattcgttgtaactcccgttacaccaattacaattaacgctccaaccgttagtattaccggccataaatgcagaaaaaatgctcgccgtgcatgatattggactgacgatgctgattggctcaaaatccagataatcaacggtatcagtaatggcgcaaacgtaatcgacagatatgataatgccttaataatcttattattactcacagtagtctcctaataaattcggttgtagtaattcaacattctccgaccattctccggaataatggtcagcttcgtaacactaccgttatctggttcagggatcgcaaatggatcttgaacatgcatagcggcaaccacaaaactgcgaatagtgaatccgtgtgtaaccacgataatcttttgatctggaaagcgccgaaaaatatcaaccataaaatcgctaacccgtttctctacatccgtaaagcgttcaccggccgcaaccttcgcgtactctggcaccacatctccagtatccgcacaaaaaagtgtcggatactccgcctggaggtcaactttctttcgtccatcccactgtccatacgaaatttctagtagtcgtgaatcctcactaaccgttaaatcagcggcttgattcaagatctgcgccgtctgttgcgttcttacaagtggactggtgataagctgatctgcaaagcgaatatcaaaatgttgccgcagttgctgaatttgttggcgaccgtgatcgttcaaatacgcaatggcggtattggttgttccttgattaatccccatcacattcccagtcgtttgtccgtgacgaattaaatatagttctgtcatgcataaactcctaacatttttttctatcatatcatattttattgtcctgatagttaaaatctaacccacttaccctcgttttagagtcgcgagacgaaaatttatgatcccagtctttaaagcgttatactgacactaaattaagttcacgctattggaggcttttaaaatgaaacttactatttcgacaagtgctcaaagtattatttcacctaaattacgtccagatacccttattctcctcaactacgacgatggtgttggtccatactcaccacacgggttagaagcacttcaaatttcatttaagctcgtgctgatttccaaaggaatgccaatggacgattatgatctttcaatgccgtctgacctcggctcaattcacgtcaagggatactcagcccgtttcttcggatcgaatctcaaaattgattttaacgctcactatcacctactatccctatctgacgacggtgaagttctcgaagacaacttacaaatcgaagatcgtcagataagttcttaattattgtggtatttattctacatttaatcaattttaagcagacacttgatctttaacagacacttgataatagttagtctataaaatgtgaaatctattagaagttgataaggaagctcccatattaattccattcctaggttaccagtattatgattgtgatagagatatgctcatggttgcacatactaaagactggaggtcactaccatgaaaattgcaattgcaggtgccggtgcgttaggcagccgatttggatttgtacttcaacaggccggaaatgatgttacgcttattgacggttggccagcacatgttgtagctattaaagaacacggcttaaaagtaacccttgataaggatacctatacaactcaaattccagtcatgttcccaaaagaagttacacaagacatggcgatggatttaatcatcgtcttcacgaaatctatgcaactggatcaaatgcttcaggacatcaaaccaattattaaagaccatactaaaattctttgtctcctcaatggtatcggccatgaagacatcattgaaaaatacgtccccaagaaaaacatcttccttgggaatacaatgtggacggcaagccttgttggccccggtcatacccaatcattcggtagcgggagcgtttcactacaaaatttggttgcgggaaatgagtcagacgctgaaattttagctgcttgcttgtccgaagcggggttgaacgcgcagtatacagataacattcactattcgatttaccgaaaagcttgtgttaatggtacgatgaacggcctttgtacattgcttgaagtaaatatgaccacatttggtaagacgactcctgcacatcaactagtaactaccattgttaacgaattcgcggcggttgctcgtcacgaaaacattgaactagatgttgccgaaattgtgtcacacgttgaaaattgctatgatccaaacacaatcggtcatcattacccatcgatgtatcaagatctaatcaaaaaccatcggacaacagaaattgactatattaacggtgctatttcacggaaaggtcagaaatatgacgttccaactccctactgcgactttttaacggccctgatccattgcaaggaagacattattcaggacaatgaagctgttacaaactaatattccatgtatgtaaaaaggactgattcgtattgaatcagcccttttactttacttaatcagtccaattgtttgtagtaataaataaacatttaatccaatcaatacaattgtcgcaatccacgaaagaatcttcagtaaactaccgttcgcaaactgccccataattttcttgctactcgtgaaaataactaatggaataatcgcaaatggtaacgcaatactcaagaacacctgtgaaaatgtaagtagattttcaattttaccttcgtcaccatgataataaatcgcaaaaattaatactggcgttacagataacaaccgggtaatcaaccgttggacccaaagcggtaccttgaggcgaacaaacccttccataacaatttgtccagaaagcgtgccagtaatcgtggaactctgaccggaagcaagcaatgcaattgcaaataacatactcaacatcggactcgcaattgcgccaacaatttggctatcacttagtgcatgaaacaggtccgcaaaacgtccaagtgaactgtcagtcccataaaacagtgctgcccccaaaatcaatagcaaactattcaccacaaaagccactgttaattgaatactggagtctaaagttgtaaatttaatcgccttagcaacgtttttggcgttggatcggtcgatttcacgcgtttgtgaaatcgaagatcctaagtatagatcatgaggcattacggtcgccccaacaatcccgagtgataagtacaacattgaatggtttgtgataatacttcccgttgggacataaccctttaaaatccctgacatacttggttgtgacaaaatgacctcatacgcaaaaaccaacacgattacagcaactaaagtcgccacaattgcttcaattttgcggaatcccatcttcataagcaatagtagtaacaagacatccgctgcagtgatcaaaatcccaattaccagcggaatcttgaacagtaattgtaatgcaatccctgaaccaataatttcagccacatcggttgccataatagccaactcggcaaccacccatagtccgagcctcacgggcttattagttctttcccccgtaatttgagctagatctttccccgtcacaatgccgagcttcgatgacattgcttggagcatcatcgcaatcaacgatgaaattaagataaccgccagtaaccgatacttaaactgcgcaccaccggcaatcgaagttacccagttacctggatccatatacccaaccgcaattaagatgccgggcccagtataagccagcagggtcttccaaaaaccggcattttgcggcactcgaatgctaccattaatctcatctagacttttgctgtcggtatcaattgtatgcactaagccattgttgtgttcattatttttcatctgaaaagcctcttttctattgagttagaaattcggtgaatcagtagatttaaacttggatgaactaattcatgtaactttaaacccgtttacttttttcaattaaacatgtttaaagttatatcaattacgctgttcctgttttttaaccaaattaaaaaacgatcgcaaaccctccctcaagttaattactacttatccaaaacctagactaatatatcatgttttcgagaaaaaaaaacttttttacctttattaaccgttttcaaatcaaaaaaaatgcggaatattaaaaattccgcacaaatttctcatttattcgataagcgctggtttgtagcatccttcagtaatttgtataatgttgccgctactgggacgccaagcaacattcccaaaatgccactgataccactaccaatcgtaattgcggctaacacccatattcctggtagcccaattgacgtgccaacgaccttgggataaattaaatttccttcaatctgctgtagtactagaataaagacaatgaacagcaccgctttgaacggtgaatccacgacaatcaataagaatccgacccccgccccgatccaggccccaaagatgggaattaaagccatcatccccacgaatgcaccaattgagactgcatatgggaatctaaaaatcaacattccgacgatacaaagtgttcccagaacgaatgcttcagtaacctggccgataataaagctcgagaaacactggttaattgtcgccaaataatactttagcttccgcatcacacggtcactcaaaaacgcatgacccacccgtttaatatttgttccgagtttttctttactaattagaatataaattgcaaacgtgaccgctaacacaaagttaacaaccccactggttactttgctaaagattgtaatcgtcgatccgagcacaccactgataccggttgtaaaatatttcattactttagactggatgctcgtccaatcaatctgtgtcgtgctaatctttttttgaattaatggaaattggtccgtgctttgaatccacgctgccaatcgtgtgacaactttgggtaccgattcaaaaaattcactcaaggcattcgcaaattgaggcaataccaatcttaatacaccaaacaaaaccaacagaaccagtacaaaagtcagcaaaatcgacacaggacggcgagttacacgcacaattttaagccgcgatttaggaaaataccactgttccaatcgtgagcacaataagttcagaacgtaggccaacgctgctccgagtatgattggaaatacaacgcccatactttttgtaattaactttagggctgactgcggataaatcaacgttgcaataatgaccaatactaaacagccataaccaattacttgttttttacttagtttcaaattcgaaacctccatcatttcgttgccaatatcataccaaatttaatgtttcgttgatatacgcacaattactttttgttgcgttggctctgccaagaactgcagattttgaaaaagcaataaaatccagccaaaaactgcaaaaaaggataacatttcaaatcccgttaatgacaagtaatcgatcggtttaaatgccaaactgacagctaccagaataattcccatgacgtaagaaaacacttgaaattctcgtgaaatctgtggcagcatccacttaatcccaataatcatcgctaacactaggtaagctaagctacttgcaatttgatcgtgaataaagtggaaccgctgattattcgtaaaaataccaattgaccccaggcacacggcggttaacgtcaataatccacgtaaaattaaaagtcgccagcttcgataattaggccctagcgacacaaataggtaatctactaaaacaatcataattaatgctgaaataatcagcgtcaaattaaattgccaagcattatgggccaagtccgttcccaaaaagctcaggttatattcccaccagtgtcgattaccattggtcaccatcgaaataataacaccactaataatcacaattgtaaaaacggtggttagtgcaaatggcgaaataattcctgccgcttgaatcatcatgtaattaatgaaaaagcaaaaaatcaacacaaataatgacgatgtaacgggatcaaatgagatatccggaaaaatgagttcaaatacccaaaagatccccagtaaactcagtgcgagaattaacccgacagctagaataatggtcgggaaattacgccaatatatatttttgagtgttcgattgtcagatttttgccgtgccttgataaaaaaaacgctaaatagcaccattcccaataccacgccgaaaataataatggcactagaaatcgaataccccccactcaacggtacttgtcgttggtctttcacgcaaaaataaagtaaaaaaataatcccactcagtagtgccacacccagtgaccataaaaattcccgtcgggaccgatgatcgctatcatttgttgtttgcaaaattaaccgtttgtttttcacaacggcttccaattcctcaccgtcttgaatatttaactcatccactaaatttacaggcaaggtgacactaagctctttttgatttgccactgtccaataatccccctaaaatcttctgttagcattaattatacctaatttattaatgacattaagcttcaaatttaacttttaagatttgtttcacttctttccctactgccacatgttacaataaagagcgactatcaacttataaatagaacgtaaggattttttacgatgactcatttaatcaacaagttaaaaactaacatctacctacaatatctgtgttgctttgcaattacaagcattttcattttcgctattatcccactaacgggttcaacattaatctggaattcagatggcatcacgcagcattatccagcattggtttactggcgccgaatgctacggcacctcatcatcaaccatcagtggtgggcacagtggaattggaacatggggcttggtcaagataccatccaaactttatcatactatgtcatgggcgatattttcacctatccagctatttttttccgcgaatcttcgatggtagcttattattccgtaatggtggttgtgcgccttttccttgctggcggtgcattcattttttgtatcaatcatatcggccatcgaaccaaaaactggattatattgaccgccacgttcgtttacttattttcgggatatagcgcgtacgttgcttttgcacacccattctttcttaatccactcattattacgccgttactagtttgtgctcttcatcgcgcattagcaacccgtaaaatgggaacacttacgattatgacggcctggacactatttaacaatttctaccttggcgccattaccggattaggcctggcactttattggttgattttgatgattacaaaacgaaaatggcggcaatggcggctcaacatccacttggtcttgagcgttcttagtggcgttttcatcagtgccctgctttttattccttccctttaccaattatcagtagccacccgttcatctagccagttagcaaatggcatgacttggtacccgctctcctattacctcacactaccgggccttgctgtcagcaactacgcccgcccctattgggtaaccggtgggattttagtgatcggtatcatggcttcggtttggacgttacggcgctttcgacgttatttaacgctcaatttggtcctaagtctaggtggtattattctcatttcacccattttggcggccttaatgaatggtggctcttcaccttctaaccgttggactttccttttgatgctcccgattgcgatcgccgtcatgcatatgctagagcacgttacagagcttgttcgtgcagattttatctggtttacgatcattgccttcgcgattttactcagcctttttgcaggtaataaatttaaattcaccttcgatcttgggagcgtaatggttctctattttacaatagtttcgattctcctgatgttcaatatgcccgcacacaaacaactgccaccaaaaattctggcgattacattactatgtttaacgggtctcaacggtgtgattatgatgcgcgatcgtcacactaatcagttctctgataaatcttcaacgttgatttcaagccgcactgcccaccagctcactcaaacacagcaggcctatgctcaaaccggcagtgatcatgaccaacgctctttaattgatggccaactacggtcatatacggataaatcaccagcggataacctcccaatcttagccagaacgcataatattaacagttattggtcgctacaaaatgctgcccttaattcattcaatcaaacactagaaaataacacgagtaatcccaacgataccaccaacaccgttgacaatcgagcactcctattacgctttctgggtgttaatcggctatttctcaatagcgatgatttattagtgcccgccggttatgaagcgacgggaaccgccgtaaataaccaacaagaatatatggctaattcgacgatgcctctgatctatcaggcctccggagtaatgtcaaccaaacaattcaaacaactttcggcctctcaaaaagaggctgcattgttgactaatatcgtcacaaatcaccttcacaccaatcctgaaactaaactaatcaaacaggtccaacaacttaaaacggccgtcttaccaaccaatgccaatcaattttcgatggttcaacacattaaggtgcatactccaacaactgatttaacacctacaattgtgacatggaatcctgataagtccattaaaggttacgaactacatgcccagctgacaaatattacctaccgcgctggtacttttaagcagcggcataaagatgctcttgattattacattgcatctcataatcaagatattatgatggcaggccaagaaactgatttaagatataatccacaactgtacaatttgaactggctacgcaaaaatgcaatgagttactcggcgtcaactggtgaatttaatatcggggttaactacaacggcatctccaacgaattcgaacaaaccggtagtaacgatttatctttttacacaccacgttcttcgaccaccctcaatttgggaacaattgtctcaactaacgaggatagtaattctctcacgctcactttgccagcaaccggatcgacatcatttgatctctcattatgggcggttccgaccggcaagagtgtggatcaggcaatcagtaaaaatactgctgctcaaaacattaaattgggtaaaaatagcgttactgccacctacaccgcccgccacaaaacaatattagccaccacaattccgtattcaaagggatggcatttggtaggcgatcatcatacgctgccaaaaatcaataccggcttcattggcattcctgttagtcgcggtcaccacacgattcaccttgtttatcaatccccatttctaacgatttctattctagtatcaggcattggcctactgctatttttactaatcctgattgtccagcgttactatcgtcactaatggctcatacatcccctatacaaaaagagaatgcacggggttagcttttattgtcaaaacgtgatttaataggtataataaattggttacttaatgaaaggaagatcgcttgtggcatcaaatgatattattgaacaaactcggcaagttctgaaggatcatcatcttcggattacagcgcaacggcatatcattttagcctacctggcaagccatcataatcatccatcagtcgaaatgatccgagaagggctgaataaggaattacctaatctaggccctgctaccatctacaatacgttgaacacgtttgtcgaccacggaatcgtaattgaacttcaaaacggtgatggcagtacgcattacgattactttgagcatcaccactaccatgcaatttgtactaattgtgggaaaattactgatatttcctacgatggctttcatgacgttgaacaagaattggaagccaaagctgcagaacaatccggatacatggtttcaggtaaccacgttgaagtctacgggatctgtccagagtgtcaaatcaaactgagaattaaacattcctaaaactaatgggatggtcgccaattcgcgatcaccccattttcattgctattttaataatttgcgaccagtgagacgtgcaagttgctcattatcggtcccacatagtattcattctcacgtaaatactgaacgatctgtttctcagaggcctgcccctcatacttaatcactaaatctaacgcttcttttttggaaatttgctccggatggcgtgcgagtacgaagccatccacatcttctaataatgatagcgcatgttccttattatacgcacgaataacatagtgattttgccgtgtatcttcaatgacataaaaataatgtttcggcgtggcactataatcaatattcgtgggtgtctcatgacaggctaataactcgccaaccatgtcaaattctttcttatcctttaaatactcctgacaagctgtgcatgtatccctgtgttctccagggttatgtgtaccaactgtcaaatgatcgtgtagtaaaacattattggagattcgtgcgagcaaaatcccccgatattttttaagcttagtccgtcgttcatttttttcaacactttgtaacattaaccccatccccctcaaaattcgatgatcgtatttggtccgtcaatctctttgcgttaatatctacttgtaatataatgtaaggggattaattattccatttttctactaaatttatttttaaaatctcactttttatcacttgaatcattattttttaagattttttctttctacgtctcgttgtactatacttttatccgtatatagcctatattgaatctacaccttagtatgaccaacgctcattaggaggttttcaaacttgtactgttttttcaagcaacctcaactgaatatttataacaatgcgctcaccagtactgaactgatggtctttaaaaagacgaataatcaatatcaacactgtcaaattgttaatcaacttaatttgctcaacctgattcgatcactcgacccagaattccaaactaagctcccatcagttgcgattaattgcacgcaatcccagtttaccaacgttgttatctctgatgctttaattaacttgcaacatcaaatatacccacgtaacttacgaattgagattacactaggtaaatcgcttaaacaaataaatttactgattgcacaggcagaaaattatcgtcaacatggcattcaagttagtctagatgctgttgaccaaattaccaatttcgacgttgtcgcaccttttattttacaaactcgtgaaatcaagtttggtctgaacggtcgcaacacggaccggcaattattgcaattttggcaaactgctgcccgccgtaatcgcaaacgatttattgtttataatgttgaaacagatgacgatattgatttattggatgatctggatattgcacttcgccaaggtaattactatagcgaagctgataaactgatcacagagcagtccgcctagtcactatcagataaaaacacgccataattttaggaatctaatcctagtattatgacgtgtttttttaacaaacctaattctgatttgcttttgccactgctgcttgaccaagcaagtttaaatagttaaatgggcgatcgaactgtggttggaaaagcatatccacaaacgccaaaaaatcaatcgtattttcattttgaatacatacagaaattaaattagcggattgagagacatcgtggcgactcattaattgtgcacccagaattttacgggtctttttgtcccataccaatgtcattaagacaggcgtcgttgatggcataaattctggccgataattatcttcaatagtcacactatcagcatcaaagccttcactgagtgcatgctcaagtgtcataccagatgacactaacgtctgatcatatagtttcaatcctgatgaggactgagttcccatatactgcacagttggttcaaaaatattaattcctaccaatgttccttgccgcaccgcattagttgccaatggtatatatgcatccttatgagtcggattatagtgaactgccaccgcgtctccggcaccaaaaatatctggatttgaagtctgcatatagtcatttgttttgatcgagccgtctcgattcattgcgactagtcctttgaacagttcagtatttggtcggaatccaatacataggatcgccatttcggcatcataatcaccattactcgtgtgcactgttacaccgttgtcagtatcttcaaatgaagttaccgtccgatcaagcgccagcttaacaccttggtcaacaaagtcagttgcgagtcgatctgtatattcatgatcaaaatatttgctcaacattctaggcaatccatcaattagtgtcacatcatgaccctttttgttataggcttcaaccagttcaaccccaatatagccaccgccaatcacaacaattcgttgtgccttttttgcatgctcaaataacttcttagcatgatcataattcttgcagaggtaaacatgttttccgtcaattccctcaatcggtggtattacaggccatgaccccgtcgttacaattaacttatcatatgaatcagacttcgattctccagtgaccaagtcggtaacttttatttgtttattaacggcatcgatttcggtcacatcatgttgcatgcacacacgagcacccaattttgttaaagcatccggactcgaataaaatagtccttgcggatctttaacctcacctcctagataaagcgctattccacatgataaaaacgatacattatcgtttcgctcgtaaatcgtaacttcagtttcaggatgggctgaaagaatctgatttgcagccgccgttcctgcatgggtacaaccaacaataacaactttcataatggtcactctctttctaaaaggcttgtgtaatcgtttacaatctcattgtaacgcaaattcattcaaagaaaaagagttatcactaattaactaaaaaagagcatagatcagatcaccatgctactgcataaaaaaggagtgctgatgattggtatcaccgcactctttaatcatatatcaagtgattaatctttttaatttaaatagctaaaaacctgttgccctgcttgccggccaaaaatgaccgtttcagcaattgaattaccaccaattcgattgtttccatgtaagccaccagccacttcacccgctgcaaacagcccggcgatgatctgcccatcggtattgatgacctgcgttttttcattaattttaataccacccatggtgtaatgaatcgccggcgcaatatggattgcataaaacggcccttggtcaatggcccgatccattccagtcttgcggccatacatctggtcaacgtgctgcgaaacagcctgattccaatcggccacagttttgaccaactcatctgttgttatatcggctaatcctgcaagttcttcaagtgaggtagccgttttcactaatccaatatgatcataaaattcaaccgctttgacccggtcccgaattgcacggtcaaaaatcaggtaggctcccgttccatttaaaccatcaatggccgccgttacatttttacgcgtatctaactcatttacgaaccgttggcctgcctggttaaccaaaattgccccttcaccacgaacagcttcaccaattaggaaggcatgatcagtatcttgctgaacggtgggatgaacctgaacctgatccatatccaccaaatcagcgcctacagcctgcgcaagctgtaatccatcaccagttgctcccggctgattcgtagtgttgtacccgcctaaatctggccggtacttggtaataatttcttgactagcaccaaatccaccggtcgcaaggataactgcagaagcatgtaattcaacagttttctggctggtggttgcttgaatgccgatcactttgccgtcatcgtccgtcaagatttgatcaactttgacacctgtaaataacggaatttggtttttcgccacctgcttcaacaactcggttactaaaaagccaccaattggggccattgagcttggtcggtgagttctcattgtcgacataccgccagtaattgttaaatcatcaaggacgatattgtgtgccgccagccagtcaatcgctaaagcaccgtgttgcgtgaagtaacgcagcatcgccggattattacgtttaccgccaccagcatacgtctcttggtagaagtcatccatgctatcaacaatctggtgctgaagctgtacactcgtttcagccgcattcattcctgatgatgctcgcgtcgtgttacccccgattttgggcatcttttcaagaattactggtgacaatccaagttcatatgcttgaatcgcactggtcaatccagtaccaccagatccaataataatgacatcgtatttcgtttctaatcgctccaacggtgttggctcaaacacaaatttttcacccattttaattttcctccccaatattggtcatctttaacggatcaacccactcatcaaattgtgattccgtgactaatcctgaatctaacgctgcttgcttcagcgaccagcccttcttttgggcctgttgcgcgattgtcgcactattatgataaccaatgtggggcgacaaggccgttaccgtcatcaatgactggtcaaccaaggcagtcatccgctcctgattaacactgagaccagcaatcattttatcagcaaagccgatcattgtttcggttaataaatccgttgattctaaaaacgaactaatgatcaccggtttataaacattcatctcaaaatttccctgacttgccgctaaagaaatcgtcacatcattgccgatcaccctagttgctgccatcgtgatagcttctgcttgcgttggattaacctttcccggcatgattgaagagcccggttcattagcaggaatattcagttcatcatatcctgcacgcggaccactagcgagaaaacgaacatcattggccacctttaataggtcactggctagtgttttcaatgcaccatgaacagcattgagtcccgaatgattggcaagccccgcaaacttatttgtctccgccgtgaatggtacaccatacaactggctcacctgttgagcaatttgttctttaaaccctggaattgcatttaaaccagttccaacggcagtccccccgatcgcaaggcgatacaaggtaggctgtaactggttaatataatcgcgatcatccaccagggcactcttccaaccactaacctcttggccaaaggttaacggtgttgcatcctgcaaatgggtccgtccaattttaacaatttgccaaaattctttttgtttggcatccagtagctgtattaaatgttctaaagaatcttgaagccgttgtagggcctcaatcgccgtaatattcatcgcagttggaaaaatatcgtttgaactttgaccacaattaacatcatcattgggtaagacttccactgttggggcgacttgcatggcaacatgactaatcacctcattgacattcatgttggtttgcgtaccagaacctgtttgatagaccacgagcggaaaatgctgctgcaactcgtcatcatcttgtgctaatagtcgatctactgctgtaataatggcattggctttttcctgagctaaattattaagcgttaagttggcttgcgcggctgctttcttaagttgcaataatgacttaatcagtgccaaaggcattggtgagccagccttaaaattagtcaaactccgttgtgtctggggtccccataatgcatttacaggaattttaacggggcccaaagtatcttcttcaatacggtaattatccatcacgacgcctctttattgttttttactatcttagtttaatcggtcatgacattcaataaaaaattatagccgactaataacctcttccacatttttgatggttacagagattgttccatccggattattgacaaattcaatcaaattgggatcctgatagacatccaaaggaatggtcatttcaatgccgttagatagctttagtttctgtttgccgtacttcttgattgcaatttcctgaacttccttcgtgaccggaatttttgagtctggtagcttctcatgaatggcactttcaaattccgcttttgctgagatgttatcactgaaaacgttctgtgcgacctgttgggtgtcaatttcaccatcactagcaatcgtttcatgaatggcatctttaacgttattgacgacatcaaacttgggaatgtcaaaactcttagctactttttctgccacttttttgacagtcttaacattatcatctagcgaagcgactggctcactttcaattactcgctttgaaagatattccattttttcgcctgaaaaagtatattttttttcaatcagttcataggtattgtccgaaattttaaccgtaaatccttcatctgggcgttgggtcttccctgccaaaatcgattgatgaataattaagtcgttggcgatttttccgtctgcatcccctactagatgggtaaacgcttcatggtaattaacctttaaaaaggccacatacatctccgtatccttttcaaataacaccacaaatgcatctgcgcctggtgcgtcttcactttgaacataggtctcataccaatgtctcacaatcttactgctcgtatccgtgaagttgtcggttacctgtgctactaattgcgccattgtcgaatcttgctttaacgtcccagtcttcgtttgcgccgaagaaattttttgaatttttttgcttaagtattcgcgaatattgatattattaagatccagtccaacctgcgaatagattggatcgccaaagttacggtcgataacatgttcaatcgcctgttttaaataaatgtccatcatgttcatcctgccttttaatttatcacgttctatcttaccacggcgactgaaccaaaacatactgtggaattgattttccggccgtcaaacgttaccattagtcgttgatacaaattattttgggaggattttctcatgggaaacacaaaattaagtggtctgtttttactctggctaggagcagcaatttccattgcagaaattgttacaggtactttactggcaccgttagggtggacaatgggcatcacggctatcatcctcggtcatctaatcggctgtgtcttatttctatttccagcgggttacatctcagcacgtcaatccaaaagtgcaatcgaagtgacggacaccgcctttggtcactggggtgtgacgttattttcacttctaaatgcgattcaactactcggctggaccgcagtaatgatcgtaaatgctcaaatcgcaatgaacgccattagtcagcgactgtttcactttcactcccccgtcgtgatggccgtaattgtggctgccctcattgttctttggctcgtccttgatcataattggttattccgtgtcaacaacttaattgtcattcttctggcaattggtgcagtcatcttaatttttactgtcatgacgagtacctaccacgctcacgccacaacactttcaccattaggttttggtgcggcggttgagctaaacgtcactatggcgctgtcatggctccccctgattggggactatacgcaaaaaacgcaagcacccgtgaaggccagctttgtaagcatcagcggttactttatcggaagctgtgtcatgtttctaatcggactatccagcgttttaatgactaagagcactgattttacaaccgttctcgcacattccagcctcggtctggtagcgctgctaattatcgttttttcaacggtcacaactaccttcatggatgcctattctgcagccacgaatattgcaaatattactcaggttcatcggatcaagcttcttggcgtcatcattaccattatcggattgatcattgccttaatggtttcactctcggcataccaaagctttctttacacaattggagcagtcttcacacctctatttagcattgttttcacaacctatttcatcttgccccatcgattacccattatcgtcaatttcgggtggtggttagtcggtattttcctttataatcacattcaacagttcaatttctggtgcggaccaacagtcattaccctcctgagcctgatcattggactagtcctcagttacggtctctaccgtcagctaaaaaaataacgttgtgcaaaaaaagcatcccgctggatgctttttatttttgtgttgcaatatcatacgtcgttttcccatctttaacggtaaacattgcctgatcatcatgatcgggttgttgaatactaattgagtaaccactgccgatggctttttttagttgagtggacgttttagtcaagttcttggtaaaggatgaccagcccgcctccgaggctttgcttgggttcttagcaatgtaattcaaagccttcacagtattatcatctgtgggtaagattttatatgtctttgtgtcgctatcaaacgtgacaccaccaatgctttgataatttttcttcatctgggatagtacgttttgctccattgtcgtttgtgactgttgactggtttgaccagtaagaccaccttgcccaggttgagaaaatgaggatgacgaagctgaactagccgttgtttggctggtggaaacagatgaggtcgccttatcgttgctactttgatgccaaaaaggtaagttccaagcagcatatccggtcactaggacactgacaacaatcataattgtcggccagacccaagttccgtactgttgccatgaattcattaaataaaaaatgctcagaattaaaacaattattgcgataatcaataggaaaaccatttttataactcctcctgaattaattgctaatttacgtttgtatcactcccctatatccgttacaattaaaacattaacgacaaggagtgtcatgatgaaaagaatttatcttgcaggaccattttttagcgacgaacaaattgagcgtatcagtaaggttgaaaaagcgttaaccaccaatccaaccgccggatttgtattcagccctcggttatctgatgaaaacgacgatactgaaaatgcaggttcaccggaatgggctaaagctattttcactaaggatgtcgctgaagttgataaatgtgatgtagtcgttgcaattgccgacttcgaacacgccaaccttgatagtggaaccgcatttgaactgggttacgcttaccattctaataagcccattattttattgcaagaacttgatgaacaacttaatttgatggtcagtcaatcagcccactactacacaacttcgattgatgaactggcaacatacaatttcgaacaattaccagctaacgaatacactggtaaagctttttaaaaaagagtttccaacactaagcaattatcgtgttggaaactcttttttgtctaaattactagtatttaagcaatgataagatatcgtaatccttcaacttatcgcgaccctttaaatctgttaattcaataataaatgctgttccgacaacaattccgccaagtgcttctaccatttcaatggtagccgaaatggtcccaccagtcgcaagtaaatcgtccgtcaccagcacacgttgtccaggtttaatggctgcccgttgtaattgcagttcggcagtgccgtattccaaactatacgaagcactaatcgtttcattgggtagctttccttttttacgcgccggtgcaaatccaacgcctaattcataagctactgggcaaccaacaataaagccacgggcttcaggaccaacgatcatttcaacatttctttcacgcgcataactaacaatctgattagttgcttcggtgtaagcagctccgtcagccattagtggcgaaatatcacgaaacacaattcccttttctggatagtcgggaatgcttgcaatatactgttttaaatctaacgccatgtctaaattctcctttaatcactagcaacgcactgaagtacccaatgtttaaggtccttagaattgctatacactaatgctttttcagtttcgattaattgttgtcgtttttgataaagatccgctgatgtcaactcaactgatggcggattaacaacgccattgagaacaccatcttctattttaacaaatccgacctcgaaaaacagctgtatcataaaaatcaatttatttcgatcgatttttaaaaagccgcttagtgtccccaattgtcggtgaacatccacattttggtgggtttgaacaaatttataaagcaccccaaattcctgccgcgtcggcattcccatcaaatacgcgtcatctttttgataagcaaatacgcgaacggccgttggtgtaccgccaactttaaataccgcctttaatgcatccagtgatggtggacaatcaaccagtgtaaccgtctgctgctgcagcatagcactgttaatcgacgccgcaaggattaaggttgcgttcacctgtggttgtagttgatcaattacctgttgatcaaagcaaatataaacatcatttccttgaaataatggtgcagataaattatttgttcgttcatcaatcacagcaattccattcgtcttcaggtccttaatcatcagttgaatgctacgattgccacgccattcattttcatcaagtgtcccgacgatttcgacttgatcaactgccgcctgcagttcgggggcgagctctcccttaccaaaagcaattgccgccaacttggtatcttcatccccaattgctaattttaaatgatcgttatttttcccaatttgtttcacatcgctaatgagctgattttgaaataaaaactgaggccgcggattaccagtaccaaacggcgccaactgctctagctcattaaacagggttaaattagcatcaactgcactcaaccgtccggcaattaacattggcgccttcgttaacgttgctagttgttgtgcctgctgtgtcacttgtaactgttccactaactgcgcaacattagcaactggaaccgtcagcccgatcgccatttggtgaccaccaaatgctcgtgtgagatctctcagaccatcgacagcttgaaatagatcaaatccgtcaatactgcgtccagatccctttgccagaccagtttcatcgtcaatattcatcacaatggtaggttttccaagctgttcaaccacatgactagcaacaatccccagtacaccttgatgccaatcatgaccactcaatactaaaacatttcgttcctgattctcagcggtttgtgcctgctgtagagcttcatcactaatatcactaaccagcttctgccgatcttgatttttattatccaccattttggctaagtcaactgctgcttcatcgtccagcgtcgttaacagttcaacaccaggattagcatcgcccatccgtccaagggcatttaatcgaggggcaatgccaaaaccaatattagtttcattgatcgtttgttcattaattccggccagcttaactagttcatgaattcctggacgcattccagtccgtaattgctgaatcccataggtaattaaaattcgattttcatctgttacagaaactaaatcggccacttcaccaatggctactaaatctaacaattcagttggaaattcttctaacaatgcccacgcaactttgaacgcgacccccacacctgaaagatccccaaacggatatttacttcctggaaatcgtggatgaacaatcgcgtacgccgtcggtaactcctgcggcaattcatgatgatccgtcaccacaacgtccacatttcgctgttgagcagcagcaatcgcttcattgcctgagacaccgttatcgacggtcacaatcaattgcgtgccattatcaatcaaccgattaaacgcctgcacgttagggccatagccatcggtaaatcgatttggaacatagtaatctacatcagcaccaaccgtcaacaacgtttcatacatgagtgaggtactggtaattccatctgcgtcgtagtccccgtacaccgttattttctgcccctgctcaattgcagactgaatccgttcaacagccctttgcatatcatgcattaagaacggatcataacaattttcaatttgaggatgcaaaaactggtcaattgcttccgccgtttgatagccccgattcaccaatatcttagccgttattggcgacaacttaagttcttttgccagttgatcctgggtggcttgatctatcgagtcagccaattgccactgaaattttgcatccatcagtctcattccaccattctaaaaaatatgtatcaataacgattcacaacgtgaaccactatttttttaacgcaaaaaaatgcttaattacccaatcacctagccctgggaagagttgatacccaatggcaacggctgaaaaatagcgcggaatattaatctcacgcgtactatatcccacatgattccagattctctgcgcaattaccgccggatgcagcataaatgcactcggaagatgcgatagataggtccccttaggatccgcttgatcaaagaaattagtctctactggccccggattaaccgttaagacctggataccatagtctgctaattccattcttaaaacattgctaaagttgataacagctgccttagtcgcagaatagacactactattaggtgttggaatcttgccggcgaccgatcctaaattgacaatggcaccgtaaccttgattcatcatctgcttagccacgcaccggctcaaatacatcaaggccagaacattcaccttaaccattgcttccatcgtctggcgcgattcatcatatatggcctgcatatcaccaaagccagccgaattaaccaatacgtcgatgctcccgacttcatgactaaccgtcttcaaaactgaatcaatttgatccggatcactgacatctagctgatatgcaaacgatggccgaccagataaaattaaacagtgcttggccaccatgttcaaacggtccagattacgagcacacaaaacaacaattgcgcctcttttagccgcttcatacgccgttgcttcaccaataccactggaaccaccagtgatcaatacaattttgttttttagcgatctcagtgcttttagtcgtttttgcaagttaaccatcctttcaatcaacccttaaacggaacatcaattacatctaaatcattgacaactcgtgtagctgagaagacatctcttacctgataggcaagttcatacgcggccctccccgtgtaacgagctgagatgtgcgtcaacagtagtcgacccacatttgccgtttttgcgatttgagctgcctgagcgctcgtcgagtggtaataattgcgcgccatgcgcccttcaccctttgcaaaggtactctcatgaaccagcacatccgcattgcgtgccaatttgatactatttccattcttacgtgtatcaccaagaatagccacaatacggcccttctgtggcattccaataaagtcatgtccatccagtattgtgccatcctcaagagtcactgttttccctgcttttagttgaccgtagactggtccagacggaatattcatttctttaagcttctcaacttttagctccccaggatgatcatgttcaacaatccggtagccaaaacactcaattttgtgatctaatttttcacaactcaccgtaaaggttttatctttgaaaattacaccaccatcagtcaattcaacaaactttagcgggtaactaagcttcgtttcactcactttcaagcttacccttacaaagtcctcgattccgcgtggaccataaatggttagcggctcgtttccaccctgaaaagaacgtgaacttagtaatcctggtaagccaaatatatgatcaccatgaaggtgggtaataaaaattttttcaatttttcgtggacggattgtcgttctcaatatttgatgttgcgtagcttccccaacgtcaaacaaccaaattgcgtttctctcttctaacagtttcaacgcaatactggtcacatttctttgcttgcttggtgaaccagcaccagttcctaaaaattcaatttgcatattatcaaagttccttacttacaatcaattgtttccgcccctgcatcgggcatataattaactcaacacaaaacaggggcggagggatttttataatgatactaaccgatttcaacctatcaacggggacactgaacggtaatttaacgctgtgggcaacagatcgccatacggttgtttcgattactcaactgacctatcacaacaccgaattaatcgtttcacatcaagacgctcacgaaattttaacgctcgatcaatttcgcgctcgcattgctgccctggacggtcaaactaaattttttttaaacagcgccacatatccactgttcggatatcgacttgatggcaaccggctcattcttggctaatctgctattcaacaaactcaaacgtaaacttctgaatttgaacggtatccccactttgggcaccggccgcacgtagcgcatcatcaacacccattgagcgcatctgccgggcaaaccgcatcaagctttcatcatgttgcaggtctgtcatttcgaataaacgttccagcttgttgccactcaaaacccagaggccatcatcttcatggtgaatctcaaacggtttttcttcagtagcttcaaacgtataggttgtttcttcgtcctgtgctcgttcacttgtaaatgctggtgtttcatcaagcaagtttgctgcttgctgcataagctccgtaacacctcgatgagtaattgccgaaattggaaaaataatgggttgttgtgctaatgagtcatcttctgcaagttgctgtttgaacacggccaaattctcatctgcattcggtaaatccatttttgctgcgacaacgatttgcggacgatcaagtaattccggatcatagctagctaactcatgattaatcgcccggaatcggtcaatcgcctggtcctgatcatcactactcatatcaaccagatgtagtaagacacgcgtccgttcaatatgacgtaagaattggagccccaatccaacaccatttgacgcgccttcaattaatcctggcatatcggccatcgcaaaatcgcgaccatcatccaaacgaaccatccccaagtttggaaccaacgttgtaaattcatattccgcaattttgggtttagcgcccgtcacaactgacaaaagggttgattttccgactgatgggaaaccgaccagtccaacatctgctaacatcttcaattctaattctaaatcacgatcttcgcccggctcaccattttcagcaatttctggcgcaggattttttgcatttgcaaatcgcatattaccacggccaccacgaccaccatgggccacaataagctcatcaccttgattgaccaaatcacccattacttggccagtggctaaatctttaaccgttgttccttgaggtactgaaataacagtgtctgtcgcaccgcgacctgtcatttgcttaatcatacctttgccaccattgtcagctttaaaaattcggtgataccgaaaatccatcaatgttcgcaggccttcatctacttttaagatgatatcaccaccacggccaccatcaccgcctgctgggccaccgttcggaacaaacttttcgcgacgaaatgctaccattccatcgccgcccttacctgcacgtacttgaatttttatttgatctacaaacatgtcatttctccgtttttctgtgtcatagacatcaattatagttgaactttgccggttcgtcaaagttaatcatgactactaccctttgcaacttctgcatttttctgcagtgaaactttaattaattgtgccgtgggcttagcaattcccagctcatgaatatcatcaaccgatgcctgtgcaattttagtaatcgatccaaactcttttaacagcttattgcgtgttttggggcccactcccgcaatttcatctaacctggaactaagagaatgtttagtatgcacctggcgatgaaaagtaatcgcaaaccgatgaacttcatcttgaattcgttgaactaggtagaatccctgactctttggatctaaattaatgtgtgcatcatctggaccaaacaacaaatccgctgttttatgatgatcatttttaaccatccccacgaccgggattgttagtcccagttcatcttctaaaacttccttaaccgcattcatttgaatgacaccgccatccataaaaatcatatctggcatttctttgtgttcctttaacaaccgggtataccgacgacgaatcacttcttgcgtacttgccgtttcatccgcatgatcaaccgttgttagcttatatttccgatacagttttttattaggctgtccatcaacaaagaccaccattgcagaaacaaggtcggctccttgaatatgtgaatgatcaaaggcctcaatttttcgaccagctggtaggcctaacgcatccgtcagttccttcatggcgccggtagtttttcgttcatctagctccaataatcgaaacttttcttccaacaccaatcgagcatttttctccgccatagccaacaaattctttttttcaccgcgctgcggcgttcgtactgggattcccaaaatttcactaatttcttgggtcggcaatccagcaggaactaaaatttcgcgtggtaaaacgttattcttgcgattataaaactgcatgataaaactcgtcatttcttctgtcgcatcatcaacaactgggaaaagacgcttctcacgtttcattaaccgagcctgtcgaataaagaatacctgaattgaaagccagcccttatccatataaaagttaaatagatctctaggcgttttatcattaaaaatgattttttgcttctcgaccgttacttcaatataatgcaattgatctcgcaactctgccgctcgctcgtactgcatgtcagttgcggccttttgcatctcatcagttaattttttcttaatggttccggtattgccattcaaaaacgacttaattcttgtaatttgatgctggtatttttcctcgggaacttcttgaaaacaagcacctaaacactgtcccatatgatagtacaaacatgggcgtccctgaaatccattgcaccgccgtaaaggaaacactttttgaataaaatgcagtgtttcttcagcagcgtatacgttcggataaggaccaaagtagtaggcgccatctttttttatatctcccgtaataacaatttggggatcccgttcattcgtaattttgatgtacggatagccagtccccttttttaacttgatattataatagggttgatgcttttgaatcaacgtaatttcaagcaaaaatgattccttatttgttgacgtcacaattgtttcaaagtcagcaatctcactgactaaccgcgctgtttttccttcatgactacttttaaaatatgaccgcacccggttacgcagattcttggcctttcccacgtaaataatctgactattgatgtccttcattagataacatccgggtaacggtggtagcaaagtaagtttatgttcaatatgttcacttgccaatgctagccctcctgtcctcttgactgcatattattatatggcatcgcctgaatgaaagcaaaaaagcggcctaccgttggacggtaaaccacttcaaaaattaggcttccagaattttttctaagaagtccttagcacggtcagtctgaggatggctgaagaacgtctctggatcagcagactcctggatatagccatctgccataaaccagatcttatcagccacactcttagcaaatcccatttcatgagtaacaacgaccattgtcatgccatcattagctaaatcttgcataaccttcaatacttcgccaaccatttccggatctaacgcactggttggttcatcaaaaagcatcacttctggattcatggctagtgcccgcgcaattgccacccgttgttgttgaccacctgaaagactggttggataaacatctgccttttccagcaagccaaccttgtccaaaagatcttgggccgttttagtagcttcttcgtccgaaatcgacttcacttttttaggcgcgagctttaagttctcgatcacggtcatattcgggaataaattgaagttctggaacaccatccccatcttttcacgaagaccattgatctttttttcgttaagagttgtcaaatccgttccttcaaacaatacctgacccttggtgggtttctcaagaaggttcaaacaacgtaaaaaggttgatttaccggccccggaaggtccaatcacacaaatcacttcaccctgtttcacatcttcggtgatatcttttaaaacgaccgtatcatcatactttttttgtaatcctttaatttcaattacggcttgttctgccatttatgttcctccttgttactttacgtatctcactgttttaatctcatggcctattatactgatacatgtttgtttatgcaagagtttttcgatttttacccaatttatgcattatttaagctttaaagcgcgcaataaatgaatagttttacaaaactagcgaatcatgctagcatagtagcaacctagattagttcgaaaggaatgatttttaatgggacttgttgttaatcgtgatctgaaactcgagcaaatgttcaatgcattcgccgttgatccaaagaaaaaggcgccaaagaaacccgatgataagaaagataaaacggtagaagaaaaaagcactaccgataataaatctgaaaactaaaaaataaacctagctcggtcacttcaaaccgtcctaggtttatttttttagttctgatatccatgtgggtaccgtttgttcaagatttcaatattggttttggccacatcatcaaaggagatatccgcccattgagcaacttgggacaaataccataagacatcgcccatttcatgttccaactgctccttgcttagcttttggccccgaaacgtataatttttaacaatatcgacaacttgtcccgcttctgatgccaatcccaaagcacaattagttaaaacttgttcgtttccatacagcgttctttttgcagctgcttgatattcattaaagtccataattactgtgctcctccaatttgcttttcaatccattgccagactgcgtccttaccgagttttgtctgtgctgaaaataaaatgagttgtgttgcggcatttaatcccagcgtctttctaattagactttcttcacgattgcgaacacccggtttaattttatcaatcttcgttgcaacaactaacgttggaatatgataatactgaagccaattatacatagagacatcatcttccgtgggtgcgtgccggccgtcgatcagctgaataacccctcgtaactgcttgcgctgggtgagataagtttcaatcattacaccaaacttctctcgttcttttttagaaaccttggcatagccatagccgggaacatccacgaaataaagctgatgctcaacttcataaaaattcaacgtacgtgtttttccaggttgactggaagtgcgtgcataactttttcgattaatcagaacatttgtaagcgatgatttaccaacattcgaccgaccgaccaatccaatctctggatatccagttacgggatactgttttggatcaaccgcactcattactaattcaacttcttgtacttccatataatcctccgttgcacgttatcttcaacaaaagagacccacatgctcacgggtctcttgattgattaaactaggatgctttttgatcttttaaaatatactcaggttctgtgtgctttatgacacttgactggtcaataacaaccttagccacatcctcacggcttggcaaatcaaacatcacgtctctcatcacatcttcaatgattgatcgcagtccacgagcacccgtattacgttcaatggctagatgagccattgccgttaacgccccgtcggtaaattccaactgagcatcatctaaagtgatcaatttttggtactgtttaaccagcgcatttttcggttcggttaaaatacggaccaaatcaccttcatcaagcttttgcaacgccgttaaaattggtaaacgaccaataaattcaggaattaggccaaacgaaagtaaatcttctggtacgacgtgttgtagcacgttcttttccgtaacttgatcgatttcacgcgaattagtcccgaagccaatcgttttgtctcctagacgatctttaacaatcgtctcgataccgtcgaatgcaccaccaacaataaataaaatattcttagtgttgatctgaataaattcttgttgtggatgtttgcgaccaccctgaggcggcacgttagcaatcgttccttcaagaattttcaaaagtgcctgttgcaccccttcaccagaaacatctcgtgtgattgacacattttcgctttttttagcgatcttatcaatttcatcaatgtagataatgcccttttcagcacgttcaacatcgtaatcggcggcttgtagcaatttgagaatgatgttctccacatcttctccaacgtacccagcttccgttaacgtcgttgcatcagcaattgcaaacggaacatttaaaattttagcaagtgactgtgcaagatatgttttccctgaaccagttggcccaattaggctaatattacttttctgtagttcggtatcatccttactggcactcgccatcgcattaacccgcttgtagtggttgtagacggcaactgataacgtctttttcgcatcatcctgaccgatcacataatcgtccagcttcgatacaatgtctgcaggagttggcacatctaatagtgattgagccgcgtcctcagcaatttcctcatcaataatttccttgcaaagatcgatgcattcattacaaatatacacaccaggtccagcaacaatttttttcacctgatcttgtgatttgccacaaaaagaacagttaaccgattccattccgttggtatcttcaaacatctattgtgacctcctatacagttatgacgccatcataacagaatatttctctaaatacgaataattgaattattatgtttttagagttaaaaaaatgtccaatcactaggattgaacattttttcgaaaaccaagtgtcttattcttcgtcttctttagctttgctcttcttagctgttttttcttgtttagctgaatcgcgcacaagatcaacggccttacgaacagcgatgtcatgtgacaacatgtcagttgataatgctttagaaacatcttcttccttcatgccatattgttgagccaaatctttgatttcagcatcaatatcgtcttgtgatggttcaatcttttcagcttccacaattgcttcaagaaccaagctcgttttaactcgattttcagcatcagcagcaaattgcttttgcaaatcttcttgcttagtacctgtgatttggaagtacatttctgggctgattccttgttgttgcatgtttgcaagatattgttgcatttgacgattagtatcgtcatccaacattgcttgtgggatttccttgatttcggcattgtcaacagcttgtgaaatggctgcttcttcaattgcttccttcgcttcgtgttccttgcgttccttcaattgatccttagtcttagcctttaattcttcaagtgaatcaacgtcttcgtcaacatccttggcaaattcgtcatcaagtgctggcaattccttagtcttaacttcatgaagcttaacggcaaagactgcttccttaccagctaattccttagcctgataatcttctgggaatgtaactttaacatcaacatcctcatccgccttgtgaccaactaattggtcttcaaaaccagggatgaatgagtttgaacccaattcaagtgagtagttatctgcgctaccgccatcaaacttttcaccgtctacagtacctacatagtcgataacaactgtgtcaccttcggcagcagctttaccttctttaagtactaattcggcttgttgctgacgcttgttttcaagttcagcatcaacttccttaacaagtacccgtgtactttgctttggaacagttaaaccttcatagtcacctaatttaacatctggcttaacggtaacaatcgcctttaatacccatggttgatccttttccatgctatcaacgtctaattgtggttgatcaacaggttcgattccggcttctttaatcgctgcctcataagcttctggtaaaacgatatttaaagcatcttggtataaagcttcttcaccgtacatacggttaaagatttgccgtggaatatgacccttacggaaaccagggacagatagtgtcttcttggtcttatcgaaagcttgatcaattccttttttaatagtgtcgacatcaatatcaaatgtcaaagttcctttgttggtatcgctgtcgcgttcccattttgctgacattgtatttcctccataacgattacatatatttaaaatgttgcttgtgcatacttaatcagtttaacgtaagccgcagtaattgtaaacattttgcatcaactaatttaaatacttcccttgttaaatcaataatcagatgacctaggacagaccatagcattttctacttttaactacaacaaaaaagcctgataggaaaccctaccaagcttaattatcaaactaaaataaattagtcatcaatttctgaaaccacaccggcaccaaccgtgtgaccaccttcacgaacagtgaacttaagacccttttcaatggcaacagggttgatcagttcaacagtaaatgtaacgttgtcaccaggcataaccatttcaacgccttctggcaattcgataacaccagtaacgtcagtagtatggaagtagaattgtggacgatagtttgagaagaatggcgtatgacggccaccttcttcttttgttaagatataaacttcacccttgaacttcttgtgagtttgaattgaacctggagcagccaaaacttgtccacgttcgatttggtcacgaccgataccacgaagtaaggcaccaacgttgtcaccagcttcaccaagatcaagtgtcttacggaacatttcaagacctgtaacagtagtcttcaaaacttcttccttaagaccaacaatttcaacttcgtcgccgaccttaacttgtccacgatcgatacgtcctgaagcaacagtaccacgaccagtgatcgtaaatacgtcttcaacaggcatcaagaatggcttgtcagtgtcacgttgtggagttggaatgtattcgtcaacaacatccatcaagtgaaggataaccttttcttgttcttcgtcgccttcaagagccttgagagctgaaccacgaacaactggaatatcatcaccagggaaatcgtattctgaaagtaattcacgaacttccatttcaacaagatcaaccaattcgtcatcgtcaactaagtcagtcttgttcaagaagacaacgatatagtcaacaccaacttggcgagcaagcaaaatgtgttcacgagtttgtggcataggaccatcagttgcggcaacaaccaagatagcaccatccatttgtgcagcaccagtgatcatgttcttaacgtaatcagcatgtcctggggcgtcaatatgtgcatagtgacgcttttctgtttcgtattcaacgtgggcagtgttgatagtgataccacgttctttttcttctggcgcagcatcgatatctgcataatcttcagcctttgccaaacctttagctgctaataccttagtaatagctgcagttaaagtagttttcccatggtcaacgtggccaatagtaccaatgtttacatggggctttgtacgttcataatgttctttttctgccattgaatgaaaccctcctgttattttgcaagaattatgtcagccttcaggcagccgactgacacacctttaaatatattatactacttccccttgataaagcaaagcctatcacctatcaaaaggcgcttcaagaagaatcctaaactattatatatactgccccttcatttgtaaaccattatttctcaagaatttaaaaaaggttttcaaaggaaattttcaatacttctaatatgctttgatgagtgcttcaatcagtgcctcaatgacactatgccagtgcgccatccctgaatctaggcctttcaaatccgttttaccttgaaattgagcaatttctaaatcgacccaaccgtccgcatctgtcaccacttgttcaatgaatggatagcacatcatcatttgcattccaatttcctgactaatagtcgcataggccacgggatcgacattttctaatcgctctttcaatgcttggatcagctgctgataacctggtatttgatcaatagggaccaattgagcgccatcaatttcatgctctttttcatcaatccagtacgttttaattcgatcagtaatttttaacttttgtaaattctgtagaatactcgatcgaattaatggattggtaaacggatcccttaatagaaattttgccccaaccatgtaatccgcgagtggcagctgacctgctcgggccagtcgctccctttgttggggaaatggttggtctcccagatgataaaattggcgtaaattagccttacgagtcgcaactagcgtctgggcagtagtcgtttcgaattcattaattccctgaatcgcaactgcttgccaattcgcatttgccgttgctagtgcgaattgacgtgcctcaataaggtgctgacttttcagcagcacattgaccattaatttaaataagtccgccgataataaaaacgtttcttgtttttcaactgcaaattcgtacgccattttaaattgattatccatatagagtgcttctaccaataaatgattaatttcattatcatttcgctgttcgtacaatttttctaattgctcacttgcccggttccactcctgctgagcaagtaactgcttaatacgtttcatttgctcaacctgattttgatttaaatgatcttccaaaatttcacctccagatcaacaaagagcgtcgcgccgttgaatgatcaacgagcaccacactcttaactaattacttactttctttggttgtctttttctttttattattttttcgtgcgtgctgattaacttccataatcactggcaagattaccggatgacgttttgtttgatcgaataaaaagcgatttaacttgtcgcgaacatcctgtttcaagtgtccccagtcaaattccttattatcgaggttatcttggactgtttcctcaaccagtttggcactttgattcattaattcacgattcgtcttaacaaatacaaatccacgggacgtgattttcgggcgggcaacgatcttcttcttacgacgatcgatagtcacaacaaccacaaagatcccatcctcagcgagcactctgcgatcacgaagaacgatattcccgatatcgccaacaccaatcccgtcaatcatcgtatcgccgacatcgacacgatcaccaattctcatctcgtgtccgttaaaagtaactaaatcaccttttgtagtaataaaaatgtgatccttcgcgatacccacttcttgcgccagttgcgcatgccgattcagcaaacgatactctccttgaaccggaataaagtactgtggcttcataaagttaagcatcagttgaagatcattctggctggcatgccctgagggctgtaagtcatcagaaatagcttttacttcagcacccgcacgatagatcatatcgcgtgtcttctgtactgcagtttccattgcgtatgacggtgttgttgttatgaaaactaagtcatcatcaccgagttggacatttttatctcccccggtcgccattcgctgtaatgatttgatgggttcacccatcttaccagtctctaagataacgacttgttttggatccaactgttgcgcatctgtcatactgatcagtaactcatcatcgtcaagaacgagttttccgagtgacatggctgttttaacaattttttccaaatcatggccagataaaacaacttttcggcccacctgtgcagccgcgtcaaaaatttgttgaatccgcataatattggaagccacactggcaacgataattcgatgatccgtatacttaaaggtctctaaaatataggcagcaatatctttctcacgttcactttgaccaccgttagcagcaccggcagaatcactcagtaaggctaacacgccttgagtgccaatttctgccaaccgtgccaagtcagtctggtaacccttggtggccgtttgatcaaatttaaagtcacctgtataaacaatgttcccagatttagttgataaaacaattcccattgactcaggaattgagtgggttgttttgaaaaatgaaaccgtcacatcatcaaagtcaatttctgtctcagcatcaacaacgtgaaaatcatcatattttttgttctggctgttagaacttactcccaatttagccagcgcaattgtcatttcagagccaaataccgggaccttaaattcatcaagaaaataaggtaatgctccaatcgcatctgcgtgtccatgggttaaaaacactcctacaactcggtcggcattttcgcgtaagtaattccaatcaggaattacaacgtcaatacctaataattcattttcagggtattttaggccgcagtctagaatgaaaatttggttatcaatctcaactgcatacatatttttcccgttttctcgaaccccaccaaacgggataatgttaatattactcattacgtcaccttgaatctttctattgattatatgtctaatatctcaaataattttgcttgttcatcttgatcaaggggtaatattggtaaccggcaaccaccgacagcatagccaagatggttcaatgctgccttcactggtgatggtgatggatacatgaaaagtgcattcatcttaggtgttaagtcacgttgaattgctgctgcagcttgccaattgccagcttcaacatcggcgtacatttcactcatttgtgcgccaaacacgtgactcgcaacggaaataacaccagcaccgccaatttccttggtagcaagcgctaggttatcttcaccagaataaaccaaaaagcctgatgcacagtgttccactagcgcccctaaatcatcaatatccgtacattgcttgatgccaatgatattcgtcacatggctaagctcaattgccgtctctacggccatcgtaacccctgtccgtcctggaatattatagatgataattggtaatgtactctcagccgcaacagccttaaaatgtgccaacatgcccttttgattgggtttgttatagtagggtacaacaaccaaagcggcatcaataccatcgatcacactgatttcttttgtaaaatcaattgtatcttgcgtactattagatccagttccgacaatcattggaacgcgatggtcaatgatcttcgcacttttttgatacaactcgatcttttcatcgtgcgttaacgtcggcgtttcacccgtcgtcccaccaacaacgaatcccttcgatccagtttcgatcaaatgattaatcagtttttctagccggtcgtaatccacccgatcactatcatcaaatggtgttacaatcgcggtcattaaatctgcattttcgaatgtcattcatcttacccctttaactcattcatttaatattaatccgattagacattgtcattatcttactacaaattagcggtattgtgaattacgattaatcgcacacggcactctaccagctttttcgccaacttctatgtaaaaaaataagatcggacacataacgtgacccgaccttaaatcgatatattaacgacgcaaacctaatttttggattaagtcacggtagctcgcaacatcagtcttacgtaagtaagccaataaattacgacggtgaccaatcttcttcatcaaaccgcgttgtgaatgaaaatctttcttgtgaacacggagatgttcattcaattcgttaatatcagctgtcaaaacagcaacttgaacctcagttgaacctgtatcgccatcatggcgtgcaaattctttgatgatttcgtttttacgttctttagaaattgccataagtaatttcccacctttcaaatttttgcgcctagttctaagtaaaacgtcggtgaggatcgttaaactgagaagaggccgatcgacatgtgaatcgatctctaataatatacatgacatctacttaaaaagcaagttgaatccggacgtttgatattttttgcgatcttctcctggattctgttgcattcagtgcgatttgtattgtataatggctgatgttgaaaatttcaggtcagatgtgatcattaatttgtggaggtgaaaccatgccaatcatcaaatcagctattgaacgtgttcgtgttaacgaaaaagcacaaacacgtaacgcttcacaactcagtgcaatgcgtactactgttaagaagttcgagcaaggcaagactgcaggtgcagaaaaccttgaagaattattcaataatgctatttctgccatcgatcgtgcacactcaaaaggcttgatcaaggctaacaaggctgctcgtgacaagtcacgtctagctgcacgttatgctaaataataaatagtatttttaaaaggactgcgatttctatcgcagtccttttttattacgctcgtctccttgactgatgctgagttgcctgaacatactgcagcataaacaattcaaataacaattgcgggtcccgtgaagacgtcttcaatcccttttcaattttaaccaatcctaaataggcttgctccaaatctgctaatttaaacgctctcaccgtctgtaaggctaacttaactcgatacgggtgaactttcaatgttccggccaaacttccttgactaagaccgcgatctttaagcactttcacctgaattaacagcctaaactggctaaccaagaccgcattaattcttagtggttgctcttcactgttgattaaatcctgatatcggtgaagtgctaaccgataatctcgtttcaataccgcggtaaccaaatcaaatacattttgatcaagggactgtacaaccagcccttgaacagccgataattcaatctgttttccttgataactatacaactccagtttccggacggcctgaaccatcagcgaataatccgcattagtgcgttgaattaattcatcaagtgcatcagaggtaatttgatagccctctacatccaattggcgtttgattgcttgtcgcgcttcacgttcgcttagcggggctgcactgatctcagtggccactttttttagacgcttcacaactttcttgcggctatctagcttttcataaggtgcgttgatcactaaaattgtgctctgttcagggtgctcaaaataggcaactaatccatcaatatcatggtcaatttttctatttttagtgtctcccgtcagaaaataaggtttattaataataactagtctctgatcaccaaaaaaaggagccgatgtggcgtcatcgagcgctgttgccagcgatgtcacttccatatcgtagttaccaatgttcataactttttgatcatcaggaataagctgattgaacgcctcaagtgcctgctgtcttaacacagcctgttcgcctaaaactagatataccgaatcagctggttgctttgttaactgttgctgtagggcggtaacatccacttgagttcatctcctttaagtttagtatcccaagcatgtcgagtgttgttccaataccgatatcgaatcatgccatattgttgcgtagaaatcgcctgaatcctttgtcgttttaacgtattcatcgtttcgttgtttggatgaccatagcgattcatccgtcctgcggatataatcgctaatcgcggctggattcccttaataaaagcaggatccgaggccgtcttacttccatgatgccctaatttcaagacgtcggttttcaattccgggtagcgagccaatatttctttctcaccgttacggtccaaatcacccataaacataaatctcaaaccgccaaaaatacctgttaaaaccattgaatcctcattagcgcccttccccgatgtgaacggatgcacaactcttaggggaagcgccggcaagtgatcatttgccacaacggggatcagtcggctatgttgctttcgtgctaatggtaatactttagtcttaaagttacgctgtctttccattccctttggaaacgaaatctgacgcacatggatcgcagccaaaatatctttagtatatccaatatggtctgtatcttgatgacttaaacatagattatcgatttgactgattccctgactttttagatagttaatactgacacgtttcgcacggctatttgtcgttgttgactgcgcccactgtggtttggggaagtttaactgaccaccagtgtcgatcatggtcacgctccgattaaacggctctcgaatcaagaaactatcaccctgaccaatatcgaaaaagacaacttctccgtatagcggaaaatgaatccagccaaacgtaaaagcatatatcaacactaatactccccaggcgcgtcgccgatgcggaaatacatataccaataacgttacagaaaacaagatcgcaattgcagcaaccggtggctttccaaaatgaatcatccccgggagtgcaccaataaaatcaatcaactgctgcataaacatcaaaaagacatttaccatttgaccaaccattggcattgcccagtacgtgaaacagcatccaatcactaacggaaaaacaaccgctgaaaaaaacggaatcatcaagtaactggcgagcaagctcaatacatgccattcataaatataatataaaatcgacggtaagccaattaaattcatcagtactgcgccagtcagtggtttacctgggggcaagaaatgaagcattaaggctaataaataacttaattggccaccaagtgttaagagtagtaacggttgataaatcagaccaccagctaggcttaaactccaaatatcgatttttgaaagatgaaaccgctcgctctgacaaattagtgtaatttcagccatcagtgttgctcgcattagccctgtcgaactaccaccgataatcaaataaaccgggagcactccaattaaaagacgatttaccgtctccttttcaatccacagatagaccaaggccgttcgaatcatactgacaactaaaaaaacgtgcataccggaaatactaaataaatgaatcaggccaagttgtgtcacaccggtcatcgtatcagaaaaatcatttaacacgttaccaatgataagactatgacaatagagcctcagcacatgcggcatcgtatcaaaataggtcatcaattcaaatctcagctcatgacaccagtcaacccatcgattaattccagaactaggagctggtcgcgcagtgacgaccttttctactgtcatctgattataaacatgatgaattcgcgcatactgttgtgcattaaactggttatcatttgtggcaattgaaattggttctaacgtcccttttaattgccacgttgccgttttattcacatgcaatagttgctgttgcatcgctaatgatttaattcgaccgtatacctgaacttgttgatgtccagccacagtccttgccaacatctgaaactgatcaccatttaccttcaattgatctggatagacacgaacagtcagctccgtttcctgagggccgttcagcgttgctcgatcaacgcgttgctgataattaatacaaaacaatacaaaagcacccacagcaatgatagtcacaacggtcactgatgttcttcttaatgtccaaagtcgcatcaccaaccaactgacgccaagtaacaaaaaccatcggtgggcaaaaaatattccggtcgttagcgccatcgctaacgctggataaagataaaatcgataaataagattacgctagatattgatctagccgcgtctctttcaatgtatcttgatcaatgctaatttgattgagtttgatatttttaagtttgataagtttcattgcatactcatcattatgatagttacgaaggtaattaatctgcttgattcccgcctgcaatagcattttagtgcactggagacatggaaaatcagtcacatatatgctggctccgtcagttgaaacaccaaacttagcacactgtaaaattgcattcatttcagcatggattgtccggacacagtgcccatcttctaaataacaatccgaatcaatacagtgctcgtctcctgatacagaaccattgtagccgccagcaataattcgtttatcccgaacaatcgtggcaccaacagatagccgtttgcaagtacttctcgaagcgagtagcaccgcctgaatcatgaaataatggtcccaatcaattcttttcgtcaaaacaatcaccttccctttactgtgttctagtataacaaactcaactcaaatctaaactgctaattgatctttgatttttgcgaccgatgcatccccaaatccggaaacattttttaaatcctcaaccgttttaaactgtccatgttcctgccggtactgcaaaattaaatccgccttcttatcaccaactcccgtaatcttcatcaaatcatccttacttgcagaattgatattaatgattggtgctgccgaactttcacttcccgtcatctcggttccaccggcttcaccgaccatcggtgttgtaacttctcccgtaactggcacatacactacttgttgatccgttacctgtttagccatgttaacatggttcatatctgcattagctgccaccccaccagccttagtgatcgcatcttgcacgcgtaagccacttttcactgagtaaacacctggatggttaaccgcacctttcacgtccacatacaccattttattgctcactgtcgccgactttcgcgatcgctgctgggtctccgactgtgcatcaacaaaatcaacgctcctatgagttgtcgcattctttgctgaaagataccatcccccaattaggcatatcagcacacccaaaccaatcaagcagtagcgccggtagtcttgccaaaaatttttaagttgctccaattgctgatccccccttcaatgttaaagtacgcaaaaagagtgttgatttatttaaaaatcaacactcttttttagtggttctccaaatatcgaacggcatcattaaatgtcttaactggaacaaccttcatatttggtgcatattttttggcagtttgcttggctaattgatagttagtcttgtgctgttcttcatacttcaacagctctttggttggcttaacatatggtgcaaagaaaattttagcaccagccttctttgcagcaatgacctttttatcaatcccaccaatttcaccaacagtgccatcagggttaatcgttcccgtacctgcgattttacgtccctgacggaggttttggttagttaactgttgatagatctgcaaactgaacataagcccgccagacgggccccctaattcacccggattcaccttaacgggaattttggttgttaccttgacgttatccgtcaagataataccaattccggcctttttagttgataatctaactaagggatgcgtgctaacatgttgcttaccattatgcaaatatgtcacttcaactggtgtaccaatcttttggtgacttaaatacttctgatagccagcggatgtatcaaaatgccgaccattcactttggtaactgtatcgccgaccttgatactctttttaaacttagaatttgactgaacttccaacacataaatccctaggtatttcttcgtaaactgttgaccggcagctttatatgctgtcgcaatcgcctcattgattgcgctttgcatataaaatccctgcactttatcatacgttgcgtcactctgaccgccggtaacttcagaagcgctttcaattgtatcatgtggatcagccaacgcccataaataagtaattggccgagcacgttgcaaataaactgacgtaatcatataactacccgaacgcttatctgggtgatttttaatcgtaacatacgattttagaccatccgcctctccgggactctcaatatatgaattcagtggccaaaaaattagccacagtagaaaaagcgctgcaacagtaaacagtccgataataccgtactttttacgattactcttcttcaaactagtttcctcttaacttttccgacaactgttcattgatatttccgggtaaatatgccgaaatatcgccaccaaaacgagcaacttcctttaacaagctactcgataaatgctggtagttggggttagccatcataaaaatagtttcaatttcatcatccaaatgctgattcattgcagcgatatcgcgctcatactgaaaatcattaaagtttcgcaggccgcgaagtaggtaatcagcaccaattttattcatcaagctaaccgttaattcatcggctgtgattactgaaacgttgtccaagtccgcttgtgcgacagcttccttgatctgtgcaactcgctcctcaaccgtaaatattggttccttgcttgtgttaatcataactgccactgccaaacgatcaaacaacaggcttccgcgacgaattaaatctaagtgtcccaacgttagtggatcaaaactaccaggaaaaattgcaactttcatcttaatcatttcctttcacaaaacgataaatagttagtaccgtaataccatagtcctgccggcgtaccagttcaaatgagtccaaatcatctggcaactgtgcattttggtcagtttcagccacaatcatagcaccgtcatttaacaggtccaatgctaccattttttcaatgtcttcggtgatcttttgttgcgcatacggtggatcaagaaagaccatgtcaaatttcacatcacgcttgtgcaataactcaagggcttttttagcctcctgtttatacacttcaaactgttccgcatgcttagtaaccgcaatgttttccttaatcgtcttaattgcttggtaatgatgatcaatcaacactgcttgctcgattccccgcgatacggcttcaatactcagtccaccgctaccagcaaaaaggtccaaacttttaccaccatcgaaatagggtccaatgatattaaacaatgattctttaactttatccgtggttggtcgggtaccatttcccggtaccgcctttaaccttcggcctcgaaaatctcctgatactacccgcatgcgctattcatcctcttcagtttcatgtttatatattccagcggcctttaaatctgacatatctgggtcaatttcgggccagtgagaataactcacatgtttaacaaatttaagttcatttactttttttagtgtttgctcgactgtttcttcgtccgtatataaaattacataacgcatttttttggaaacatattccactcgtccatagtgccgcagttgccgcaccgaacgtaaattattaacatataccaccaaggaacgacgtggttttatcgtaaatgtcacattaccatctcacttacatttaatgtctttggttattgtaccaaattttgaaaggggccgcacccacaactaagtgagacggtccctttcaatgtcattaaatgactaaatatttgtaatttcgatcaataaatcgttcgaatcaacggcatcgccatcttcaacatacactttcgcaaccgttccatcaattggtgcttgtatcgttgtctccatcttcatcgcttcggtcacaatgatcggtgttccttttttaacttcgtcacccttttgaactagcactcgcaggaccgagccactcatcgtcgcaccaatttcacccggcttggttggttcagccttccgcttcttaacaacagtattatgcacgcttaaatcagcaactctaacttcccgtgcatgaccattaatatcaaagtaaagcgtccgttgaccttcatcatctggatccccaatttcattgagtgagacaatttccgtttccccaatagccaattcaatatcgacacgctccccaattctcataccttggaagaacgttggtgtatcaagaaccgtcacggccccgtattgtttctggcgatcaacgtaatccaaaaagacctttggatatagaacatagctaatgacctcttcaaaggttacactatgcccaaccttttgttccaattcagcttgaactgctttgaaatcaattggttgtgctaagctcccagggcgtaccgtcaatgcatctgcacccttcaaaacaattttttgcaattgctttgggaaaccaccagcgggttgacctaaatcacccttaaagaaactgaccactgaatcagggaaatcaagactctcacccttgctcatgacatcctcaggtgtcaattcatgttgcaccatgaacaaggccatgtcgccaaccaccttggaagatggggtaaccttgataatatcaccaaacatttggttaacctggcgataagtctttttaacctcttcaaatcgatcaccaagccgtaaagcattcgcttgttgttgtaagttagaatattgcccaccaggcatttcggtttgataaatatcagtttgtggtccaaccattttattagaaaactgctgataatatggtcgaactgacttccagtaccgatcaaccgcctcaacgttctttatatcaacttccggctgccgttcagttccttgtagggcataatataagctccccatacttggttgtgacgttgttcccgacatcgaactagaagcaacatcgacaatatccacacccgcttttgcagcctgtgaatacgtataaattccgtttccagttgtatcatgcgtgtgtaaatggattggcacatcaatctcgtccttaagcgtcgaaatcaaccgatatgcggcttccggcttcaatagtcccgccatatccttaatcgcaataatatgtgcacctgctgcttgcagttccttggccaaatcaacataatatttcaaattatattttgacttatcgggatctaaaatatcacccgtataacacattgtcgcttcagcaactttattattatcacgcacatactgaatgcttttttccatttgttcgatccaattcaaactatcgaagattcggaaaacatccattccgtcctgggccgattgatcaataaacgccttcagagcattatcaggatagttttgataacctacggcgttggaccctcgaaacagcatctgtgtgagcgttcgtggaatcatttggcgaattttcttcaagcgttcccacggatcttcacctaagaagcggtaggctacatcaaatgtagcaccaccccacatttcgtatgagaaaagttctggtaatgcacgctgtaacttaggtgcaatttcaaccatgtctttcgttctcatacgtgttgcaaacaggctttgatgggcgtcacgcattgtggtatccgtcagtaataaggcacgatgatctttaatccactggaccattgcatccggtcctttagcatctaacacatcttttgcggttacaattttcgcgtcaattggtgcaaatgtttcatcgtatttaaattcaggataatatttcttttcccggctaacacccggaaacccgttaacagtcgtattggcaatgtaatggagcagttgattgcgctggtctgtttcatgtttgaaattgaataactctggagtttgatcgataaatgtcgtacttgcttcaccggaggcaaatactggatgagaaatgacgtttttcataaattcaaggttagtgtgaactcctcgaatcgtaaactcatctaacacccgtaacatcttgtcacaggcttcatggaaggtatccgcaactacaatcgcctttactaagagcgaatcaaaatacggcgtaataattgaacctgtgtaggcgttcccgccatcaagacgaaccccgttaccacctggtgagatgtaagttgaaatcttaccagtatcgggcatgaaattattagtagcatcttccgtggtcacacgggcttggatcgcagcaccatggtaaacaagtttatcctgcgttggtaaattgatctccttgtgcagatcatacccttccgcaatcagaatttgtgcttgaacaatatcaaatcccgtaatcatttcggtaatggtatgttcaacttgaacccgtgggttaacctcgatgaaataaaattgatcgccttccaccaggaactcgaccgtagcagcattaaggtagttaacatgcttcataaatttaacagcagcattgcaaattcgttgacgcaattcaagtggtaacgcaactgctggtgcaatctcaattaccttttgattacgacgttgaaccgaacaatctcgttcaaataaatgcatcacgtttccatgactatcggcaagaatttgaacttcgatatgtttaggactcgaaagatacttttccaaataaatctcgctgtccccaaatgactgtgttgcctcactttgggcggtttgataggcgtccaccaattcttcttcatgatgcactattctcatcccacggccaccgccacccatggcagctttcacaaaaatcggataaccaatttggcctgcaaacttcttcgcctcttcgatcgtctcaaccggttccttggtccctggaattgttggaacatttgcagcatccgctgctcgcttagccgctattttgtccccaaacatttccaagtgttcaactttaggaccgataaatgtgatattttcctcagcacatcgtttcgcaaattgtgcattttctgataaaaatccataaccaggatggattgcatcaacctgatggtcctttgcaattcgaataatatcttcaatatccagataggctgcaattggtttcttcccttcaccaaccaaatacgcttcatctgctttaaagcggtgctcggaatattcatcttctttggcataaattgcaattgccgtcattttcaattcatgaatcgcacgaaaaattcgcgtggcaatttcgccacgatttgctaccataattctctgcattccctaatacgcctccatctgaattaaataccctctaatacccgggatctagtgtgaaccgcactcacgttaagcacacaccctaatcccatacataaaacaagcatactagacccaccatagctaataaacgggaacgttactcctgttattggtaaaatccccgttacgccaccaacattaaacagtgtttcaatagaaataaaggtggccacgccatagcacaataatgatgagtacgcgtcatctgccctaaccccaagccagattgtccgcgcaacgataattgcaagaagtaccaagatcactacaactgcaaccaatcccagttcctcgccaatcactgccatgataaagtccgtatttggttccggtaaatagcccatcttttggatactatttccgagacccacaccaaaaattccaccgttacttaatgcatagtacgagttaaccagctgactcccggcaccctgtgcagttccaaatggattaataaatgcaataattcgttgtattttataccccttaattgcaccacttgcagctaacttacttagaatcggcattagaacggcaacgaagaaaaagaataacccaaaaatagttgtgacaccctttttccatgaaataccacttgccagcatcataattaaaatgatcgcactattaatcacagccccacctaaatcaggctgaatcacaatcaataccactaaggctgctgataaaagtaatggactaatcgcagcaccccaaaaatggttagacatctcatgttccttatgcgaaaacattcgtgcaaggtataggatcaacacaattttacagacttccgccggttgaatattcataaagccaagattaatccatccttgagcaccattaattgcctgaccaaataccttaacataaaccagtgctaacaacgttatcattgtcatcccaaaaataaccttactgttttgaaagatctgcaagttcaccgcggtcataaaccagacaacaaacaaacctaaaacaacatagatcgtttgcttaaccagatacgccgttggtgaaccaccattttgattggcaatatccgcactcgcggagtaaaccatgacgataccgaccaaacacaaaattaaataaggcactactatgtagtagtctaagtaacggaacttcctacttatttttcttaacattttttttgatcacccaacacactcttttcgtaatttgatagaaatcaaatttgattgaaacaattatatcatacaaaaatttatggtctatcctttttgttaaaaaataatgaggattagttcaccaaaaaaagcttgagaccggcatttgtctcaagcttttttgatttttataaattaaattataagaacagtaatttatacagataaactgctgcaattccaccagcaatgggtgctacaacaggcacccaagagtaatcccaatgactatctcccttagttttaagtggatagagtgcatgcaccaaacgtggtcccaaatcccgagcaggattcaaggccgggcctgtggccccacccatggaaataaccaacgtcatcaccaataatccaatagtaaagtttgccagtccaatgttcgattgaaacgccatattatgtgtcatccctagcgctccgaaaatcagaatgaatgttccaacaaattcgttgataaatccatctcgatacgaatgcgcggcatcaatcgttgaaaatgttcctaaaatcgattctgtgttagtcgatagatcgtagtaaggacgataactccaaaccacgattagttgcccaatcactgcaccgatcatttgtgccgctaagtacggtagcacttcattccaaggaaacatcccattaactgccaatgcaatcgttaaagccggattaatatggttacccgaaatattggcaaacatcattgcgggaatcatcaccccgcaaccataaccaattccgatcagaatccaaccaccgtgaaatcccttggtaccttttaattccacgtcagcaactgcaccattacctaaaactacaaggaaagccgttccaatcatctcggccatcacccgcgtgaacaaactgtaagtcatctcttactccccagtaacaaaatatttaattgattgctagttcttatttaattttcccgaaaactagcgaaagttcgaacttattttcgtgaagcaattttgcgctttttggcttctttttcccgtgagttagagtccaaaatttgcttgcgtaaacgaacactttcaggcgtaacttcacacaattcatcttcgtttaagaattccaacgattcttcaagtgatagatgagttggtgtcttaatccgggccatatcatctgaaccggccgcacgcacgttagttaagttcttacccttggtgatgttaaccgtaatatcattttcacggctgttttcaccaacgatcataccttcataaacatccgttcctggatcaattaacagtgtcccacggctttcaattcccatcatggcataggtagttgccttaccagcattcattgaaacaagggttcctttttgacgacctgggttccagttcttaattacaggaccatattgttcaaatgtgtggttcatgattccgtaaccacgcgtcattgacatgaattctgttgaataaccaatcaaaccacgtgatggtgctaagaatgtcaaacgcgtctgaccattgtcagtggattccatgttttgcatttcacccttacgttgtgacaaactatcgatcacaccaccagtgtattcatcaggtgtatcaatttgaacttcttcaaacggttcgctcatcacaccgtcaatatctcgatagataacttctggacgtgaaacagctaattcataaccttcacgacgtaatgtttcaactaagattgacaagtgaagttccccacgtcctgaaaccatccaagcacctggttcatcagtgtcttcaacacgcaatgaaacatcagtatgcaattctgacttcaaacgatcttccaattgacgggcagtcacgaatttaccttcgcgaccagcaaatggtgaactatttgtccggaatgtcatctgcaaagttggttcatcaatccgcaataatggtaatgcatctggttgtgatggatcagcaacagtttcaccaacgttgatatcatccatcccagaaacagcacagagatctcccgccttagcttcatcgatttccaagcgcttcaagccaaagaaaccaaaaagcttagtaactcggaagtttttctttgagccgtcaagtttcaaaacactaacgctatctccgactttgatcttgcctcggaagacacgaccaatgccgacacgaccaacaaagtcgttataatcgagcatagctacttggaattgaagtggttcgtccgaattgtctactggagcaggaattttatcaacaattgtgtcaaaaattggcttcatcgtatgttcttgcgtatcaacatctggatcatagcttgacgttccgttcatagcagaagcatagacaactgggaaatcaagttgttcttcatcggcacccaattcaatgaacaaatcaagcacttcgtcaacaacttcttctggacgcgcacctgggcgatcaactttgttaatcacaacaattggtactaaatgttgatccaaagcctttttcaacacaaaacgagtttgtggcatcgttccttcaaaggcatccacaaccaacaatacaccatcaaccaaacgcatgatccgttcaacttccccaccgaaatcggcatgtcctggtgtatccaaaatattaatctgcttatcaccgtagcgaacagcagtgttctttgagaggatcgtaatcccacgttcacgttcgatggcgtttgaatccagcgcacgatcctcaatttgggtatgttcatctaatgtatctgattgttttaacatttcgttaactaacgttgtcttaccatggtcaacatgggcaatgatagcaatgttacgaatatcgtcacgtaatttcaagatcttttcttcccttcagttagttcaagtcagtttcacactcggcaggagcagactgtttgcataaaaaaactgtgacaagcggtcacagtcaaccaaactaatttgcaagcctaataacttcaccacttgctcgttctgtcgctactaatacaacattggatgatagcatatcaagcggggcaccgtcaatagttttcactgctaaccctaagacatttgccaaaacattacctgcagcaaagtcccatggtttcagatatgaaacatatccgcacagctcacctcggagcacactagcaaattctaatccagcactaccgtacatccgtggtcctcgactagtttgcgcaatttcttgcatttgatgttgattatgaataagcagcggcccactgataccgattaatgaatctcccaacgacttattttgcggtgccgccattttttgttgattaataaaaacaccaaaatcaggccctccatgatacaactggttattcatcacatctaaaatataaccgagaacgggggctccatcgatataaagtgcggccatcacagcaaaccgattcttttgcatcacaaagttcatcgttccgtcgattggatcaataaaccaaacatgaccatgcatatcttgaatgacatctccgaatccttcttcgccaagaattcgagccgcaggatcaattgatcgaatcgcctttaccagcatttgctcattacttttatcaactgtcgtcactaaatctttgcgacctgtcttttgatcaaccataaacggttgatccatcttatttaaggtttcttgacgaatcgtttgcattaatttttgcacttcaacatcgatttgctgaatatctttcattcgctaaatccctcttattaagatttttttctgcgtcgaactctgcgctgtcttaataacatcataaagttcataaccagaatcttgcttaaactgttttcccagttgcttctcctgagatttcgattgtacaattgctttgaattcttgatactgatctagaatttgttgtcgatctgccccagattcataagcatcttcaactagtccaaacatctgtgtcaccgttataatttcggcagtcgaccagcttggatctagtgggtaactatagttttgattactcatcgtcatcactcctagcgccattttaacacagaccacaccaaaaagtctgacctttcagtacgaaggatcagacttttttagtcatcaatcactacatgctagatgtgtgttggatatcctagcgcaatatctgcagcctcttggataggttcactcaacgttgggtgcggatgaatcgtcagtgccacgtcctcaacattcattcctgcattaactgccaaggaaagctcagcaattaaatcgctcgcttctgggccagccacctgtgcaccaaccagatttccttcgtcctttgtgtaaaccaatcgtacaaagccctctggttcgtccagtgaaacggctcttgcattaccagcaaatgggaacttcgctgtactaattgcaattcccttttctttagcacttgcttgattgagtccaaccgtcgctagttccggatctgtaaagcaaaccgctggtacgccaacccaatcgttagctgtattcttgcctgcaatagcacccgcagccgttttagcttcaaagaacgccttgtgcgccaatgcaggaccagcgacaatatcaccaattgcaaaaatgttcttaacacttgtacgtccctgctggtcaacctcaaccaacccacgatcggttgttttgacactggtcatctcaaggccaaaattatcagtgtttggtcgccggccaaccgaaactaggcagtaatcagccttaatactcgtttcttcaccgtcggcatcatacgttacggtcacgctttgatcatcttgctccgctttcttagccattgccttggtaatgacatcaacgccctttttcttgagcccctttaatgctaacgaaactaggtctttttcaaagttaggtaaaattgaaggcgttccttctaagattgtgacatgcgatcctaagttggcatatgcacccgccagctcagtaccaatatagccaccgccaataacgactaattcgtgcggaatctccgttaaatcaagtgcaccggtagaatcaaccacgcggccttcaaacttgaagtttggaatttcaaccggccgacttccagtagctaaaatcaggttgttaaacttgatcgtcatgccaccaccattatccataaactgcttaggtccaacggacatgacacgcaattgactatcactgtctagaaaggcttcaccttgaatgacttctaccttgtgtttcttgagaagcatcttgacaccaccggtcattcggtcaacaactttcgcctttttccactcctgtgttttggcaaagtcaattgttgctggttgcgtggtaatcccaaaggttgacgcatcatttgcatcttgaagtcggtgtccagcgctaattaaagctttggagggaacgcatcccacattcaaacacacaccgcctaattcagccttttcaattagtgtcactttttggcctaattcggaagctcgaattgcagcgacgtagccaccggggccaccaccgataattactgtgtctttttcttcaacgtctgccatatgctaatcatccttccattaataacaattctggatcatgaagcaattcattcatgtagttcaatgcgttttgtgctaacgcaccatcaatcaatcgatggtcatagctcaatgacaatttcagcattttaccaacaacaattgcaccattttcatctacaattggttccttcgcaatcttaccgacaccaagaattgcaacttccggttgattaatgactggtgtaaaccaaccaccacctattgaaccaacgttactaattgtaattgagccgcccttcatagactgtgggctaagcttattgtcgtatgccgcctgtgtattttcactaatttccttagcaatttggaacatacccttggcgtcagcatttttaatatttggtacatataggccatgatccgtgttggtggcaattccaatattgtagtagtgcttgtaaacaacttcttgtgtcgtatcgtcgatggaagcattaaattcagggaatttcttcaacgtggccactaacgccttgacaatgtatggtaagaacgttaaatgtacaccctgatcggcagccatttgtttgtacttcttacgattatccattagagcactcacttcaacatcatcaaatgatgttacgtggggtgcaatatcctttgaggttctcattgatttagcaatgatctttctcattggcgtcattttttcacgagtttctaattccggttggtctgatttgtatggtttaactgcctgaccagttgacttcgtggttgccacctcagccgttttttcagtcttaggtgctgttggcgccgccttggccggtgtagcaccgttaaagttatcgatatcagcttttaaaatctgaccatggttgccagaaggtgttactgtgctgatatcaattcccttatcacgcgcatactgacgaactgatggcattgcaagaactaatttattgggatcggaaatcgtaggtacgccatcgccacctgtcggtgctggtgtcgtactctgtgagtcagtgccatcaccagtagctgatgatgatgtcgattcatgtacttttccgtcatcgatcttaactaacacatccccaatttcagcggtctcaccttcttgcttcacaatctcgacgattgttccagcaaccggtgaaggcagttctgacacggacttatcgttttggatttcgaccagtggatcatcttccttaaccgtatcaccaactttgacaagccatgatgaaatatcaccttccgccattccttcgccaagttcgggaagcttaaattcatatgcaccacctgactgaggagctgtcgtagcagttaccgttgccggcgccgtagattctggcgcgtcatctgctgtatctgctgatccatcatcaatttcaactagggtgtccccaatttctaccgtatccccttcctgagcaacgatcttttttaccgttcctgaaacgggcgacggtagctctgaaactgacttgtcattttggatttcaaccagcgtatcatcctcattaactttgtcgccttccttgaccagccaagttgctacttcaccttcggccataccttctccaagttctgggagtttaaatttaaatgccataaagcagacttcctttcgttctccaattaattattagtaatccaggatttcacgagcctttgcttcgatttcatcaacccctggaatccacacattttctgcctgtgcaaatggatagaccgaattaggagctgcaacacgaccaataggtgcatctaatgacataatcgcatgttctgaaatttctgaagcaacatgtgctccaacaccagccattttttgggcctcttgtaccacgacaactttgtgcgtcttttcaactgaggcaaaaatcgtatctgtatcgatcggtgataacgaccgcaaatcaactacttcaaccgaaacattttctttagctaatttatcagctacttttaacgattcattaacttcagcactgtatgccacaatcgttaagtcggttccttcccgaacaactttagccttgtctaaaggtaccgtatacttttcatccggaatatcgtctttcatggagcgatataacttcaagttttccatgaacaacacgggatcattattttcaattgcagaaataactaatcctttagcatcatatggattacttggtgttacaacacgcaatccaggaattcctgtaaagaagttttcgaggttatccgcatgcatttctgccgtatgcgttcctccaccaaatggggtccgaattgtaatcggtaaattcttctgaccgccaaagcgaaaccgtgtccgagccatttgtcccgcaactgaatcaatcgcttcaaacgtaaatcccataaattgaatttcaggaatcggtcgccaaccagtcagccctaacccaattgataggcccagaattcctgattcagccagtggcgtatcaaaaacgcggtcttcgccatacttgtcttgaagtccctgcgttgttctgaaaacgcctccatttttaccgacatcttcaccgaagatcagcgtctttgagtcttcccctaacgcaatatcaagaccgtctgtgatcgcttgaatgtaagattttttagtcatgattacttcgactcctttgcttcaaattcggtaatttgttttgcaatatctggggttggcacttcaaaggtattcttaagcatatccgaaaccttttctggttcaacgttgtctgcttctttgatggcatccttgaatgatgctttacattcttctacgtacttatcttcagtctcttgatcccatagccccttaccggttaaatacttccgcatccggataagcggatcatgatcgaaccacggtttttcttcttccttcgtccggtatctacttggatcatcaccggcactactgtgagcaccaaatcggtaagtcagcgtttcaatcatcactggaccattaccagctactgcaaactcccgggcttccttagcaacttgatagcaagccagtacatccatcccatcaacttgaatacttggaatacctgaggcgaccgccttttgtgccagtgtcgttgccgccgtttgcttgcgacgtggaacggaaatcgcaaagccattattttgaataatgaataccgccggtgcttggaaggcccctgcaaagttcatcccctcataggtatccccttgtgaagtaccaccatcacctgtatatgagaacgccaccgcatcctcaccattcttcttcagtcccaaagcaactccagccgtttcaaccatttgtgcgccaataatgatttgtggcattaaggcccgtgctttgaactgatttccctttacatgtcctcgggaccataagtaaccttcagtaaccgtagcgccatgctgaatcaattgcggaaggtcgcggtatgccggcaataggaagtcattctccttaaatgcagaaacagtccccatttcacttgcctcttcaccgtatgttggtgcataaaatcctaatcgtccttgacgagaaaaattcatggtttgttcatgaagcgctctttcccacacgatcttcttcataaaatcaacaagttgatcatcagaaaaatttgccattagttctgaatcgacaacgttaccgtcgttatccaaaatttgaactggcttaaaatcactgcccaaatctgcctttattgcagcaaaatcgaccgcgttcttacctttgttggccataatacacacgttcctttcttttcatcagcgctatgtaagcgctttatttgtcctcaattcaaagtatacacccctattatataaatgcaacccgtttcatacgcaaataagcgtattttgtattagaagttatatctaatacacagttacctttttcacaaagtccactaacttctcattattctcatccgattcaatttatgctagacttaaactagcagtttttgtggaatctaattttggagatgaacgtattgattttaatgaaagatattgtccgagacggcgatccggtattacgaacccaggccccattggttgactttccactgtcagatgaagacaaacaattggccactgatatgatggaatatctggaaattagtcagaatcctgagctctgtgaaaagtataaattacgagcaggcgtcggactggctgccccacaagtgggcgtttcaaagcagatggcggctgtcctagtgccagctgaagaagatgatgggaaacctgtttttaaagatgttattattaatcccgtaattgtcagtgaatcggtgcaacctggggcactaacagaaggtgaaggttgcttatcagtcgatgaagatgtccctggatatgttccacgtcatgatcgcattacattgcgctatcaagatgtttctggcacacaacataccattcggctcaaacactatcctgcaatcgtttgccagcatgaaattgatcacctacatgggacgctattttacgatcacattaacaaggacaacccatttaaggcccctgacgataccgtaatgcttagctaactcaaaaagatcgaagcgtcaatttagttaacgtttcgatctttttttatcttaaaatatgtgaattagtaaacagagttatctttattaactgatttttttcaagtcataaatatattggtatgtggcatcattgataatatacgcaacatcaatgtgcaattgttgctcatatacccacgcatcagtcactaaaaatgcctcttgtgccttaggcacacgtgaaatctgatgatcattttcatactgcactaatccttgattcaacacttgatggacttgtttgagatcaattttctcaactaaatcgctatgcaacacgtattcaaaagccattacaccttttccccacacatccgcgacagtttgagactcgccaaaatcaatttcatttggtcgcacaatttgatgagtgaccaaagatttcacagcttctttcatggcctgatccgtgtttctttgagcatcatttctaacaattagtgtagcatgttttgtaatctcacgtcgaatcacttcatatacaagtaccgcgataataattgctaaacaaattatgacaaataatagcatttcatcaccccatctcttttgctaagcataccatgttcataatttgaaacaaaataaaatgagaatttcataacatttaccatctaagcttagattgtgataagatatagactgtaaagttttatgactatgtattaaggagcctttataatgatttttaaaatttactatcaagacacaaagattcgtaatcctaaacgtgaagatacgcattcaatgtatcttgaagccgattcagaaccagaggcccggattcaagccgaaggcaatacggaattcaacattgaatatatcgaagaattatctgataaggccttggaatacgaaaaacaaaacccagatttcaagattacaaagttttaaagtaaccgctgtcctaactgataattgctaggacagttttttgttatgtaaatttcattgtatagtcaaaacatttgttttttgatggaggaaataaccgttcgtgcaattttcaattattttaaatgagcttgccggtagtggaaatgcgaaaaaagtctggcagaggattgaacctcaacttcaagctcaggaagtcaactataatttaaatagaacacaatatgcgggacatgcagaatttttagctggacaaattattaagcatgctcgtgacccacggcaaacggttattttagtgattggtggcgacggaacgcttcatcaggtgctaaatggtgttctcagccattctgaaactggggacgatcgaatcccacttgcctatattccggccggctcgggcaacgattttgctcgggggctaaaaatggcatctgaccctgatacagcacttcgccaagtattaaattgccaacaaccgaccttagtcgatgttgggacatataacgaagctattaagcatgagaccggcttttttcttaacaacattggtattggctttgatgccgcggttgttagtcgaacaaatgcatcggcacacaaaaagcagttcaataaatatcatctcggttcactttcatatgttgcttcggtatttagtgtcctctacaatcaggaaccatttcaattaatggtgcaaatgggcaagcatcgtgacctatatcaaaaggcctttttggtcacaacatcaaatcatccctactttggtggcggcgttgcaatactgcccgacgccactgtccacagcggtgaactcgaactgattgtgatcgaacggaaaaactggctcatgttgctctgggtttcgatcttgctcgtgttcaaacgtcatctcaagtcccattgggtacaccactacaaagcaaaaaaaatccacgtcacaacaacgtcactagagtttggacagattgatggggaagaaatggggaaccgcttctacgacctttcaatgggggtacagcagtatccattctggattgatacaactattaaataaaaaaatctcgaatcagagttatcaaactccgtttcgagattttttaatcttcagatgcttccatcgcatctaaaatcatccgcaattgactgcattcttcacgcaaatcattcatttcttttccatactgcggctcaattgtaatcgttccagtaacattttgcctagacgatcgcttagcttctttttgacaaagctgtgtcagtgcactttgagcatcagctaattcctgctgaatctcaaatttgttactcacctcaaacactcccttttcagtaaagtattaaaagcaaattcaaatttgcaacattgaatataacaccaatccggcagaaagttaaccatttaagcattacaatttggttacacgcataaaaaaagcacacaaagccgcgaaccgcgcgagtttatgtgcttttaagtactacttcaaagttccggcaaagctaggcatgaagtaactactaatggtctgaatttgaacatttgagccagtatgtggtgccgcaacatactgattgttgccaatataaattgcatcatgataggtattgcctggtgtaccccagaataaaatatctccaggctgagcagaggctaccgaatgcttagaaacatatgcttcttgtgccaccgtattatgtggcaacgaaacgccgtccgcgtatttaaagacgtattgcacaagtcctgaacaatccattccagaagttgtattaccgccatagacataaggaatgccagcacttgctaatttaacagcaaggctaacgaccgatccactctgcaaggcagtatttgacgaagctgtcgtcgaatttgctgtcgttgtagcttgttggctagactgcgttgcacttgacgatgtggcagtactggtactcgatgatgttgcagcacttgatgatgcagcagtacttgaacttgtggttgctgatgaagcaacactagcacttgaagccactttttgggaactcgaactctgtgcaacagcactcgaagcaacctgatacgtcgcgtccacctgcactttgcgctgaacagttgttgaagatgatgtcgcactgcttgcagacgctgacgaaacagatgatgcacttacagaagagctcacagtcgctgatgatgccgtggtggtgctagtagcagcagttgtactcgacactcctgattcattcaccttactggtttgtgtcgtggtagcagcactttctgcggatgaactcacagttgccgctacactcgaagtgctactagtcaatgaagttgattgaccggctacactagccgatgaactcgtagttgccgaaacggcactctttgcagtcgctgacgttgtactcgttttagccgttgcagatgcattcaatgtcaatttctggccgacaagcaagaaatcttgattttgaataccatttgcctttaccaatttatcgaccgaaataccatatttcgcggcaattgctgaaagcgtgtccccacttttaacgacatagctagatgctgaagcagttgtcgtggtcgttgctttcttttgtcctgatagattaagttgctggccagaataaattaaatcaaccgttgagcttacttttttaatactggtatttgaagattccaagtcggaaattgaaacaccgtatttttgagcgaggctccacaccgtgtccccttgcttaactgtaacagttgaagcgtttgccgtttgcgttccaacagcgaacaatcccaatgcaccaaccgttcccaacaaaacattcttggcatatcggttatggttacttccacttactttatgagaatttgacattcgttccactccttacagaattactaagttcttaaattattatgaatttatttttaaattactgataatctgattaaacatactgtaagaataacatgatccttgtaacatgaaaacacttaacactttacattttcgaatcattaatcgctcatttaatctatttgtatataccaaaaggccgcaacagcggccttttcattttacagttccttatcaattagttaacattacaaatacgttacaacaatcataattttgtaagatggatttgctcatgatcatggtcaatcttcatccacgtttggtgaaccgtaattttgctatgttgttggtttccaaattgcttgtaaaattgtgccttatcaactgtatcggtcgcactaacttgatgtgctttaagcgcggttttagaactgtacgtcgcaaccaccacccgattaggaatgcaggtaatagttttcccacttctcttatatgttccagtgtatgtccgggtccagcattggctaaccgtattctcttcaactagttggtaggttttatcccgatttaatgtcagcttaattttaacagcctgcgcgtctggatactttttggttccctcccattttccgatgatcgatacctttttgctatgatgctgcacagtttgtctttgactcgttactggagtcctgtttgcctgataacgcacatagccggcgctccccaatgccactatcgcaattaaaattaccatcgtcaacgttatgatttttgtttttcgtttcatcaaactctcccctttttaacacttaatcatcataacgcaccataaccaccgaaaacacttcacgagttctaatctcattttattttaattttttattttgatattccgaattaataacatccattcttcatttgatgagcaatgcctatttatacttagccttgctatatacaactattataattgttcaccacaatttaccacgtataatgctggtttctttgaccatatggtctgggtttagccttgacatccaacttaaatctcgctatggtagtgttatattaaatttagatgagaaatcaacgactaggtcagtaaccgttcaattagtcttcagagagttctggtatccgctgcgacagaatagacattgaattgcgaacatcgcctatgagtgcgctgtgtcattaacttgatacactgttggggccacccattatcaggagatctttcgatcattaagccaagcacagtatttgcacttggaaaataaggtggtaccacgctaacacgtccttacttggggcgtgttttttcgtctattttttctaacttcaaaaaaggaggatcgttcttgacctttatttgacttaaatacatattaaacaactttggaggactacatattatgacaaaaactaatttaactctcgcaactcccgaagaaacacaattcgctaacacgctctttcaggcgttacaaacgcaaacaaagctcgatgagtccaaatatcaaacactgttacaagatgatgatgccgcataccgagttcaatatgcacttacccaacttaagcaagagcctgtgcgcggctataaggttagtttaacgagtaaacaaacacaagatatgtttgactccgactcaccactctacggcgcagaggtagaccatcagtggctgtcatcaccagcacagcttccattgtcagatatgatggaaccacttgttgaagtggaactggtctttacggcccaagaagatttatctgctaacgattctgttgacgaattactcaaaaaaactacggttgctgcagcattagaagtaccagacgcgcgtttcaaaaactggttccccgccttatcaaaacgtatggtcatggcagataatgcggtagctggtcgtgtcgttttcggtaaggaattggcaacaaataccatgaaagcggctgacctatcacaagtcaaggcagaattgacactcgatggtcaaccccttgtggctggtgattcttcggaggtccttggaaatcctttgaattcactccaatggctcgtcaaaaaattggaaagccaaggtcaaaaattgaaaaaagggcaacgcgtatcaagcggtacgtttgtattacccccacatcttacaaaaggccattacctctgccattttagcggtgactttggcgacgtcagtttagacgttaaataaaccggaacgtgtctggaaaataattgcgattgaaaatcgacctgaaattctattaattctagaattttaggtcgattttttgttctttttacattcaataattgtttacgctgaaaaccagcgactccactgggcgggattctcactgaatttgtcacatttattgtcattaagaaaatacatagtctatttttcccgggttttctcctctcggatggatttgacacacaccaaatgaacttttttctttcaaatattggatcaacatcaaacttgcgctgcaaatagatctcagaatcttgtttagataagtagctggtaaatcaagaaaatcatgattcaaacttacctagacgttccatggtcagacttcattgttatgctgatttcgaattcacacatccttattcatcttcatgtcgatgttcaccttgatggaagacatttgaatagtaaccagtcaacatttgatgaaacttattgaaccacgttggatcagccgctgcaatatcatcgtacatgctagcattgatcttggttaaaattgcagcgagttgatccaattccctgtcgtccaatacttccagaaatggcggaatttcatcaatcgtctggctggcttccttacgtcccatcggtgtcaaacttactagtgtcacccggcgatcagttatcgatttttcccgggtcacaaactttttcttctccaactttcgcacgaactccgccgtagattgcgccgtcaaattcaacttgattgctagatccttctgagagacatgatcctccgtcaacagggccagcagaatttttccctgtccctgaacgatcgtttgtcgttcaggatgttcacgtgccgaatggcgacgatgaatatcgtccgccacatgctgtagcgccccaaactcaatcagttttcgcgtggttgtttgctgcttaaacaggtcactcatcagtacgccctccttgattggtcttaaaatgacctaacgatgtaccctgatacttattataccttaaaatcccttcaaaaagtcaggggcccttataaaaaacattgacatattaatcaggggcccttataattcatttcgtcaggtaccctgaacaataaattacttatcaaagaaggttatcctatgaattcagaatacgcaattgaagtttctcatctcaccaaaaaatttggcaaaaatttagctgttgacgacatttcctttcaagttcgtcgtggcgaagtgtttggtctcctaggcccgaatggcgccggtaaaacgactacccttcgtatgatcacaactctattgaaacaaacgagcggacaaataacagttttcggtcacaacacgctcaaggacagcaaggccgctcgagcaacttttgggttgaccggtcagtatgcatctgtcgatgaagacatttcagctcgggaaaatttactcattttttcccgattgaatggtctcactcacgtagcatccaagcagcgagcaaccgaattattagaagagttttcgttaacagaatcagcagataagccgattgctgacttctccggcggcatgcgtcgtcgtctcgatctggccgtcagcctcattactcgtccatcactaatctttttagatgaaccgacaaccggacttgatccccgcactcggtcacaaatgtgggaaaccattcgtaatctcgtcgatcagggatcaacgatcgttttaacaacccaatatttggacgaggcagacgaattggccgaccgggtggccgtcatcgatcacggtaaattggttaaaatcggtgctcccgcagcattaaagcaacaggtagggagctcaacccttcagctttcactagccgatgaacaccaattgaccgcggctcaaacaattgtcactaatcaactacacacctccaccaagttgagtggtgcaaccatcatggccaagctaaaacactcagaccaggtcgccgacgttttgatcggtttccagaaggctgggattgcgctcaatcgaattaccgttcaagagccgaccctggatgacgtcttcttcaatctaactattggtaccaactaaaaattcaacatttttaactaatcgaggtaaaatactatggaaattaaagcttcgcacggtaatatcattacgaatacagcaacaatggcgtaccggaacctactcaaaacactgcataatcctgatcgttttatggatgtcatcattcaacctgtcatgtttatgctccttttcggctacctttttggcggcgcaattgccggtggcgttaaagcctaccttcctactatcgttccaggtatcctgattcaaacaatgctgtcagctgcatcaggatcgggtgctcaaatccgcgaagatcttgactccggcgtcttcgatcgcttcaaatcactgcccatggcacacattgcgccactggccgggcagttgtttgccgacagtctccgtctgttggtagccaccattgcgtcattaacgaccggctacttaatgggctggcgtcccagcgtcggattcgagtggatcatcgccatcagctttttggccatctttaccggctgggcattatcatgggttttcgcccttttcggtctgcttgccaagagtgccacaatggttcaaagcgtttcgatgatgggcatgatgcttctttcattcatgtcaaacgccttcattccgatcaaaacgctaccgaaattcatgcagactcttgccaatgcaaatccagtcacctacgtcgtgactgccattcgtcaaatattagccaacggtgcctggacaagtgaatccttgcttgttctcattttcggatgcggcatcgttctgatttttgcaccacttactgtgtgggcttacaatcatcaaaattaataatcgtatccgctaacgaaaccatcccgcacaaaatagacagaaaaaaatctcaacttattttctgtttccaaactttaataaccaaaaactggaaaaagacactaactgcatctcaacgtcaactgcattgaattcgttgacttctctgattagctacgaaaatcacctttttattcgctctattttttctaatcattaatatttcttttaaatatcagataaactagttgctagttatccggtgattgatgtaaactaggtgctaaattatatggagaaggtgattatatggttcaactgtattttcatactaacgatccatcaaaacgcaaagccgttaaatggctagcggagcacggtattgatttgcatcaacggaacattgaaaatgatccgttatctgaagctgaaattatgcatctattctcattatcacttgatggaacagatgagttaatttcaaagcggtcaaaagataccaaggctctcaatatggatcctgataaaatgacaattaaacagctcacaaatgcaatctcaacaaccccacatattcttaagaatccgatcatctttgataaacataagcttgtaaccggatttgatttggagaaaattggaatgtttgttccgaaaaaacttagaaagttagaattatcatctttgtttgcaaaactcaaccctgctaagggaaatggtaatcacatcaaacttgcataactatgttttatcgtagactaaaaggcataccagcttaccgaaatgataagttgatacgccttttttatatttcattcattaattagtcgaccggcacccactgataatgtgcccgttcaccaccaacaagctttggtcggctctttaaatacgtaacatgggctaagccaacttctttaattgatgttctgacggggatttgaacaaacttaacatgcataccaatcgatgtatcaccaatatcaataccgccagcagccacaatatgctcaacctcaattggatcatcaaactgttcataggcagccacttgagtaccaccacccgcgtttagagctggaaataccgtgacctcttcaaaaccgcgcttttcagcctctcgtcgttctattagcaacgaacggttaatatgttcacaaccttgaacggccagatgtaacccataccgtttcaataacggcataatggtgccaattaccatccgcccaacttcaatagaagaatgcttaccgatgacatggccttggatttcactcgtacttgatcccaatacaattaatgaatccttaggaaactgcgcattttctaaaaattcagtaagtccctggcgtaactgccgttggctctcttcaaaatcaaattctttcgtattctccaccctctaaatttaaacctaaattttagcatttttattgtgtgcactaataaatagcgaatcaacgggttcgttgttatgaattttaataatcgcctgtcccagtaatggtgccactgataattgaaccagctttgcaccttttttactgtctggtaaatcaattgaatttgttacaattgcttttttgatcggcgcctcattaatctttttcatcgcctcttttgagaagaccgcatgggttgcacaagcgtaaatttctttggcaccgaagtttttcaaggcaaccgcggacactgccattcgaacaccggtatcaataatatcatcgatcaaaattgccgtctttcccttaacgttaccaatcacgtattcaggtacggattccgtctgacgttcaatttcttctggattacgattatcaatgatcgcaatcggcgcctttaaaatttctgcaaatcgacgagcacgcgaaacgccggcatgatcgggggccacaattacaatgtcttccgtcaaatggtggtcataaaaatagtttgcgagcaatggtgccgccagcatgtggtcaaccggaatatcaaagaagccttgtacttggtctgcatgtaagtctaatgcaattaagcgatcgatttggtccttttcaagcatcgtcgcaatcagcttagcggtaattggttcccgtgaacgtgcttttcgatcttgtctggcgtacccatagtatggcacaatcacattaattgtcttggcactggctcttcttaatgcatcgatcataattaagagttccattaaatttgaattaactggatctgagattgattgaatgacataaacctcacatccccgtacgctttcgttaatcgtaatttgaatctctccatcagcaaattgcttgatcgacgcgtcacttaacgctagcccaacttcttccgcaaccgcttgtgccagtggacgatttgaattaagtgaaaaaagttttacacgtgatgcatttttgattccagccatgaatggcaacccccaaattatattttcattatattatcgcaacatttgtcttgaagtgcaagttgattagcttatgaatccgctatgaagtttgaaaatctgtcggtttaattccgtgcatgccaatcattggatcaatcgttccattctgaatcaacgccatcgttaactgcgcatcttctggatcaataatcttgtcatcatcattattattttgagaatctgaaaccgaatctttggcttcctgtaggtcattaccaacgggcatcatttctccaccaaacgtttccgtcagtcgttgtaataacgacgtctgtcgattaacagcctcgttttcaatacacgttgcaaaggcccgtggatcacctaacaaaattaacttatttttagcccgtgtaattgccgtatacagtagattgcgttgtagcattcgactgaactgcgggaccatcggtaaaatcaccatgtcaaactgacttccttgtgatttatgaattgaaatacagtaggccaatgtcaatctttgccactcattacgagaataagtcacttcattttgatcaaattgaataaccatctgatcggtcttcggccccgcctttttaccagttgccttgagatcaagcgccacaatcgtgccaatatcaccattaaaaacattattttctggtgaattcactaggtgcagtaccttatctccaattcgaaagtgttggccccgaaactccacttctttggttttctcactcttgataggattaaaaatattttgtgaaagttcattaatgcggtcaatacccgcactccctcgatacatgggagctaaaatttgaacctgatccgcactaaaatctttatcctgtgccttaactacaatctgggaaatcacatcggccacctgatccgcacgacacggaataaacgaacgatccggatatgacttagtcaaatcttttggaacctgtccaagtttaatagcgtgtgccaacgggataatcgaagattcagaagactgccgataaatatgatctaattccagcttcggtaactgttcaaactgaagcaaatcatgaaaaacctgtcccggccccacagatggcagttgatccttatcgccaactaacacaacttgcatggtactaggcaccgacttgagtagtgttttaaataaaagtgtatcaaccattgacagctcatcgacgattaacaacgcaccctcaagatccttggcattcatttcggtcggcatttcacggccgtttaatcccaaaagtcgatgaatcgtgctagctggtagcccggtggtttcactcatccgcttagcagctcgaccagttggggctgccagcaagatgggaaatggtcggtccttatactcattaatatcgagtgaatactgatgaagcttggcaaaggttgcaacaattccattaataatagttgtttttccagttcccggaccaccagtcaataagaacactcgcgacattagtgctttgataattgcctgctcttgtgattgatcatacgaaatatccagttgaccttcaattttattaatgactttagcaatggctttttcaccgaggtcaattggttcatcagacattaatcgctgaaggtgctgggcaatctgccactccccactaaataatgtacttggataaactcgatcctcctgaccgacaatttcattttttttcgccagatcaattagctgatcggcaaccttttgcggttcaatttgcacttgttggctcgattctagtagttggatagcattattaaggagggtcttggtaaatgtgtatgtatccccactttgcattgttacctcatccagtgcctgcaacacaccagcggctaatcggcgcggatcatcaggtgcaatatccatctgcatcgccacctgatctgcacgtttaaaactaataccatcaatatcctgggctaactgataggggttatcatgaataacatctaatgttttctcacggtacttttcaaaaatcgtcgctgctaatgaattaccaaaacctaaatcattcaaaccaatcacaatctggtccattccttgattatccgtcaaattatcaaccaaggattgaataatggttggtcgaagttttaatggtgctaaaacacttgaatcgtgagtgatttctgcaattgcaccagttcccagcaaatcgacaattttttcggctgtcttttgaccgacccctttgaactgatcaccggacaagtaattgactaggccctgtcgtgttgtaggttgtgctttgtgatagccggttgactggaattgctgcccatactttggatgatcaacaagttttccctcgaaacgatatagactttcatcgtcaacatccccaaaatttcccgttacaacaatttctggttcggtccactctaaattagtttcttcaacagagaccagcaatactttatagaaattatccgaacttgcaaaaaaaacggtaattactttaccaactaaaaaagacgactccactgggtcatcaaataagttaattgaattatccaccaaagtcatctcctcaaactatttcccaaaacaccactacttatcctgatgttgtttgagaaccttctgaatatcatcgatccgcttttcactcttctcataatagtccggatctaactgcttggcttggttcagataatccacatagggttctccaagaaccattgccaccagacctctgttgaattgtgtatctgcgcgacccggatgacgttttaaaatatcatcgtaaaaatccgcagcctgcgtgaaattaccgagtgttagtaacgcatctcccaagacttgattaatttccggatcctgcttccgcaaatcatgtgcagtcagcccataagcaattgcccgcttatagtccttcatctgcattaggctctgggccatcatcaaatatgcatctgccttcagcttatcgtcattaatcttgttatagtatttgattgcttcttcatacttgccaacttcataatagagatttcccaagccataactcaacaaattgaccgctttagtatccttggcaaaaattcccagagctttcataaacagctcttcagcctgttcgtggctgttcagccttgtcagaagtgcccctaaatcatagtaattttgcaccttgtcagggtgtgcatcaattgcccccaccaatttagctactaatttttcagattgttctttctgttcatcacgattaattccatcacggttttcagtcatttcttgttcccccctctaaatagtgtcagtcggatcattttcagatcgatttaaatagtcagtttcattccattgaactagttggtacccatccattggtgattgtgcctccagaatagtcgttgatgtgttgctgagtccgcctcgatcacgcaggtgatccagcgaaacacctaacaacccgttaataccggcattcatcgccgcaccgtgtgatacaataatcacattttgatcgccaggatgattgctgacaatctcatcaacagcctgtttaaaccgtctaatgacctgatcgaagctttcaccggcaatatttgacgcgttgtaacgatcaggatggttacgaaaagcgtcaaattctgttggaaattgttgagcaacctcctgaaatgccatgccttccattttacctaaatcaaattctgataaaccgctcataagggtcagcttcagtttttgattcaactgggtacgtaagtagttcgcagtatctcgagctcgtttgatgggactggcgtacatctgtgtaaatgacaccgtccgtaaatgctttcctaaacgtttaatctcatgataactttctggaaggagaggtgaatctccatgcattccttggtaacgcgactcaagattccattcagttttgccatgtctaataaagtatagtttagtcatctatttcttccttacctaaaatcaactgctcttattatcccaatatccccaacattgtgcaactctattttacaccattatcttcaacaccgatgaataaaggattctaattcgcaacgaattagaatcccttatttcatactatacatactgaagagcacgtgtctcattgtaagcctgatcaataatcgcactgcccaagcactcagcaccatcatagaaaacaactgcttgtcctggtgtaattgctcgcgcaggatcatcaaacgccacaacaacggtttcatgatcatcacttaaccgtacggtaaccccaacatccttctgccgataacggaacttagcggtgcaatggaactcatcgccataccgttgtgcaatatcatccacccagtgaatatcactcgcgttaagatgtgttgcatacagatgttcattgtggtagccctgcccaacgtacaagacgttctttgactggtctttgccaatcacaaaccaaggctcgttacttgttccattaccaccaattccaagtcccttgcgctgaccaattgtgtagtacatcaatccagtatgctcacccataacagtcccatcaagggtgaccatcttcccaggcttggctggtaaatacgtactcaaaaagtctctgaaatgacctttttcaccaataaaacagattccaacagagtccttcttattggcagttgccaatccagcttcctgagcaatcgcgcgaacttcaggctttgtcagaccagctagtgggaacattacccggtctaactgctcgtgatctaattgactcaaaaaatacgtttgatccttattttgatccacagcacgcatcaggtgcatatgaccattagcatctcgctccaagtcagcatagtgaccagtcgcaatatagtctgcaccaagttgatccgcatattctagaaacgctttaaacttaatctctttattacagattacgtcgggattcggagtgcgatctttcttatattcatccaagaaatacgtaaatacgcggtcccagtattccttttcaaagttaacagaataatacggaatccctatttttgatgctacttttgcaacatccttgtagtcttctgtcgcagtacaaacgccattttcatcagtgtcgtcccaatttttcatgaacacaccgacgacatcgtatccttgctgctttaaaagcagtgcaacaaccgatgaatcaacaccgccgctcattccgactactacacgtgtatgactgttgtcagccatgtcatcaccatcatttcaaatagattctggaaaaatccacgattgaaggtcgtaacaatccagtatcggccattatatcaaaattgaccacaacatgcacgcattaaaccttctcaaatacaccacgcttaaccatttcatcaaggatgaaacgatactgagtcgtaaattcatcagctcgagcgtgcttgaaaatattaaccgtcgcactaccactcttatttacggtatccattttaaagctacccaaatcttttttaaacgtgattttaagttttgcgaccgcttcgaacggtgacgtggggtccaatgaaccttcatagacaaacgtaccattgggttttaagtcgaaccccaaatctcgaagcgtatactttttaacttgcgaactaatttgataagtatctgaatcaccaggtacctgtaccttatctgcaaatgccatcctatcgcacctcactcttttgtttaagtcgcgatacaatatcacttaacgcctggacaaacgcggtaatctgctcagtagttgtataccgaccaaaactaattcgaatcgattcgctaatccgtggactatcttcaccaaacatagcagttaaaacatgtgacggctccaaattaccagctgtacatgcagacccaccagaaactgcgaatccagccagatctaaattagtttgtaacacatacgttgaaattcccttaacccaaatattgaacacatggttcaagttttctggatccagtgccccgttaatttcgaactcaatatgctgagccgtcagtccatcaataatctgctgcttgaattggtagtacttagtttgacgatgcagtttttcgtcatgggttagtacggaaactgccttcccaaacgctgcaattgctggcacattctcggtccccgcacggcgcttagtttcttgatcgccacccttaacaaaactttcgaaattgacgccttcacgccgatataaaaagccaatcattttgggcccattaattttgtgtgcagaagtggagagtagatcgatgtgatctgcttcaacatcaatatcgagcagtccatacgtttgaacagcatcggtgtgcaaccacgcctgatgatctttcaaaatttcaccaatttcgtgaattggcatccggctaccaacctcattatttcccatcataactgtgaccaaaatagtatcggggcgtaaggctgctttaaagtcagccaacgaaatattaccgaattcatcaaccggtaggtacgtcacttcaaaccccttttgctctaaataatggagtggttttaacaccgcctcatgctcaattgctgtcgtaataatatgtttacctaagctttgtcgtgcctctgcagtctgcaaaattgccgtattgtcgctttcgctaccgccgctagtaaacacaatttcgttatcattggcatgaatactctgtgcaattatatgacgtgcttggtcaacaaccattgcggcttgccgaccaaatccatagccggttgatgcattaccaaacacatggcgcatcttatcggtcatctcatcaatcacttcatcagacatgggcgttgtcgccgcattatctaaataaatctgttccactatcaaaacccctattcagtttgagcccgaaagagcgccagtaacatttgtgctgaacgcttcccggcatcaataataaattcatcaaaagaaattcctgcgtttgaatcagcagtatccgacattgcccgaacaacaacgtacggaacatgatgatcagtagcaacttggccgactgctgccccctccatttcgctagaaacagcctcgggaaaatggttcagaatttgtttcactgccgcttcactggcaataaactgatcgccactcacaattagtccagtcgtcacgttcaacccggtttcttgcccggcccgagcaatttcttgcccccacttttgggacgcctcgaaacgagcgggttgtcccggaagttgaccatattggtacccaaacgccgttgcatcaacatcatgataagccgtcgcagttgagacaacaacatcgccaacgtgtaatccgtcaccaatcccgccggctgaaccagaattaatcactacatctgcttgaaattcaacgatcaaatgttcagtagttattcccgcctcaactttaccaatgccagactcaaccaaaacaacgttttgaccgctaatttgaccttcataatatttttttccaccaagcgttgttatctgcttattctctagtgcagccgttaactctttaatttcttctggcattgcacaaattacaccaaacttcattcaaaaccatcctatcttaattaaccaacaaaaaacagaactaagtatacgagtataatcgcaattactagtccaataataaccaaatttaatttatgctttaattttaatgttctcgcgtcactgggatccgtatgacttcgcgtttccgatatcggcggaatttcttcatccggcgcatcagaaatcacatccgcatccggttcactgtccactgtctcttcaggaccttttcgtcctcgtttcgcctgttgttgccgataagcttggcgagacaatggttgttcttcttgatcctcatgattcattcaggtcaccactcaataccaatgtttgccaatgataaatcgccataattgtcttagcatcgataatcttttgctcgcgaatcatggcaagtgcctcatcaaggcttacccgcattacttgaagattctcatcatcatcttgtggtagttcgttcaccactgtcgttagtccagtcgcgacatataacgtcatgaattcatcacaaaatccaactgaggtataaaacgaactggcttcagtcagatgtgtcgcctttaatcgcgtttcttcattcaattcccgaatagccgcatgcaatgcactatcatcgcgatcatccagctttccagccggaatttccaacgtcgcctgatccaccgctgctcgccattgtttcattagcaacattttattttgatcatcgattgctaaaatggccacggcaggggcatgatgcacaatctcgcgggttgtcattttaccgttcggcaatttcacatcagcaacttctaacgtcataatatggccgctaaaaatcgtttttgaagcaaccttcttttcttctaatgtcacctttataaagatccttcctcgtcatccgtaatcacttgaacatgagctgcctgtggaccacgaactccttgcacaacaacgagatcaacctgctcacccggacgtaattcttttctcccggatccttcgataccgctaaaatgcacaaatacatcaggttcattcggaacttcaataaagccaaatcccttttgttcatcaaaatttttaacttgtccgcgcacagtcttttctccttctacttcgtcaatgactgaacaaaggcttcgtacgccgtttgttctccagtttcaacaactactgtattttcaaattggtgctctaaggcgtctgccaagcttaattcaaccgttcgtacaaacgtggcattaccaattagatcaatatagtcttccccaccagcaacttggtgatgaactttagtcttaaccataccgcccggatttttaaccgtaatttcagtattattcgttacttgatccgcatgtaacagtacactaactaaacttgaagccgacatcgctgtaccacaggcatcagtatacccaactccacgttcaaatgtacgcacaaaaatttcatttttaccaagtacccgaacaaagctaacattaactccatcagggaaaattgggttttgaccatcattcaaataacgccctagttccccaagctgatcgctttcaagcgttgcttgatcaacaaatgcgatcaaatgtgggttcggtactgccactgcagtaaatttcaagtcgctgtctaattcatcaattgcttggtcaaccagtgtttctgcttcatggttaacatgcatttttaaatcagccgctttaaaactaactggcgcaatatgtgcctgataagtcgcaacatccggtgctaaattaggcatcttagcgactggtaaatcggcctccatagtttgcaccgcgaacgactgtgtttggttctgctgtgccaaatagcgtgcaacacaacgaagtccattcccacacatgctggcctcactaccatcagcgttgataactcgcattcgtccaattgggcctacatggtctgctctgtcaacccacaaaaggccgtccgccccatccagtaatccattttttcgatcacaaatattaaccgccaattggcgaatttctgtttccgttagttgtctctctaatgtttgtgcgtctagcatataaaaatcattgccagaaccgtgtacctttaataatttcatttgcttcaccctcatcttggcaaaaaaataccaagtaattttcattacttggtattttacaccgttagttactaaaagtcatttgttcagtaccaacaacctgttcaaacgggtcatcatttaatccctatttttcaaggccctcactgacggtctcagggaattcacgccggacgatttccgcacaacgtgcacataattgtggataagcactgtccgaaccgacatcggtcgtcgtcatccggcaacgttgacaaacttctccttcagcagcagccactctaatcgcaacaccatcgttgtaattttctgcatctgcaggtgtttcatccaacgcatgaacgtgaaggtcagaaacttccaacaactgacgtgtgtcgccgttcagtccagccaacaccttttgattttcatcggacaagtataagtctaagcgtgcttcaagtgactttccaattagtttttcatttcgtgcttcttctagactcttcaaggcgtgtgtccgaattgtcatgaatgcttcccaagtttgaagaagttctttctcaccgtcatagtgcttaacttctggcatttctgcaagttgaacgaactcttctggttccttcaagtactgccagatttcctctgtcgtatgtggcaaaactggcgttaacagtttcgtcattgacacaagaacttgatagaaaacagtttgcattgatcgacgggtttgtgagttttcaccgtcaatataaacaacatctttagccacattcatgtaaaatgctgacaattcagttgtgataaagttcatcaattgtttataaatatccaaaaattcgtagttatcaaagtgtttcttcgttgactcaacgaattcattaagttttacgagcataaattgatcaactgattctaggtcgtcatattcaagtgcatccttttgtggatcaaaatcagtcgtgttagcaagtaagaaccgcattgtattccggaacttccggtagctttcagaaacctgtttaaagatctccattgatacccgtacatcggcagatgagtcaacactcataacccacaaacggataatttcagcacccatctgtttaacaactttgtttggttcaatcgtattaccaattgacttactcatcttcttgccttcaccatcgagggtaaagccttgggacaagattgatttgtaaggcgctttgccagacaccaccacactggtaatcaaactggagttaaaccaaccacggtattgatcagaaccttccatgtacatgtctgatggataagtgagataatcacgttcagctaaaacaccctgatgtgatgaaccagaatcgaaccaaacgtccatgatatcagtttctttagtaaactttccatttggtgagtgttcactcgtaaagccttctggaagaaggtctttggcgtcacgatcaaaccaaacgttggatccgtattcaccaaatagatcggcaacatgattaatcgtttcttccgtcataattggtgtcccatcttcaccgtagaaaattggcaacggcacaccccagacacgctgacgtgaaattacccaatcaccacgatcccggatcatattatgaagacgtgccttaccccaacttgggtagaacttaacatcatccaaagcccctaaaatttcatcacgaattttgtcaactgaggcaaaccactgatcggttgcccggaaaatgatcggttttttagtccgccagtcgaatggataactatgtttgattggcatatatttcagcagcaagccagcgtccttcagtttatccaaagagatcttattaccatcttcatagaagacaccttcaaaatcaggaccagcttccttggtcaggtatccttgatcgttcactggaacaaaaatatccaggccgtactgcttcccaacgttataatcatcttcaccaaaaccaggcgctgtatgaaccagcccagttccggcgtcaagtgtcacaaagtcgcccaacatcgtaactaacttccgctctggaaagaaaggatgctgtgcaataacacgatctaattctcgacccttaacggtcttttcaacttgcacatcttcccattcgaacaactccgcacacttgttaaccaattcagctgctaaaacgaacttccgatcgtcacccgaatgtgtgacaacggcatattcaaaatcagcatcgacggtaattccctcggatccaggaatcgtccaaggtgtcgtcgtccagacaaccatataagtcttgtcattttcaaggacgcccttaccatcgaccacttgttctccgtagaaagctgatggtgaagtaacatccttgtaatcaacttcagcttccgccagagctgattcagaagaccatgaccagaatactggctttttaccacggtataaaaggcctttttgagcaaaggcaccaaacactcgaatttgagcagcttcgtattctttttttagtgttaagtatgggttatcccattcacctgcaacacccaaccgtttgaaatcattacgctgcttttcaacttgttctagcgcatatttccgacataaatcacggaattctgaggtgttcatctttttacgatcataccccattttagtaagttgttgctcaattggtaagccgtgcgtgtcccatccaggaacgtagggtgcacggaatcctgacatggatttataacgtacaataatatctttggtaattttgttaagtgcatgcccaatatgaatatttccgttggcatatggaggcccatcatgtagtacaaatgttggtttaccctcatttaatttttgtcgctgttcataaactttattttcagcccagatattctgccgttcaacttccttaacgggtaaattaccgcgcattggaaacttggttttgccaagatttagtgtttctttaactcgcataatctctgcctcctataattaatattgtatgtagcgccgtggtatgatgaaaaataaaaaatccccgcccgcaagggacgaagatttcgtggtaccacccaaatttagaattaaaaaattctctttgtcattcaataacggggatgacccgacttagtctaacataatcgactaaatattcggagatgatctatcagtttcgtaacttggtcaacctttcaccactcgttgactcgctttcaagcacatctaaccgacttgctgttctcttcattattttcatcatattcagctaattgagcgcttgaattacttgtcgctgtcgggaaaaatcacaacagtctcgccagctgcagcagcgccattcaccggttcttcaaccgcctgcgtatccgctggctgctcagcaacctcgctcgctggttctgagtttacactttgatttccctcattgtcaagagtctttcctaaaaccttttggatttcatcatatgagctcacatctgattcttttaataagtcatcccaatcatcgcttgtgacaactcctagttgtgattctaacatcacttgtagccgctgtctgaagacacgagtctgcttcttcaagtcattggtttcaaccgttagcttacgagtagagtctgccgcgttagaaatcagctgatttgccttttcattggcctcagacacgatatcagtagcttgcttttgagcttcacgtaacgtaatgtcggcttctttttgagcattggactttactttatcagcagcttcttgagcaactaaaatcgattggttcaatgaatcctttaactcagtaaaatattttaatttttcttgatcggctttgaccgattcctcaagatcatgatttttttcggtcaacatctgaaaatctgataacacttgatccaaaaaatcatttacttcgtcaacattgtaccctctcatttttgtcgaaaactttttattttgaatatcttctgccgataaactcatctaaaattcctccattacttagcagtcacaagcgatatcgtaaccctaattttattcttttttgttaattgacccacatacttcagtctaattctaccaccatgtctaacggaaattaaatcgtgaattgctaccggataatccggtttttccatttccgtccaattcaaacgtacttttccatgctcaatcagttcctttgctcgatttcgggagtagttaaatgcggttgcaataatcgcatccaatcttaacgaactgactgtcgtttcaacatcctctgaatcggacacctgactaatcacatcatcaatcgtcattggtactagttgaattttaacattcgcaatcttatcaacctgcatgcgaatatacactagcatttcagcctcaaccatcacctgccaacgggtaccatcggagataatatcaccaaatgttgcacgttcaatgccttgactaatcaacgttcctaaaatttgacgatgcttcaattccgcaaacttcacaggatatttaacttctaatacctgaatctgaaagtcttcaatttgcggttcataatatgatggatagatgagaacccgcttcatttcagcaccatcaacaccaccttgcgcctgcatcgcaacatcatcattttgattgaccagcgtggaagcaatatagcgttgtcgcggattcagaaaatgagttaaaatcggccgatattggtcgattgcttcacgaatccagccattaatcgcgtcgataactgatcgttcatctgcacggaaatgctgttctatgttgctatctgccatttttctgaccctttctcgctaaaccatcagtaaatacaggtatgaaacaccatgctgtgccaaatacaataccataattgcaaccaatggcgaaaagctaattcctcccagcggaggaataaaatcaaataatcgaatgtatggtaccaccaagcggtttaataaaaggcctaatcggctttgtgaagcaccaggaaaccatgaaagtaacgcccaaacgacaatcaccattgcatacagctttaaaagttgttcaacgacataaaatataaatccaatcaaactgctacctctgctcttctaaaaattatcttgatccttggttagatttgcggataaattacctgaaatttcgtaattgtgtggcgtgcacaagaaaatttgatcgccaacgcgttcaattgcgccatcaattgcaaaaaccgttccattaagaaaatcaacaacccgtttagcttccgcattatccatctggttgaagttaacaatgattgcacgatcgtttaacaactgtgttgcaatttctttcacatcggaatacagtcgtggttcaaaaagcgaaattttgccataatctgtattttgacgcccgctattgattgacaccactttttgattccttccacttgttggcgttgtatcggtcgttccggtatcttcgtaatcctgttcatcttgttcttcatcatcaataccaaagaaattatttaagctaaatttaccagccatgattattcctcctcgcttgcctgattgtaaaatggggtcgattgccaaattatctaactactcagctaatcgtccccaccaaccaatatttatattatgaacgacgctttttgaagaatggcggcgtatctaagctatcctcgtcatcatcagccacgttttcactattatcattaaagacactaaactctggcttttcaaccttgtctaagtcactcttcttactatcagaatcacctgatggtgtcgtttgcacgtcccaatcaccaaatggatcgtcacttggttgttgacgttgtgctggtttggcagcatccgtatgacgcgcagatgacttcttttcatgatcaatgcctgtcgcaattacagtcacacgcacctcatcacccaagctttcatcaattgatgtcccgaagataatattgacatccgtcgtagcagcctgtgtcacaatatctgaagcatcttgggcttcaaacaatgataaatctggtccacctgtaatattcaacagaacattatcggcaccatcaattgaaacttccaataatggtgatgaaattgcctttttcgttgcttcggctgtccggttttcaccggttgcagacccaattcccattaaggcagatccctgattagccattactgtcttaacatcggcaaagtccaagttgacatagccaggtgatgtgattaggtcagaaattccttgaacgccttgacgaagtacgttgtcagcttccttgaaagcttccatcattggtgtttttttatcaaccatttccaataaacgattgttcgcaatcacaatcagtgtatcaacactggccttcatcttggcaaccccttcggcggcataacgtccacgcttgggtccttcaaaactaaatggtcgtgtcacaaccccgactgtcaaagcgccttgatccttagcgatttttgcgacagttggtgcagcaccattcccagtaccaccacccattccggcagtaacgaataccatatcagcaccttctagtgactgtgcaatctgttcttcgctttcttcagcagctttttccccaatttctgggtttgaacctgccccaaggccacgggtaagcttgggtcctaattgaatttttgtttcggcatttgacgcatcgagtgcctgtacatcagtgttagcaacaataaaatctaccccgctaacatcttctgagatcatccggttgacagcattactaccaccgccaccaacaccgattaccttaatcttggcgccaaattcttggcccgcttccattgaataatccataatctaattcctccatcgctgctgattaatcaaaaaagttattaaagaacttctttacaccttcaaaccggttctttttaggctgtgtatgttcttcgtgaacgtcttgcttctgattttgtgctggctgttgtttttgctcttgctttttggaacgtgttttttgtcgaactgctcgactatcagcattctttcgctgacttgcattgacactagttgtcttactacttccttgactcgtatatccgactgcttgtttaacaagcaggtcaacatcagacagaacactctcatactgagcaagtgataatcctaaagtaaacgccggatgtctgatgcccatttgatcaggaacatagaccttggcattaatctcaaagaaattctgtgcaagttcagcaattccaggtaatgccgttgccccaccagttaaaatgattcctcctggtagttccaaagccttaatggcttttaactggtcgttaatccgactaaagatttgcgttacccgcgcctcaatcacttctgaaaggtactcttcattcacttctgtagggtcttctttaccgacctcactaacagaaaacgtggttgtagcagacgcttgtctagcatctgcatagccgtagtcgcgcttcaagcgttcagcattttgcagtgacgtgtttaaaacgaccgagatatccttggtaatgtactgaccaccttctgggtcaacataggtaaacttcaactgatgatcgtgaacgacgctagtggttgtctgcccaccacccacatcaatcacaattgtaccaaaatcctgctcaccgtcattcaaaacttgcttaccaatcgcaagcggcgctacaaccatgtcctgaacttgaagccccgccttttgaattgcctttttggtgttgtgcaccaccgtcttaggtcccgtgaataatgtagcgtgtaattcgagtcgaacccccaccattccacgaggatccttaatttgatcaaacccatcgacaataaattcatttgccaatagatcaatcacttcacgttctggtggaatattttgaatcaatgccgccctagcaacatcaaccacatcttgatccacaatttcgcgtgactgattttgatcagcaaccgtcaccatacctgtgcaactttcgacttttaaatagttggctggtagtccgaccacaacatctttgattttaacattggacttttcttccgcctgtgtaactgcttgctgaattgcttgagcagtcttatcgatatccacaatgattcccttgttaagaccagctgagggttgactaccaacaccaaccacttttaactgtcccttaactttttcacaaacaatcgctttaatcgaggtggttccaatatctaatccaacgtaaactcctgaattatccatttacgtggaaccctcctattgtttttattttagttttattgtcttttaaaattatattgaactataccgattttaacacacataaccattggtctgaaaggctttacgcacatttaaatgatcactttaatatttttttagtcaactatcaaaatcagccaattttctcagtaactgcgtgaataagcaccaacctctaagttcacgatgccactgctactcattgaattagcaatgcctggatagtaagccattttttccttcaactgcgtatatttaatcagtacctcattgccgtcattcataaataatctcaatcgttgtggatcgtttttcgttggttgaaatttgacttcggaaatgccatcttgaattacctgagataaacctgcatactgctgtgccgtttgtaccaatattttttgtgacttaaacccagaataaacggccccaccatgcacgggtgatccctgcgcatggttaatcacatgaccactcgacaaaacaggcagatacacaccatttcgataaacagatccaattaattggttctctacaactgtcagtttaatatcccgaaatccagttacgctaatcgcaacattcttaatctccggattttcttttcgagccgtcttattgatcaccttggatcgctgatcaattttccacataaagtcattcgtactcagtccagttgctttaataacttcccgatcagtaagttgatgattacccacaacaacgattttatccactttactgaatggtgatatgataaacagcattcctgcaaaaatcgtagcaaaaaaaagcagtagtagtattgcgcgcaatgcagttcttccatggcgctgctttttcagttttggcaacttattgccaatcgattcggacgattgatgacgatgaacttgatgctgccgcttgcgttctaattcacgtttctcaatttccgccagacgttgtgcgtatcgatggtgggaaaaattgtgatgatcgtcacccatgtcagtcctcctcccctaagctaaatcttaattttgtgcatctcgtaatactgtgattaaccgatccgcggcatccggcattcccatctccttggcatgttgtgccattgcttgacgtaatggggcatcttgcatcaatttatcggcagcttgggccaatgttgcgccagacaactgatcttctttaatcatttctgcagcctgttggtccaccaatgcctgagcatttttggtctgatgatccgccgtcacgtatgggctcggaattaaaattgatggaattcctaacgcggtgatttctgcaatactagtggcaccagcacgaccaacaatgacatctactttgggcatcatgcttggcatgttgctaatgtacggcttaattacgatattatgaccaacttgtgcttcgcccaactgagtcatcacttgttgataacgtttttgtcccgtggcaaaaacaacctggtactttctatcattgaacgttggaatcgcctcaacaacactagtattaattttaggtgcaccttgactaccaccaaaaatcatcatcgttgggatatcatccgcaagccctaattccgtccacgaaaaatcactcttactatttgcaacttgctgtgcacgcggattaccagtcatcacgaccttttcctcagggaattgttccttagctgcttgaaatgcaatcgcaatttttgtcacgtaccggctcaaaaacttatttgtgattcccacaacactattttgttcgtgaatcacggttggaattttcattttggccgctgcgtatagtaccgcaccactcacgtatccaccagttcctagaaccacatccggtttaaattcctgaatcattttacgagcatcatgcacactttttaaaaatagataaatcgttttgaagttttcaagcgataatgatcgcttgaatccctgaattttaatcgtcttaaaatcaattcctgccgctggaacaattcgatcttccaacccacggtgagttccgacatacaaaacttcagtatcgggttcgatttgttttaatcgttcaataagcgcaagagctggataaatatgtccgcctgttccgcctccggaaaccatcaatcgcatttacttttccttctttccggttaattgttcaactgcagcaataaacttatcaccacgaatttcaaagtttgggtattgatcccagctggcattagctggtgataacagaatcacgtctcctggcgcgcttaattcaaacgcaattggtactgcagtttcacaattttttgtatgcttgattgttttgatacctgctaattgcgcagcatctgccattttatcggcgctttcgccaaaaacaattattgctttgacgtgatcccgaaatgcaggaactaatttttcaaatgtataaccacggtccaacccaccagctaacaatacgaccggctgtttgaagcccttgagtgccatttctgttgcttcaatgtcggtcgccttcgaatcattatagtaaattcgttgttgggcttccatcacatactgcatccggtgtcgaacgccaccaaatgaccgtaaaacatgaatgatatcttcatttgaaacgcccaaaattttagcaacggcaattgcagccagggcgttttcaacattatgatcaccaactgctttaatttcagccgttggcatgatctcttcatcacgccaaaagatttgatcgtttttaacatatgttccttcgtgactcttgccaagtcgagaaaatggaatcatttgcgcctttgtctgctgactgagggtctgccattcatcagtatcccaattaattacaaaataatcctctgcagtttgattggcagtaattttcattttggccgccacataattctcacgtgttttgtgataatctaagtggtttgaaaaaatatttgtaatcactgcaacatgtggatgcaactgctgggttccaactaactggaagctcgataactcagccacaatggttgaatgactgtcagcgttttgaaccacgccactaaaaggaatgccgatgttaccagctttgaagacctcatgatgattatgacgagctaagatatcacgaatcatcgtagtcgtcgttgttttaccattacttccggtgacgccaatcaaagttccatcataaacacggctagcaatctcaacctctgtcacgattggggtgccaagctcaacaaattttgcaactagcggattgtcataaaaaattcctggatttttgacaaccagatcaaatccttcatccactaatgataagggatgtgatccagtaatcacacgaacaccaagttgtgttaatgtatcaacctgtgttaaatcctttggtgtgttcttatcgttgacagtgacatgggcccctagcttcacgagaagttgagcaactgaaaccccactcttcccaagtcctatcaccaaaatttttttatcatcataatcgctaatgctttccatttcgttcaatctccctaattaaaataatatgatgtagcctaaaacaattaacgcaccaattaacccaacgagccaaaaaacataatcaaccttccattcactccaaccagacatttcaaagtggtggtggatcgggctcatcttaaagattcgcttacccgttagcttaaatgatgcaacctgtaacataacactggccgtttccaccacgtaaataatcccaatcaagagtaatgaaaatggatgattcaacaccaatgataccgcggcgagagcaccacctaacgctaatgaccccatatcacccatgaaaatttttgcaggtttatggttatatgggaaaaagcctaacagtccaccaattacggccacgcagaaaattgcaacatcatattggtgttgataactggcaactactgcgtaagcaacaaatgaaatcgttgctaaaccagacactaacccatctaaaccatccgtcaagttaaccgcatttgaaaaacctacttgccaaaaaataataaaaattgcaaacaaccaaccaatttggaaagtaccaaatcccattggaaaaccttcgtgctgataaataaccgcaaagaccattgctgcaattacctgtgccagcgctttttgccacggtttgaacccttcattttgatgatggaaaattttaatactatcatcccacattccaattaacccataggcaattagtgagaataataaagcccccatcgttggtgtcaaaagtccctgccaagctgcgacccacagagctgaaataacagcagcaataatgaatagtgaaccacccattgtcggcgttccagcttttttagcgtgccacgttggtccaatttctcgaatctgttgcccctcttttttggcacgaaaatactttatcagcgatggcatcagggcaaacgtaatgacgaatgcactcacgatcgttaaaattgttgcaattatattcatggtaatcctcactttttattatttttgtttaaatacaactcttaattgttgatgttgtttaatttgggtaccctctttgatactttgactagtagcataaccgctaccactcacagttaaatcaagtcccgttaattttgcatattggttcacatctgcttgtgaccaaccatttaagttcggaatcgttacgttaccacccgttatgagaaagattttactcttcgccaaaacatacgtccccgctttaactgattgctgcttcactttgttaccacttccgataaccgtcacgcccagtcccaacttgctaagtgctgcctgagcagtcgtcgtttcttgaccaacataattacccagtttgactttacccgcatttttttgattagctgccttagcactatccaacgcctgtttcattaccggattaaagacatccgctaaataagtttctgccgagctagatgtattttgtggctttttaatggtgacatacataatatattcaggattcttagcgggtgccatccccacaaaggaatacacataactgttgcttcccttttcatagccactagagccactaatctgagccgttcctgttttaccggcaatcttgtaaccatcaatctgatacttgcttccagtaccatcatcagcataaaccacaccctgcatgtacttacgaacttgttttgcagtttgcgcgctgatggggttacccacgaccttcttcccgtatgatttgacagattgattagtcgatggatcaacgatttttttgataaagtatggcttaagcattttaccattatttgccactgcactaaaggcctgcatcatctgcataacattgacggtaattccttgaccaaatgccgtgttcgcttgttctaacgcacctgaaaacggagacgagccactgacttcaccggtggttccaaccacatttgttttttgtaagaatccaaacttggttaaatactttttccaagtactagcacccattgtttgttccaggtaggccatcccaacgttactagaacgttcaaacccttctttgtaggtgatgtatccccaaccagccttattccaatccgtcacttgaccatcgccaactttgaaaaccccggacttgtagacagcattaggattaaagtttcctgaatcaatggccgcgctgatcgtaaagaccttcattgttgagcctggttcatacgcatcttgcgtaagcgtatttcgccaaactggactcgacgtggacttataatttggtcgttgcgttgccgcgacaattgcacctgttttcgcgttcattaagaccgcgttaaatgattctgggtgggaagcacttacggctgcacttacacgatcttctaatagggtctgcagttgccggtcgaacgtcgtataaatattatcaccatttttagcctttttggccgtctgctcagtgttggcaatctgatagccagatgtatcttgtttagcctttttaacaccattttgtccactaagttgtttgttgaatacctgttcaattcccatttgaccaacaagtgtggtattaccagattttttgcttgtttttgattgcgccaatccaacaatttgcgaagcaaaatcatcgtctggatattcacgggaaggggatgatacaaaattaattccactcaaatggtaggcggcaattttttgtttagtgttaattgaaatattatttcccgcactaccaaattcaacctgaaaagtgttcgatttagtcggtgtcaaaatttttaacgctttttgttctgagattggtaaatacttcgctaaaattcgagccgtttttttcttattggtgacatataacggtttaccattcacggatttttgactatgatcaaccaccgcatacatcgaatacgttttggaatcttcagctaccgccttacctgaagcatcataaatcgtgccccgctttgcctgaatcacttgtttttgcgtatataaatgttcggttctttcctttaaattaacatttttaacatctttaaaaatggcaatataagaaaaacgaacaattagtagagcaaacaacgcaatcgcgataaagaatagccattgaccaaataccttacgattttttgttgtttttctactatttgtccgtttatgattcttattcattacttattaacgttccttatatttgaattcgaaatcgtcaagccatatttttgagccacctgttccaagtgttgttgacttgttaattcaccaatcacttgttttgaacttgtgttttggctgttaactttcgtaatttgtgtattaacattttgtaatttgtgctgcgcatttgtgaccgcaattttcgttgatactaacgaaatcatcataaatgttaacataacaccacacactgtcaccagtgctttttcgaacttcgaccagccaaccttatccggcattggtgcctgtcttggtgcccgttcgggggttgatttcacctgtggttgactaacttgtaattcttctagtggtatttgtttcgcagcattagacgccatgctaatcacgttcctttttctattttttatttaattttttcgataattctcaattttgcgctatgtgcgcgatgattttcttctagttccgtttcacttgctgtaattggcttgcgatttactaaccgatagtgaggcttcatttcttctggaataactggtaatcccgccggaacatcttgcatctgcgtccgttccctaaacatggctttcaccaaccggtcttccaatgactgaaaggtaatcacactaattcggccattaacattcaataggtcgagtgcttgttccagagacgcttccagtgcgccaagctcatcattaactgcaattcgaatcgcctggaaactgcgctttgctggatgaccaccatgtcggcgtgccgctgcaggaatcgcatttttaacaatttcagctaattctacggtggtctcaatcggttttaacgcacgttgcttttcaatagcacgcgcaattggcttcgcaaatttttcttcaccataacggttcaaaattttgactaattgttgatatggccactcattaacaacttgtttggcatctaatgcctgactctgatccattcgcatgtcgagcggtgcatcgtgattatagctaaatccccgcttggcatcatcaaactgtggtgaagagacacctaagtcataaactatgccatcaatcgattgaatgtttaactgttcaagctgtacctttaactggcgaaagttgctttcaaccaacgttaacttattctgttctatcgcctgtgacagatgctgttgattatacttaatcgccgtttggtcctgatcaaatgcatacaaatgtccctgtggcgacaattgcttaagaatttctcctgtgtgaccaccaccaccaagtgttgcatcaacgtaaacgccttccggctgaatatttaatccggccaccgcttcgtttagtaacactgtaatatgattaaattcaggcatgtgttttcccccacggcagtttataatccaaagtccatcttttcggcaatttcatcgaagttttcttcagcttcatcggcaaaactattccagcgatcttcactccaaatttcaattcgatctgacaccccaacaatgacacacttcttttcaagtccggcatgttggcatagcgtggctggcaaattaattcgcccttgtttgtctaattcacactcagtagctgccgagtaaaaaaaacgaacaaacgaacgggcgtcctttttagtgagtggtaactctttgagttttccctctaatacttgccactcactcatcggatatccaaataggcaaccgtccattccacgtgtcacaacaaactgtgttccaagctcttcacggaactttgctggaataattagacgctttttggtatcaattgaatgtgaatattctcccataaacacgtctaatcaccccatttcgataacgcttaagaaaagtctaccacaatccaccacaattcaccacaacttggttaaaatatttatctgcaaaataaatagcaacgtttactatgagcaaacgttgctatatcaactgttataagaattttgtacaagtggggacttatcccataaaagtgtaaaaaatagaggcaatgtagacaattgtggcataaaaaaccgtgattttccaaaaaaagcgccagaatcggtggtagataagttcaccacttaccaaaatttgcccaatcacaatcagcattccaatcaacgcccacaacatcatgggatatgaaaaccaacgccacgttaaattaatactactgtagtatcccattaaaaatggccaaaccgtactatagcggaaaaatcgtggccaccaacgatgtaaaatccgtctcattaaggttataattactgatactaaagtaattatgacgatttgaagtataatttgtttcatgacagattcaccttttttataaattagttacgaatcataaacacgcattattataatgaaacaaatcagactattcaacagcttggacaatagaaattaggaggtgcttacttgattcaattttttgcggtcaaccaccaacacttggtcttgattaacgaagaagatatttttgcgaatcccgatcaggcacgttggattaacgtcgagtctcctagtcaagaggatatcaatgaattgatgaccctttatcaaattccaaaatacttttttacttctgttttggacgaccatgaaccttcccgggtagccaatctgtcatcaaataatgacgaagccagcatgctattactttcctatccgaaacaccaaacaagcccccttggctatctcaactacgcaacatatccaattaactttatcgtcattcaccacatcattattactatttcggatcatccggccccctttattcaaaggtttgttatgcgccaagaagtttctagtcaaatcattccggatcaaaaatggttattaacacagatgttatggtacattgcccatgattatgtgacctctttaaacgacattagtcaccaaatggaaattttagaaaagcaattaacttcggcaacccaaaatgaacagatataccagattatggcattacaaaaaacgctaattgaatttgaaagtgcgctaacacaaaatcgaccggttctaaaagcccttcgatccgccaattttttagtttcggatcatacaagcaaactcaataatgctgctatcattgaaaatgaacaggccctcagtatgtgccacattcagagtcaaatcttggatcaatatagtaacatggtttcagcggtcgtttcgaataatttgaatgccgtcatgaaaattttaacttctatcacccttattttaaccatcccaactattatcggcggactatacggaatgaatgtcgcgctgcccggtgctcacctcgcatccgcttttagtctgattcttttcgtcacgattattatcagcgccgtaacattagtgctgttaaagcggcacaattacatgtaatgattgaattttaggcatagtttcgttacacttataaaagtattttgaaaggcggcatctgattttatgaaaaaaaagaagcgttcaacatttgaaaaaattacaatgatcgctatctggcttatgttgatttccatgattggtagtttagtatttgcagccgtatcggccctcatgtattaacaaaattgtcctataacgtcaaaaaggatgaattacgaagttttcacttcgataattcatcctttttttaatcctttttctctttgaaaacttggcgcggttttgatccttctgctggtccgatcaatcctcgctgctccatttcatcaatcattcgagccgctcgattatacccaattctaaaacgcctttgaatcagagaagtcgatgctttttgctgatcaatcacgaaatcaactgcttcttgataaagatcatcttcatcctcatgagtttcgtcttgcaccatttcttcatcgctcacaacaatattttcatcatattcagccgtttgttgctgctttataaaatcaacgactgattccacgtccttatcggaaataaacgccccttgaacccgggttggtttattttgatcgatcggcatgaagagcatgtccccacgaccaagtaatttttcggccccgttggcatccaaaattgttcttgaatcaattccactagaaactgcaaacgctactcgtgatggcacattagctttgatcagccccgtaataacatctacggacggtcgctgtgtcgctaaaatcatatgaatacccgcggcccgtcccatttgagcaattcgcacaatcgcatcctcaacatcatttgagaccgtcatcatcaaatctgctaattcatcaacaataaccaaaatcaacggtaaatagggattgttttcacccttatcttcgttacttttcttaaccatctggttataaccatcgatgtttctaactccaaatccggcaaatagttcatatcggcgttccatttcaccaacaacctttcctaacgccttcgcggccttcttaggctgtgaaacgacaggactcagtaaatgaggaattccattataaacacttaattccactttcttcggatcaatcattaagaatttcacttgatggggcttcgccttcagcaaaatgctggtaatcatgacattaatcgctactgacttaccactcccagttgcaccagcaaccagtaaatgaggcatcttggtcaaatccgccatcacgacttgcccggtaactgcgcggcctaatggcacctctaaaattttattattcttcggggccgactcaaccatgtcccggaatccaaccgttgcaatttgtcggttcggaacttcaatcccaattaaagatttccccggaattggtgcttcgattcgaatatctttggcagccaatgctaatgctaaatcatccgccaaatgtacaatcttacttactttaacaccaaccgccggccgtaattcatacttagtcactgatggtcctaaactgacgttttcaatctgagcgtccaccccaaacgaagccaaagtatcctgcaaagtttgtgtattttgattgattgcttttaattctgcactttgatccgtagccccaatcttagttagtaaggcactacttggcagctgatagtcctcattttcactttcctgcgccggtttaatcgttatctgatcatcgtcatcatcattgtgactcgcctttgcctgcgtttcactggccaccgtaatcttaggctctaatggcttgtcttttacaggtggcgtggtatctgctggatcatcaaagaagtctgtcacgtgttttggattattatcatcagcagaagtcgtcgctggagacaccctctttggttgtcggactcgtttcggtcgtggctgcctttcaggcaattcatccttcagcgaagcaagccatgttccaatggctcgcagccccacatcaagcttctttaaaatcgtgaccatcgggatattaaagaaaataacaatcccaacaacgatcagtaaccatgcaaccatgatcgtccctaagcgtgatagtaaaaaatatgatagctggtacaaataagcacccagcattccgccaccgacgggcatatcaaaacttccttgcatgatatcggtattcaaattggtccaggtttgagcgacgaactcactatgccgatttagctgatcaaacatggcactatgaaagagtagtaaaacacccacgtagccaatcacaaatcctagcataaaacgccacttaaaacgtggccagcgccccttgagcgccattcccgcaccgtacaatgcaatgactaatagcataacatcatacgtttcaccaacgattacccgaaataatcctgcaactagtgttccaattgcaccgaggttaaatagccccaaaaccaccagcaagacaacaatgacgcctcctaggttatttagcgctgaatcatatttacttgagctcgacttgcgactggttgacttccgctttgtagctgtcttcgtttttgccctccgcgccatttttttcaccttactttagtttatcattgtcgtattcgtgaacccgttctaggttcggaaagctttgctgtctcagtacctcataaataacaattgctgcactatttgataagttcaacgcacgaattttcgaatcgtcttgcggaatacgaatcgcattttcgggatatcgacgcatgaatggttccggtaatccggttgtttccttaccaaacaagaaatagtaatcaccggtattaaccgaataatctggcgtcgtataatcacgactcgcaaattttgagacaataaataatttgttaatatctggaatcgtcttaataaagtctggtaaattatcatgatatgtaatttttactttatcccagtaatctaatcccgcgcgcttcatatgcttatcatcaacagaaaagcctaacggtttaatcaagtgaagttctgtatccgttcccgcacacgttctcgcaatattccccgtattagcgggcattaatggttcaaataatacaatatgatttgtcacaataaaactcctttaattttgccaaaataaaaaagcagggtctcggtgtgggcacggcgaaacgctgctttaatgaagtactccttggtaattaccaacgactaatcgatgtcaattaccaaacgatttctacattaaaatgtaccacttgttcataaataatgcaaatttctttcgccgcttatccatttttagtttctaaaatagtaacatctaccgtaattttagtgagttgtttaagttgatcactggtgagctgccgtgcatccttcccccaatggagtggggtcatcaataccatctcttgacgcaaattagtcggtatttcaaattgataggtgacacgatgctcaatcacgttttcgtaatgctgtttaaagagggcaacgaccttagaattatcataggtttgatgatcgccactcgggtataacatgtcacgtaactcacctaaatatcgagcattcggaatgaccttataaagtgagccctttggtttgaggattcgttgaaattcaccatagtctgatggtgaaaaaatttcaactaacgtatcaaatgtttgatcattaaacgggagccgtcggagatccgcgatgcaaaagaaagcatcggttgctaactgcgtggccaaggtcactcccggttttgaaatatcaaacccaattgcaacatcgtgcgtttggcgcagattcagtaactgcatcaagggcgtcccttcccccgaaccaacatccaaaatagtttgtgctgtcgccggcattaacgtattaattttttcaacaattggtcggaagagccctgccgttaataacttacggcgggcagacaacattgcagcatcatactccgtttgcccaccttgctgtagaaagtacagatatccgtgcttattaaaatcaatttgatgccctagttcacagaccaaactattaccaaccaccttttccattggctgatggcagaccggacaacgaaacaatgccaaattttgttcaacaaattgacgactacgttcgattttcttcatgttcatcttccttttcagttgttgatgatgcaggcgtcgtgtcatacaaaccagagttagctcgataccactcaaataaatgcgtaattaaaacctttaacaccgcatatcctggaatcccaaaaataacgcccatcacaccgaacattttacctgatgcaagcaatacgacaataatcgttaccggatggatcttgagattactacccaaaataagcggtgatagcacccgtccttcaatagtttgttcgattgcaaacacaattaaaactttaacaagcatccacggggacataaaagacccaactaaaatcgcgggcaccattgctagaaacgatcccagatagggaattaaatttaaaattccagccatcacaccaattgtaagggcgaatttaagtccaatgaagtaataccccagccaaaacataatggcgacaaaaaacgcgactgtcaattgaccgcgaacataattactaatctgcgcattaatctcacttaacacctttagaaaggacggctgtaaccgcgatggcacaaatttagcaacataataaggtaatttccggccatctcgaagtaaataaaacaaaataaacggcattgtaattaaggccactacaacggtcgtcatcgtacctaatacatttcccaatgaattaacggttgttttaatatagtcacttgaacgttgtgacagttcttttgccgctaggtctgagaaatgattgacttgaccctgaaactgttttgttaatggatgggcattcaaaccattcacaaagcggttaaattcatcaatatagtttggaaacgcagcaattagatcccgcaattgttgattaataatgggaatcacgctccaaattccccatcctagtagaacaatcacaacgataaagacacccgtaatcgtcaaggtacgattaactttcatttttctttctaaccggttaactaatggatttagcaaatagtagaacacaccagctaaaatgaccggtaacccaataatactcaaaaactgcctaatggggacaaacaaccacgaaactttgcttcccatgtataaaattagtagtaccaacaaaataattagcaatgcactcacaatccggctttgcttgagtaaattccaaattgaattgaccggtttctcatgtggtttcaaatgcccacctccccttaatcagataactgttatcagtttagcatacttaatattaggctggtattcttaacattggattgttaagatttagagaacagctcgaagggagtttttttcttgtcagaaacatttcttatcggaactagtacccaacataataacgcaggtatttattccactcaactagacccatgtcaggggatcctaactccggcgacccgtataattgaattagatcagccaaccaacttggtcctctggaaacagcagatatgctacgcagcctaccaaaacgatcattttcaaggaattgccacgattgaattaacgccatcccccaccatgccatcgacaaccactcaactaacgatcccaagtacccttgtcatcgatgatagtcgtgatttacttatcagtggtcatgacgccaccggttcggtaaccgtctttcacatcggcgtttccggacagctcacacaaactgacagtgttgttcatcaaggactacctggaccacttcaagaacaaaacatgtcccatatcaagggctgtagtcttactcccgatagccaattaatcgtttgtgattcggggatggatttaacggtcatttatcatatttctgatgaaggaaccctgcttgccaaatctcggtatcagagcagtgacggatttggcccacacacaattcaatttcatccagatgggcaaacggcatatcttattggtgactttcaaaataagattgaggtacttcgatacgtagcggaaaccgcacaattagaaaaaatccagacggttgctaccgttccaccagaatggtctgagcataatcgcgtatcggccgttcaggtatctcaagatggtcattacgtctacgcaactaatgcggggcataatacaatagttgtattcaaaattctaagtaacggcacccttgaacccatccagcaaattagtacccttggtgaattaccacaggatctctcattcagtcagaacgatcattacctgatctgtattaatcaactaactaacgacctaactctttttaatcgttgcgccaatgacggcaaattatctctccagcaaagtcacgttgcttgccctgcaggcacctgcatcagacactattaattcaaaaaatgacctttagatacgtgagtgcgaccattaggtaaaaacctaatggttgttgttcatcaccatctcaaggtcgttttttatatcaaataatttaaaaaaatccgggcaattgaaaaatagatcatgactgacgtcaaatcagaaagggtcgaaataaaagggccactggccaccgctggatcgacaccaatcttatccatcaaaatggggatcagactaccagctaggttagcaacgataattgccgcaaccattgaaataccaatcaccgcacctaagacaaaattatttttccaaataccaacaatcactgtaattacaattgcagtcacaacaccaattagcaacccggttataacttcatttcggatcaactgaatcatcttacgatcattttcgactgaaattttacgcacggcaacggccagactttgcgtaccagcattaccagcagtccccgtaatcaaagaaatgaaaactgctaaaatactagcctcactcactaagccttcaaaatggttaatcaaagttgccgttgacattcccaaaattaacaacgttatcaaccatggcaatcgatgaacggccgccataatgggggattcttccagatcgtccacattaaccccggccaaaccagagtaatcttcagttgattcttcatcaataacatcaatgatatcatcgacggtgataatccctaataaatgaccggcacgattgacaactggcatcgccaaaaaattatattcacggacagtttgcgcaacatccgcttgatcatcgtccacaaacacgctgtagacattgggattcataatttcacggaccattgcccgtttatcattactcagtaattcacgcaacgtgacaacaccgatcagattttctgcatcatcctgcacgtacacgtaataaataatttcagcatcccgagccaagcgccgaataacttgcattgccgttccaactgaatcatcaattgacacggccacatactcggtagtcatcaacgcaccggcagttttatcttcgtaattcagtaatttacgaacttcgtttttttcaccgctcggtaatagatttaaatatgtcgccagatcgctactcgttgcatcgcttaacatatcaacagtattatctgtatacatttctgataataccatcgcaccttggtgtggattcatctctttgagatacgcaattgcattgccctcattgacttccaattcatcaaacatgtcgccaagttccttggcagataaataacgataaactttagcccgttgttgctcatctaactgaattaacagccgagcttgatcataaaaatgaagttctaaaaaaacacgccgaaattcaatccgatcattttgtgctagcgtagcactgatcttctccacaggtaattggtgttcaacttcaatatccatcattaatccctcaaaacattaagaattcagtacttgctgtatatcatctgccaagggacatctaatttcaatccactgttgtttgaatggactataaaatttaattcgttcgcagtgtagtgcctgccgagcaatccattgtggtccagcatacatttgatcaccaaccagaggatgacctaaatatgccatatgaactcgtatttgatgtgttcgtcccgtatgcaaacgaattttgacgaccgttgctgctggcattcgtttaactacccaatactcagtttcagacggcttcccatcacgcaacacctgacgtttaacgaacgattcaggatctctgcctatcggtgcatctattaaaccatgatcggcaaccaaccgaccgcttacaattgcaacatagtccttttgaaccatgtgttttttaagctgcttgtccattacgctgtgcgcaaaatgatgcttaggaaacacaacaatcccgctcgtatccttatctaatcgcgtcgcaatatgggtgacctggtttgcgtaatgctgacgtaaatagtatcccttcactcgattaaccaagctgtccgcagtgacaacatggtgtgcaggaactgacgcaacccccgccggcttattaagcactaggtagtcttgatcttcatacaaaatatcgattggttcgtcacaacgatcgactgtatcactgcccttttcatccggcaacactagcgtcacagtctgccccttatgcatcattaccgttgtaaaaacatgctcaccatctaataaaatatcaccgccatgatacttagcaactacaatcagagcacgacttacttcgttaaaggctaaaaaggtccgcacacgaataggtgcatcttctaaataggtccaagaaaatttcacttgacaccaccaatgaaggcctcatcaacacgttgccaaaagctagtatgtcgataacgtgcaaatgcaattttacttttcgaaatttgataatgtaacttctgaattcgatgcgggttatccaaatcgtgagcttgtaattgatcacagctaacaattaaccgatcgtctgttttaagcaccagatcaacgtattgatcctgccccacaattatcggcgaccctaatgtgcggaaaacacgattgtttatcgacgcgatctcacccaactggatgccaatcaaactcggatccataaccgcaccaccgatcgacttattgtaaccggttgaaccggtcggcgttgaaatgcacagaccatccccacgaaaacgttcaaacagtttacccttaatgtagatatcacaaacgagtgtattaactgcctttttaacagtcgattcattaagcgcaataaaatgtttaactgtcccgtcagaataggtaatgtccacgtccacgagtgggtaggtcacttgctgaccagtatctttcttcaagctttcaactagctgatcaacttcaaaatcacgccaatccgtgtaaaaccccaggtgccccgtatgaatgcccacaaaacgaatacgatccaattgctgccaataatgatgaaaagcagacaaaagcgtcccgtctccaccgactgttaaaacaacgtctggatgttcattgtcgattgtcaaatgagcctgatttaatttggttgttaattctttggttaccttaacggaaccaccagttggattactaaaaattgcaattcgcatttgtctttcctcttaacacatcttaatggggaccatgctgaccattatcatcttgctgttcttgatcgctatgttcctgactagaccacgcattactttttccgtacgaaaatagattctgcgcttcttgaatttcctctcgaatttctgacatctcattatctaacttgaacgcagcctctgcagctcgctgcaaccgtgcgctcaactcttcaggaaatgccccctgatacttatagttcaaggaatgctcaattgttgcccaaaaattcattgctaacgttctcacttgaatttcggccaataattttttctctcctgttactaactgcacaggatattcgattacgatatgataggatcgataaccactcggtttggcactcgaaatataatcgcgttcctccaaaatagtcatatcacttcgctgtcttaaaaggttgactacttgatagatatcttccacaaattgacacataattcgaagacctgcaatatcttgcatatcttgttccaaccggccatcctcaatatgccgacgaaccatcttctctttaatactatcaactggtttcaccctgccagttacaaattcaattggtgcatgttgattcaaatcttgaaattgtttacgcatcccacgtaatttaatttttaattcatcaactgcttgttgatatggtaataaaaaatgtcgccaatcctctaccattgtgtcgccttccttcgtcttcgcattctattttatcatacctcattacttctgactgcccataagccaccacattcaggatttccacaaatcgctttacatttcacgctgaatttggcaaaatacaaatgctaagtactgacatacgttgtcacagacctacatagttgtaataagcatttaaattgtattttacataaactttggtaaagttaagttgcaattagttaagtagtctagtttataaactaactgatgattcgaggaggatttactgtgcttgaactatacttatttgtgaacccattgggaacacgctgcatgcgttgtgaaaacgatgtactcaaactggaaaatgaaattgatggccatattgcctaccaattcgttcccttgctaaacatgcaaacaattgataacacccttgaatctcatcgattgaacgcccatgatctgcaaaccagaaataatgtatccgatactatttttcaaattatcatggactacaaagccgcactctttcaaggtcgtaaacgtggtcgatcgttcctactgtcacttcaacaacagttagttaaccagaatagcaattacactcaaaacttgggcgcgcaggtcgctgaaaaagttcatcttgacttagaaatgttcaatgaagaccggcgttcctctttggcgctaaaatcgtttcatgatgaccaaaaaatggcaaatgagatgggcatcgaagccccatcgtctgccgtcgtgttcgacacacgaaacgatgatgacggaatcttaatcaatgattttgattattacacgctactcgatctgtatcgtgaacacggattggataccaagcagtcagctcgctcgtttgcagaatcgctcattcaaaggcaccatccaaatctacatgttctataagttaaccaagcagtcacattagtgattgctttttttagtgcaccgacttaaataatttattttttgctcgtaacttgtaaaccattccgctcgtcgacaaagcgttactattccctgatgataccttataattcgagcctctaacaatcttcgggtatatgtccgactcaaacttaatcgtaattttccttcctgttcaggcgccaagcaggcaaattgtagccactgctcttcagactcagctaccaacaattcaagccattcttgtacgtgccactgttctccaatttggtaacattcaagttttaacagtaatgtggtacgccaaatgatgggagaaaccttgaggggcaaaactgttttgttccatgcgtgacacacgagtggaatctccaccacactatgccgttgaagataacaacgttgttgaatttcttgaatttgagcatctgctctcataacctgctgttgaagcgctctggtctgactaattaactgaacattgtttaaccgagcctcacttacattccaagtcaagttctctagcggttgccaaacaacaagcctgttatctgctgtcgaccaatacaaaataaccaattgtccgtgcactaattgcataaattgtgcccgtttggtcgccgacagttttcgtttcaaatacggcgcacctaatatccaccacacctgaatatgtaattgtttgtacccctgattacgctgcattaatcgctccattgataacggactacattgaaactctagcgcaatttgcgttccatcctccttcaataaaagaatgtctggccgctgctgtatttcactcaaatacacttcataacgcggcctaagccccttctttgctgtccagtgataaagttgcttttttccaagtaaatgttcttgcgtttcaccttcactactggcgcagttcgtatttttgcgatgcgcaaaatgagccatcttaactttccctgcccgaaggaccaccggttcaccacatattgggcaaaaatagttctgccgtttcaattttttagaagcgactattcgtctgccgttgcaaataccaattatcataccctcacctcataattaaagtacgataactgcaattattagcattaaaaaagccggtcactaagtaaccgacccggcactactatagttgattaagccaatttccaaaaattttcattccggcctcatgccactgattaataatacgttgagatggatcattagcatagaaataattctcaggtaattcaatcgatagcccctgcttttgatcccgaaaatattcattagccaaggtattggtactatactccggatgaccagtaatgaatgtatttcgatggtctttagaaacaataatttggggaccagttttaatgttttctgaaattaatttcaactctggttgcgcaacaatgtctgctgagttaagcgttgtatgacgagaatgtggtaaataaaacgtccccgtcaatccatcaacaatgggatctttttcaagtgcatgatgcttaaaaatcccaaatattttttcttttacgtcctgcttttgaattccatattcataataaagccctgcctgagctgcccaacaaatatataaggtctgcttaacatgtgtcttggcccaatcaataatgtcagtaaactcattccaatagtctacttgttcgaagtcgattgtctccactggtgctccggtaataattaaaccatcaaaatactcatccgcaatttcatctaaagtagcatacatttttcgtaagtgctccaacacatccgacttaaaatgatgtgttcgaggatataagaacgtgaaacttaaattcttagaatatccggcactgaggttaagaatttggccctcggtttcaagtttattaggcataatgttcagcaccaataaatttaatgtttgttcagcctctgttccagactgatttaaaatgtactgtttagcatatttttgctttaattcagtcattattcacacctccattataaataaaaagatctccatcccaacaaccacattcgtgattatttgggacgaagatcttcgcgataccacccatatttttattgatctcacaatcaataactcatcaagtacaaaaatactcgtgcaacatatcgattgcaaaccggttagtcagcaccaacgcaccaactaacagactccaagatcatcttcataacacaatcaccatgttccatctcaccaacaggaactctctgtactagtgatgtgttactactcttcttttcattgccattaaatcttaacttgcctataatcatatcatcattttaaaatttgtcaaatatcattttttctcattttaaactgtaacgcagcgttattactacattctttttaaaattaaaagaaccttctgcaaatttctcacagaaggctctcatctatttattaaaatagtaacgtggtactttcatatattattaaatcaacatttgaaagactttttcccgaaaatttcccggatcgtcaaaatactcccaattacaatagtaggaacaccaaaaataatccaagttaaggcaagacatacatataaaaaaagcccatcgattaaggtgggtttcgtggtatcataaattcactttaataaatgtgttatcatttgcaatgaaatatggagggaacaatatgatactactatccactcaaaacaataacgtatataaatttatatccaatttaaacttgccaattataatttctattatagcattaatattatctgcactttcaatctattttaattatagtaattccctcaaaagtatgattttttcaaaaaaaatagcaatatatactaattatttgcagacaatttctgaagctgctatggataaaccgattatttctttggatacaaaacacaatcacttggccgataaaagcaatctattactgcttggaaataaaaaaatcatacaagcggctacgaagatagaacctatagatattgattcaatagattctaaggaatatcgtgaattaatcactgcaatgagaaaagatttaaacaaatatgataaaacagagttgaacgacacaaccatagatgattttattaatccataatttaaaaaatttctgttttaaaatcgtgtaaaataagtcgtttgtccccaagaataaaatagagtacgtagcacctacgccataattggtataggtgctatttttgtgtaaaataaaaaacaggcctcccagcgattaactaagaggcctgctttcgtatacttgtacgtcttttgatttaaaattaccacagaatgcgtttgagagtaataaaaaactccccatttctggagagctcctatgacagttaacgaatcattatcggacgtgaattcattgtaatacaactaaaatttattgcaataaaaaacctgcgtcaattaagatgaagacttctagttttttagagtagggacctaatggttcttaagctgtcgaattgtttaacatttgtttcaaacgagcattgtacgtttaacgtgcttgcaaagtaataataatattttattttttagacttccggaacaacaacaccgttgataagttctgcatatttatgtgctttatcaaattcatcaaatccatacgcctcattgaccatagttactaagcaaaaattgccttttttattgggtttcccaatccatttgcatccaactttaataatatacaattatatcagtcctttcgatacaaaattatccatccataagatcattatagcattgagaacagtattgttactataatgttacaatttattttttataataattacaaaattttaacaaaaagcccctacccgattaaaggtagaggcttatatcatcttattcctgcttatcagataagctcattaaatcatgcaaataacttataagctgtattttgtccaactacaccatcaactaaaattccggtattgcgttgcaactgttgaactgcggattgtaacccaccgccaaagataccgtcaaagccgttgactgaataccctttgcagatcaacgcaccctgaacaatgcgggtcatgttaccttgtgctccacgtcgaatggttttaaacgcggcctttgaacctgaaccaaagataccgtctactgcaatgtgaccaccaaactgtttgttaatctccgtttgaatagccttagctagtgctcgcttagttgcggggccgtttaagttgtccactgctagaccagtaccatagtttgcattcaaccatgattgaacggtcgcaattgaaccagtcgaagtaccagttgatgaactaactttcggtgaagcagtcgcaacgttcgtaaacgttacttccccgctgatgccatttaacaggtctttcttgaattgggcttcgctgatcccccacttgtttaggaacggcattggatccacatggtctgacttgttggccggttgatgttttgaacagtagtcatgggtcatcaggcccttagaaccggtgttgtattgcatgttgattccaccttgtttagcgagctggcgtgctagtgcaatgtacagtttgtatgactgttcaaattcagccttgctgttgaccagctcactgaattcgatagcagcgtaggtattgtgattccagccgccgccaacgtcccacgcgcctcggccggtgttcgcaacttgatagatcttcccttgacccacaatatgcgtatagaacgcgttcttgtgaccaccattatcaactaaatactttacttcattttcaatcgttgcctttgggtttccggttgaatgaagatgaatctggtttgctgttgtggcaatgtttggttgtccactaaacttgtgtactgtaatttccatgtttaatcacccttcttttctttgcctttatcaactgccatctttttaaatctacttttaacaaagtctggaaatggaattcccatgacttccaaattttccataatacttacgccatattgaccaatataaaaaaccagtgccgcgttagcgatactggtaaatcctaatgcatcaatgagtggataggtaaacagaattagaatcatgatggcaaggtgtttaatggccccttgcaagcccgtggtgctgtctactttcttctttgctttcgggaaaaaagctttaaaaaatcctagaaacatatctgctagcactaccagtaggaaagcttccatgaacggattatcaaccatctttcgtgctgaaattaaaactaaactaaatgtgaaacccggcggtactcccattactgcatctcctctatcttatttttttgtaccaattaatgcggcatactctgctgctgtcagtaagtgtgcttcattaattttgacggggtacacttcacccacgattgtttgatattgatccggactgatatagttttctttcaccgtccgtttcatattttcgacggatagcgtacccgcatcaaatgccgttttgagttcgataaaatttggaaaatcaatcattctttcacctcattaatacgttggcatatacggtgctcgtacgtcgccatcactaatcattggttgagcgtagtaaatcttgttaccgttgtgttcgttgttataaaaagaaattcgaatccccgttgtcccattaggaaccgtgataggatcaaacgtatataagcgccatccatgtatgcggcctggattcacagtcaacacattgcatacatagttactatttgtgccctgaaaactaattagcatgccaccattgaagtcgccgtcgtcccggtcaatattgccccagtaggacacgcatagtttatggccggggtcaggaatgtgtgacaggttttgactaatgaagttcccgccgcccgcactttcaatacataccgcaaagtttccatcatgggtgacatttgccatatagcactggtcgttgaatccatcccaatttgtttgttcattgatgaacgatgaattacgaattaaattaggatgcgactgaaccgaactcataatgtcaaaccaatcataagtgcgtccagtgccactttctcccatttctgaaagatacttttgcacatcagcccaattcatattaattccaattgagctatcagtcccattgttgagcgtcccaccaattccactagaatccagaatcccactttttttcgtgttcgcattggacaagctaatgttgtccgcatacatttcggtgtgaatgtatggattgtttttcgtatactcggattgattggcataagcatccaatgtgtaacccgtagggcttacaaccgtcttgagcatgcccccgccagtcatcgtagaaatatgcttcagcatgccatctttgaattccattgaacccttgtactcattctgtgattcatcaaaataatcaaacggcactgtgatgtctggtgaattaatagtggcggaatcaatctcgactgataccaacttcgtcaataccaatgtgctttgatcaatcttggatggtacccacttaccacctgaatagacagaaaaaccagtgatcttttgaccactggcatccgtcgttgtttgataccaaaagtctccatccttgggacttgctggtgctgttgagttcattatcaccactggcacatcctttgatcccggttgtcctggaagtccttgagcgccccgcgtgagttgccaagtatacttggtggggcccgttgattgagctttggtgttgtccgaataaatccctaaatagtcccggttgtgggcctgattctgatcagtagtaaaatcagtcttcccatcaacactgttagcataggcaatatgggtgtgagcatcttgcccatcgttaccatttgcgccagttatcttttgccaatgaccggcatagtcgttagggtcatcacttggcactggttgattgaccttagctacaatcgccacataagttttatctttagggctctggctcatgttagtcccttgatcatcgtcagcatagcgaatccacacataactggttgaaccattcttgatgccattcacttttgaacgtagtgccgctatttgttgtggcacggtgtctgttagtaccacgtaattcgtgaacgtgattgagcctttagttgtatcagtgtacgacttctccagagtagccacccgggcttgtaaatacagcgctgggttgtaatcatgatcaatgatcgtcaccgtatcaccaatatctaaattagggtcaatcactttaacttgagcatcataggtgaactgtggttgtgaccgggtttgaatttgagtcaatgtccggttgaataattccgtattagatgctgtatcatattcgtagaagtcttcaatgaatccttgatcccccgggttgaactgtccgtttgctgttcgtgctcgtaagaacttgtcccctttaacggtgtaaaagtctccgtcgtcgaattctaagtctgcgaaactcacatattcctgcggcttggtggtgtccacaattgaaccatctgcatcagtttctgtgtcttcaataactgaaccaacacccgccaatgcagtgacgaactcttgccgggtttcagttttctgaatattgtccagttcctcgttgtaggtaatctgaatgttatcctgcacggtcccaatttgtttgtacacgtcaaccacatacttgaccggtaccggtccttgcatctgaatgtgaaaccgacattcggcattgtcaaacgcctttaaaacagacaataagcgtcccaaaccggtatctcgacccgtgaacgtcaatgtccgggataaatcagctaattgattcacccctaactcccacggggtgccgtcagtgattacgttaaaataatcggtaaacggcttggcgtcttggtagtaccaaacatcacacgccttgttaaacagattgataccaacgtcttcacagtgcaccgttttgtaggtttgatactcgtcataatacagaatctcaaatgaccagggccgtctctgatcatccagcattgtaatgatattgcctgacaccatgtactgggtggctccatctaacttattcagatcaaacacatacgtgctggccccggctgtcagttccttgtgatgaaggtcattataaaaaccgtcggtcgttgctagaacgttcttcgaccgatctaatacatacagttgcaatttagtcacctcttaacgaatgccccggtatctttcttgctgttgttgaatcatccgtgcacgtgctactgccttaccatcaatatcaatgttaatattcaccttttctgataattcattgatgtgttccaatacacgttctaattcatgtgctttttctaaagctaactctagtgggctagtatcacattcaagttctaattctattttatttgcattcatgttgtccctcctacaaatatttcttgcgaatataagctttaacactgggcgtcgaagcaaagtctgaaaataaaaacgaaatgatattgttacccggataaatcagaatcggtttcgaacccataccctgaattgctaggttcagtgccccattgacacgagtttccaccttgttttcagtaccacccacactgattaggtcaccatcttcaaacgtattaggcacatctacatacttatcaacgttttctttccggaaccaaaaatcaaatagcaccatatttgaaacctgtgccatacttgaccactgacagatttgatacgtccagccagttactttcttagcaccacttgcagcctgatcaaatgtgactgtttcccgggtgccggaacctgtttcagtgtcttgaacgtccacagtccacgtgttaccgaatcgttgaattttgaccgtacccacaaacgtattccagcggggattgttgtcgtaataaacattttgatcatctgaatttctgaccagcatggtggtattggcattggcacccgtgacaaattgaatagtcactaatcgttcaccggctgccgcgtttagcacaatgttggtcaatccggtatcagccagttggctttcgaacccaatcttggtttcacatgtgaagttgtctgaaccagtggtcccttcactatcttcccatgtgtctctgtgcaccgaaggtccatgccagccccgatcagttcctgaagtagctgttccgaagttgtaaccagttgaaggctggtaacacatcaaggcccatttactacgattggaaccaatatagattgatccaacctgtcggatatcctcatcagcgcctgaaataccagcattaatcttgaattgagctagatcagtagccgtcttatcaatcgtaaatagtgtctctgacttctcaacctttccaccgtcaatctcattaggattaccaatcaagacgcttcgatcatgacctgtggtacccaagaacccattatccccatgattagtcacttcaaaacgggcagctactggcaatgggccgtcattgactatgttcatcgcttccgcttccggagcatcagttacaatctgagcaccaaaatagtccaaattgatgacactatcggtggtatcaccactcacggcatactgtggaaagatattgaaatacagatagccatccgctgaagcatagttgaacaactccgttggagtggcataactaattgtcaccagtgacggtgtaggtgaagcggtactggtactccccacccaactgtcattctgatcccagacttgcatacgagcgttatttccactctcacctgaaccactaatcactgcactgaatcgcgcactaacaatgtatttcttcaaccattccagctgctgctgtcggccacttatcttgtacttgtcccagtagcccggctgcgcctgctcataggcgttcactaaatcaaacttcactaacaggtggggagctggctgttgccagtaatcctgtgaactggcaataaacgagcaattacaccagttaccttcaccattttcagcgtctgaatatctgaaatgaattcgtagatctttgtttcccattcctgtcttataaggaatggaaccatagaatccacagtgaccaccgttaggataattagggtacacgttgtgcacgtccgggcggtcagttagatcaaccttcacccgtccatactcgttgtgccagtcagcatcagtaatgatgatgtagttgtatgggtgggtggcatattgatcccatgcaaaccacccaccaatttcaatgttgtcaccattcaaccggaaataatcgagcgctccagttttaggtgaatcagtcgccaacggaaacagcgtctgtgtaattgcagcggttcgtttaacctttgaaaccaccgtggcacacgttccatcaatcgaggccaatttactatacaagtctgttgtgatttcttgggtgtaggcactaggtggctgcatggcaacagtgatgggttcttggctggcatagatcgtgtgcgggacttttgaagtctgccccatcacttttccattgaagtcattttgaacggtgtattgtcctttggttgaatccaagtcgaactcatcttctcgtacgctgtacgcatagggatcatagcaaatccatttaatagttccggttaaatcaaccacatctttttctgggagttcaatttctccttccggaatagccatatagtatctctcaggcctatcactaaaaattaatttttttgtttccgtagtatggagaagctgcgaaatttgggacattttactccgtaaatcacccgaaataataaacggcatttcaattgttcgcttaccaaattttacggatcgtaattcatacccaaatctgtttccagggctaatagcatcatctattttctctggcaaaagcatttcatctttacccatagtaacttttaaccactgggtgagttcgataccgccataccatacttttaattcagacattatctaatcccccttattctgttactactattttgaattttttcttgttccttagtcatcaatggtgctaacaatcgaatcaacggattactgtcaattgctactactgcttccattgaatttaatttcttaatggcaaccaccaaatcggaaacattgtctgctacttcttttatttttttagccatcaagctattatcaccataattagatgggcccacattttgagtagtagtgatattctggacaacttgctttggtcgttgaacaatatcagcgtcagcgggtacattcaacccctttgcaaattgcggtaaaccaggaaacatgcgagctgttttatgagcaggaataactttggaatgtttttgtaaaggtaaaacaacatttcgaccttgtggaatgtatgtgaatccgttgggttcttgaatagcttcacggaatgtagctcccatttgatcattgaccatagccaatccaccctgaaaattgttagtacctttttcctcttttgctgcatgcccaatgcttttaaaaatagttgtaatagtgtgtacaacattgcccatcctattccatgaatttaaagcagaaattcctttctgaatatttccacttgccatatcgtgagccacggcctttttaactgatgtaggtgttctgttccaagactgaatagttcccatagcttgcctagtattaccagatgctaagtcttgtgcaactgcttttttcaatgctgctggcatggaattccatgaacttaaggtattatgtgccttgttaatatttccagacgcaaaatcttgccctaccgctttttttaaagcagttggtaagctgttccacgagcgaacagtatttgaagcaccgttcatatttccacttgccatatcttcaacaatcgcatttttaacgcttgtgggcatgctgttccaagttgtgacagataattttgcgccttgcatagggccagtagcattatccttaattgtggctacttgttctttaacactcatgttgttaaaaataccagtagttgtaatgaccgacattaagtcagcaccacccttagtctgcatgatggcttctttctggctaactgttaaattgttccagtcctgtgtgttataaattgcattgaccaaattacgagttgcctcgtctttaataacagcttttttctccccaggagttaattgattccaaacattcatgtctgcgattgcagattgtaattcaccttgtccatgagctgaaacaatggcctcttgttgtttcacagttaggttattccactgtccagacttttccatgagacgagttaaatcttcgccaccttttgattggatccaagccttttgttctttccaagtcattttgttccatttgccagattcaattaaagctttggcaaccatttgttgagcgttagtcgataacttaccttccttttgaagcaatttaatctctttccactttttagagcttgtaactgctttgttgatttcttcttgagcattagtttttacttttccagttttcggatcgaaaatgagattattccaatcattagccgcttttttcacacctttgctcatatcagaagtagttttcactaacttgctattagacttagctgcactctgttcagcatcattcatgacttgttttactgatttccagctaattccccaggtgttgaatacacccttcatttgtgtatcagtcatcccttgggctttcatgacattataaagtcccttgatgatactatcagaggtggcagtatgttgtgctttgagctgtttcatagcagttccatattctttagcactaatttgatggctcgaatacatatcctgaacaatttttttctgctttgtatattccttattctcatcactgaacgagtgagctaaggtagcacgcgtattagacaattgctgctgactcatttttttgacattgccatttatggccgccattacttgaaccttttttgaaccactaacacctagaatatttaactcatcgtcagccatttgctgatttaagttatgcatcatgattccttgatcggcagtaagcttgtatttattagatgcggatgcttttacaatagtagctgcttcttttgcagcactctttgcatcagcaacactttctttattggcttttttcgttgcttctacgcctttcttaacaattgctgctacagcaggcggaagatcgcttaaacttttgtctaggtgtttgttagtctggtcagcgtcactttcaatttggttcaacatattagaaaacgaatcttttacttcattagccgatgtcttaccattcgtggaccagttctgtaaagcagcagatgagttattactgaagttttgaaatttctgcaatgatttatcagcagtggcaccaacatcagatccccatcgagcagatcgctctgatgattcgaatgcttttttaccccagagttcccaagctacagcgccagcgccaacaactgccgtagtaccgataattgctgcaccaagagggctaatcgctgaacctaatacgccggcttgaccgccggtagttaagaatgttctacctagtaatccccaagtacctttggcgtttgtgatcgtgctatttgctgtggacatggcgcttgtagttttactaataccaccagttacgctgttggtagctgattcagtggcttgcattgaaccattcaatactgctgatttagcacgccattgttcgtacttactgataacaccgaccacacttgagccaacaaatccaaagcctttactaagcccccctgtaagtttcatcgccggtccagtagcagcagcaattaaacccatgtggataacccattgttgagaagcattgtccatattggcaaaggcgttaacaacgccggtagcttctttaattaatggtgtaagcgtcggaagtaatttttcaccaatcgtaacgcctaaaacattgagagaagattcaaatcgtttaatctggttagctttagtgtcatttaattggtcggcaacctttttagtagctccagtggcatcttccgtattttttgtaagtttacggagactatcagacccggcttcaacaagcgcgttagctgctgcttgattttcacgcccaaaggcttgtgctaatgcttttccacgttctgctttagaccaaccactggttcccttcgtaatatcatcaattaattgtggcaagttatgagaatcttcttgaaggcgtttagcactaatccccatcgatgtgaacgcctcttggttttgcttagttggcttaactaaagaagtcaacatgccccgaagattagtaccagccttctcgccttcgatacctttattacttaattcaccaattgctgcagctgtttcttgaacgcttagtccaagcccattagcaacggggccaacataactcatggcttctgacatatcaccaaaaccggcagccgttgcattagccgcataggttagtgaatcagtaaccatctgagtattcttcatagttcctttgactgagttcgtctttaatccaaattgctcaacaattgaagctgtggcttgcatgacaactcccaattcttcaccagaagctttcgaagcatctaaaacagcgggcatagaacccatgacttgtttggtagagaaaccacgtttaatcatctcagacattgcgttgttgacttcggtggttgaaattccatactgttgtgaccatttttttgagctagttgccaattgatctaactgtgcacggtatctagcggtcacagctccaccgttagttagtagtggacccattgcagaaatttgcgaatcgaaattaatggctgctctagccgccaatcctaatccagccacgattggagcagacacacgagtagtcatagtagatcccatggctgacaatttttgcccggtagcagtagccccggaacttactttgttcagtgcacctgtccatccagttgtttcaacacgagctttggcgattaccgccgcgttatttgccaattgggttctgaatgaccctaatttagcgttcgcattttgtagctgtgttgccaaacgaccagtggccgccgtagctttaccattcacaaacgaatcatcataggactttttaagactctgaacaactcgttgttgagcagtcatgacgttgctcaaaccacgttgtttagcttgtaataggtctaattgtttaccactagcggacatgaccgatagactagatttcattgctgccattgaatatttaacttgttgcttagctcctgttaatcctttaccaaacgcagagctatcaagtcccaattcaatgaccatttgtccaagtggttctggcatatgttatctcctcctttctagaatgactggatgaattcttcgagtggaactactcgttgctgtgtgccatccgctttagaccgcgaattatcgcgagtagttttagcgttaatcgtttttatcaaggcaccatagtctgtgtctagaacatcattgatgttgaaacctggaaagacttcaacaactgatcgaattaaatcataagaaccttgaattgcatcattagtatcggagactacgctgtcggaatctccgtgaagccgtttgggtctacaccaagcatttgtgcaatagtttcttccatcttttcattcgcgtcatcggccggcaatccatctaaaatggcatcttgtgtcacacgttcatctctaaataagcttgcaataaaagatgccttttctaacaaccaatctgactcaagtacttcttgttcctcaatttttttattcatttctagcatctcaatatgcttacgaaatggaataaatgtttcttcaatatgttcaatttttccgtcaatcatgaggtcgatcgatactggttctgacatttgtattcctccattttttaaaacacccgcccctattcggtattgtttatttcacaggcgagttagttgttattattcttcagcaggcgtaataactgtaattgttgacttagctgttttaccaccagccgtcactgtaatatcagccgttccatccgttacgccagtgacggttccgtcatttacaactgtagcaatggtgtcatcattagacttgtacaccactatcttatctgttgcgtcagccggcgctactatcgctgttagcttaatagtctttccaacttcaacatttgccgccgcaggtgttaaagtcacatccgtgacggctacgattttgggacggtgattccaagttgagcctttaacttatcaattgtttcttgcgtagaaccaaaatatttaccaacatattgtccactagtctcatcacttttatcagaagccattgcactaaaagtccaactatcagcttctggcttaaatgtctctgatggatctaacgattcaaacgaaattttttcacgggagaacacgcctttataaaatcccaaaagtgcttgaccatcgtttgttgtagattcaagcaataatgcacaatatggggcttcagtgtcattcccgatataagaaattccgtccgtctcatcaccttgaccacgatatcccagcaaaatatctgcttcggattcaggtaaatctagcaatccaagctcggctgaaacatcacccaccccttttcgagaaatataataagtgatatctgatccagctacttttgttgcttcttttgataatcctgaaatttcagcagtggtagttgcacctttatcttgtttaccttcgacaatgattggcgtaccaggagtcccgtcaccagcataagggacagcaattgctcgtttaaatccaactaacataatttttcctcttttctgttaatagtttgtgtcataaagttttgtattaccttcatatcttcttgcatcgacaaataaatttgtttctggaaaatactcatcaagaccatccgataattgagcaaaattaaaagcacccatttcctgttgaatggctgcttgcgtttctttgcatatttttctgtcggtaccctgaacatcaatttgaatactaaagttgactgttaatccttgatcacttccacccgtttgcttttgtggtggtcgtaaaggcttaatgatgattcttggatattcgtcattgttcgattcagaataatcatagaacttaatgtggttaccaacatttttttgaatcacggtatttttagttagctgatcataaatgctggttaacatgtcttgaatcataataacttctccaattcgtgtttttctaattctttcatgggttgtttggcgctatcaaatgcattttgaacctttcccataccccgcgggctataagaacgcccaaatctggtatagccaaattcatttaaatggactaaacgataacgttgttttgagccaccgccatcccaaccaattttgatattccttacaccaccgcgagctctcggctgaccaacggtaacttcgttgacggttgcaccagtatcacgatagctaccgacagcagactttaattttaccgccatataccgtccggctacttttaatgcgtcgttagaatatttcgatacagccctctgacccaatttcttttccatattggcaagaacttcgtccattccttttatattcacactcatacatcatcacgtcctaaaatgattttaattacacggttatcttcataatctggtgcgatctctagcacattccacagttgataatccccatcactcatcaaattacgataatcttgcacttttacgacatgcttattggatggcacatattcacctaacggatcaggaattttgatagtcagtccttgtgcagactggtgagagtccaagatagcttgatcttttacactcggatcgtacacaagtgccaaacagtgaaacagtttttctcctggtgcagcacctggttccggaccattgtttgaattttgagtataaaaatagactgggacgttaaactgtccagtcttaatgttaggcggtgtgtactcaaatattggtctgctcatcgtcatcctcgctttcttctatggtatatgcagagacagacaatgacagtaaactactctgaaagttctcgtcaaagaactctaatgagtcattgtagatatatcgacatctctccattactagttccttaaagcgcggatcatcagcggttttaaaaccggtccgatcctgaattgcttggatagacgcagtgatccaatcatcaaaaacaccgtcttgcatactatggaagatatgaagtctacccttgagttcctcaaccaattcggcattttttaaatcagtcatgcaatcacctactcatctgtttcgataattaccggtccatcgaatgattcattaggtccttcatcctttgtgagttcttcaatacgtgctttggtagtagcacccacgtatttttcaaaagggtacacatccccgatattgtaaatatgtccttctgcattaatattaccatctctaaactgtcgaattactcgatacataatttactcctttctatttatctaaactagattcccctactacggcttcaccgaccttcggggctacgcttttggggcatcagtctttgtgcctgaagccgatagatccaaatcatatacaaatgctgaattgttgtcttctgctttgccataaaagaactgctttgctgtgtacaaggtaccatcttccaaagccaatgtttgatcaaacgtcttaatattaatgccgccagcacagtatgcatcatatcgatcagctacaaacgcgattaacttaccatccggaacggcctccgattcaacaacgttaattccgaatggataggctagcacccattgaccgtttacattttgcatagtcatggccgtttccatatcaacagagatgcccggtgaaactagcagtgttactttgcctcgcgcagcataagccttaccattttccttcttagataaggccttaacaatcgcacctaattcacgcttagcagttgcgttatctgcaagagtaatagttccaaccgattctttttcaggataaacaccacctgttactgttacatctttttgaacctgacgattcaatccaatcggttgactgttcccatcaccagtaacgaacgctaattcggcagctacagcaaatgcttctgtaatttgtgtagtaacaaatgttttaatccaaggagcaccgaactctaacacatcgtttggaatagccacgaatgctgtcagtttagattgatctgccttctcgtcactgaatgaagcagttaattgacctttaattccgtcaaacactttcccccaaacagcaactcccttggcatctgatttcaagaatttcaggcgaagtccggttgtttgcaaatgaatagcttgtagaaacggatgatcagtggttaaatcttggaagatttgatcaatcgtcgtttctggcaacgttacttcttcactttctttgtgtgtgaagtctccagaagctaattcattaaagaacttaacctcttcattggtaatcttaggatcaacagtacgagcattgaacatctcgtctgctttttcttggacttggttagtaatttcagcaatggaatctgaacttaacgcatccatcatttcagcaaaagcacttgcctgcttgtctgaatctgcaccttcttttactgcatcagcatatgctgttcgtttcgcagcgaagttagaaaatttttccgtatttaatgtcattggcattttgtattcctcttttctttaattaaaaagcaaacggattaaatttcaccgcttgcttagttttgggttttaccgcgtttgttaaattgttttgcacaatatttgcaatacgcttaatgtcattgtctgtgattgttgtcatagaagtagcttcaccagtttgattgcttgatttatctaataatgctgttcgagcctgttcaattgcttcatgcgatacgagtcctgattcaaaagaagctgtgagttctaattcagggttggaatcctcaaacataatctcatcaacaaacccctgctctttagctttttcagcgtttaaccaagttgtctccttcatcacgttcaaaatttcttcttgagacttaccagtttttgctacatacggtgctgcaatgctcttattaaatgtatctaggacctcagattctttttgatgaacttgtgagtctccgtaaacactagactggacattgtgaatcatcatctgcgccgttggagacattgttacatggtcccctgccattgcgattacactggcagcacttgctgccattccgacaatacttacattgatctttcctgaatagctacgaagtgccgtataaatctcgcttccagcatcaatcagtccgccaccagaattaatcacaatatcaacatctgtaccatcctctggcaatgcattattgatatcatcaggagaagtggctggcattttgaacatgtcgtagaaccatttatcaccatcattaatgatggggcctttaacattaatctgtgtcattattatcaccacctttcgttgtatagtttttagtaattacgtattcatctccaccctctcgtggaggtagattgaagtcacgacgtacatcgttattgttgagtgtgccggacgaaattagtttatcaatattttctgaaagttggtaaatatccttctgatctaatccaattggtttaacgtgcataccggagtcatagtcagcttgataaaaaattttagcattcagttcatcacgtatttttttaatcagtggctgataacagtaggtaatgaaagctttgttattttgatccacttctgccatctgaccgtggattaaagccggtggtacaccaataatattcgcaatatcatcagtatatgaatcaatcaatgactgaatttccgccaccgattgattcttttctccaactgttcctgatacttcgttatattcgaaatcacgtgtaattggcacaattgccacactattcttttcgaatgattggaatagtttgttgatatatgactgaagtttcttagcatttgaatcctgtgttccgcttgtcatatttgctttaacggttcctcgaatttgattattacgtaaattgatttcgattagccgttcaaataaacgaccatagtctgaccataacccgtccgtaaaacgttcgagttcatgattgttgtatgtcatgaaccaaacctcatccatattgaatgagcgttgaaacgtataattcttaactgtcacaccatcaaaaatatccggataatttgccgactcatgacgaacatagctatcagctactaataggtcacctgtcttattagtaatcactagaacttcgttatccttaattaacgtgtaaactaacttttgccaaaaatccgcagctgacgaatccgtatttggcctaacatttagtttgtaattccactttttggatagcgtgtcagttgcaacatcaaaaccatccatgactttaaattctgtagtactcgctgcccttgcaacaaagttgatgactttatccagtgccattctttttgcatacactttgttaccagattcatccatgtaatttatgtcatacataaatttcgtatcatcacgtttagttaacaagctcttgatatcagtaaagattgacatgcacttttttcacctccttaaaactcaacatcaaatagcatatccagttgttcgccagcatcagtatcgggtaactcatccactaagtattgcccgtattcaaatgctttaaaaccatccgtctttcgtcgaatctcctcttttttcccatatttcttgtttccgtgtgcatccacggtcaccaaaacgttctgagtattccatcgaagaataggatcgtcaccccaaatatatgttgatgcagcaaaaccattttcgattctcggtgctaacaatccatcaatagcggttggatttctgatgacaacaacttcgaaatttgcgtcttcaaaaaacttccgaagcaaatctgcccggaagttatccattactacttttctgatgtcatacttttcacgttgcttaacgaaccaatcgacagccttttgtggatcaattgtattttcgtctagtattgtaattaatccatcctgtgaccattgaccgattggtggtgcattccgtggacgattctctggatcagcagaatatccataatacttatctacaaatcctttacgcgcaaactgatgtccaataaaatactgtgagtcttgaaatttaaaagttaatccgcaggcagtaaagtcccgaatactggcaaaatcgattgatccgattgcctcacgcccaaccaatttgtcatatggaattggtttattcgtagctttaatttgttcatatggtgccacggacttttcagggtcaaccagcggtaaatccattcttttagtcatgaactcttcacgtccactcggttgtgactgcattttaatgtactgcttttttatctttcgaaataacgtttttccgtacggagtaagtggcttaaccaacataggatttgccatctgccacttgtccatatcatccacttcatcttcactatttagtttgcaccaaaatggaaagatcgtatctggaggcaattctccccgcatagtctgtaatgcaatatctttcttaccatctaaatacccgtctctaacataaccatctgatccaatttcaaactgtctggattcaggcaccttgccaagtccagattcatatacttgaacacccgaatcatcaggatacatatgaacttcatcgaatacatcgaaaccatctcgtaaaccgtcttttgtgttaccatttgacgtttgataagtcacagttgatcctgtttgagaaacttcaatttttgacttattagcattaaaaacacttaatccttcgctgtgtgcctgcaccgtattataaatttcggtgactgacgtcttcgcttgatcctcagagttcgcaacaatggaaccattgtagccggggatattgtttaacggactaatgaaataggagctaagtgcactgatcattccatttttgcctgcaccacgaccaactatccagagatgttcgtcatagtaaacatccgaagtattagagtcataaagaaaaatgaacgcgtacagaaatttttgatattgtgccatcgggaaaaaccacttttcagtgaacttgatagcatcatcaatccgttcttcattaaagtaaagatcgtcgtttgagagaacatatttcttcaaatagttcactaacatgattcgctcattattcagcatgatattgccattctcataggcatttatgtaatcatctacatacttttgatgaatcatatcagaccacccttttctcccttagggggcggtttaggatgtgatttttttgatgtgttcatggcagaatagattactttttctaagtccaacaattgaatattaagtttttgcttttcggaaattgcaggatttaattttacatatttttgcgatccattttctaccacaatcaccatgccatcagctttcaacgtgtcatcaagtttcctgtatattttgcgaagatttaaataacgtgatattttttcttgtaaaatataattttccttgtcactatcttcctttaaaaagcgttcaatatttgagattgtcaatccaaccacccccctttcagtatttttaggtgtcatttttccgcagtcgagtcctacccaccggttcccatttcaaatttttcgttgaatttttttgaccccgggggggaataaaattttgaaaattatttttgattttgtctgagaaaacatttttcaacatagaattcagattcgttgtccaaatccacgttacctgttctagcgtaacgtttggccttatcaaatgaatcgaatgccttgtcagtgataactaggccatgcgacttcttcattactatatagataagtatctcttgcattgccttactccttaatctattcgtgctgtgtgttggttgaagtcaacgagcaatacgtgaattctcctatcattcataacaacagttgcagttagcatgttaatgccaggttgctcatcgttagtaacgtactgatagctgtatgaacatatgcctactcgttcaccatcaacgattatatcaggcatgttatggtacataccaactactatctctgcgccaccttgagttgttgctttgattagccgtgccatcatcattctatcctgatccatgtcaatcccacctttcatcctttgcccacttgttaggcttcttcttaatatgtttatgtactgcatagttcatacgatgatgtcgtttgttgtgacagtccttacataatgtacgtaagttgtctgggtcaagtgctaactcagggtgaaactctagctccttgatatggtcaacctcaagcacactgtctgcttgagtagtgacacgaccttcagccttacacatctgacattcatagttgtcccttgccatcacccagtccctcaactgtcgccactcaactgagttatagaacgctgcacgatgagcatgtgtatctgttttgatatccgtgtgaccactctcctaactgcgtaacaaaaccgccatagaattaactatgacggctcttgataaattactatgctattaagataacatgctcattgcaataaaaacattcagtccgttagtgtacataaatcgaacattactttccaattttcctattataagaaaatttaatagctatcattaatgatttcatactgtcggtcagattatccgataattcatgaactttattaatatccttcccttggtttccagacggcttaaaaatccttaatttgtttacattttcatttaggttgtccaactcacttttccattcttcatcaccagacaacaaagccaacacagttctgttatacttatcaattccgtttttatttactttatcaatatcctgtaatagctttttcacatcaacactttttccatgtgagtctttatcatcacaatcataaagcagtattgaaacgtgtgtgtacatttcaccaatagttcgaattaattcatttatggtactgagcccaattaataaaatttgattatcaaaatctatttttgcttgcctattaatttgcattttcgtatttatccacgcaaataatgccgcacccattacgccgactatggatcctaaataaccgccccaaaaatttaaccagtcactattatttcctactttcgatggcattccttgtataccaaagcggagaaagagtggcaccaataatacagcagaggcaatcattgcagttacagtttcaataacatttttccccaaagtaattcgttttatcccgaaagtaaggcatactgcatagataataactaaaatcatgataaaagctaacatatttttcctcccaataaaaatagacgtaccataatagtacgtctactcaacaactgtgtcagcgaatttatcaataaaatcaagcctgcggtgtaattcagcatgtttttgtcgaacatagctggtcgaatagttcaactcctcagcaatattttcgagcgtctccccctcaatgtacttcttgcgtaatatctgttcctcgataccatcgaagcaatcgactaactctttcaagtccttagcagcctgttcacgccatttaagttcagcgtgtagtcgatctaattcggctgataacttcgctggtctcgaattcttacccataacgtgcatatttgccagatcaccatttgtccaccggcttgcttcaattcccgttttatttatattccatttgagatagctaatgtcctgtttaagttgcaaatagtcgttcaaccactcatatcttgatccgtttaacgccatcactatcgccatcccctatgatataattagtcttgtgagaactatagagatgacgtccatttatgggcgtcttttttcgtgccatcatataaacagcacagccagcttcggaaatttaaacaccagcagatacaatacatatacgattgccatcaggccaacgaatgctagtgtgcctgtaatagcgtgtttaaacttcaacagtcttcacccacccgatcattcaaatagttatcaaacatcttttcgatatctttatttgcctgtttaagttccgcaaaattcgtaatacttttatcaccagtccgaagcatgttccgacgaatcccattcaaagcgtgctttagattgggatagtgtccaaccgacagacctatcttagttggcttacctgttttggggttgcaagtatccttcattacttccagttcatatttgttactcgcaatatgataatcaccaattttcatatcaatcatttggctcacctcgttttcttgtataacaaccacaatagtaaaatatataaagcaaccattactaaaccgcaggctacaacaccagttaaaatttgagtccaagacgcattccacaacatttcaaaaatttgtttcattcgtctacctccaacaattctggattttcgtgaatgttgccgataatctctggaatcatatcgtcccaaacataattccggaatccacctgtccaaacacagaagccaccattgaaaaacataacttttccggtgtaatcagtgccttgataatcattttcacagtgaacaatatccccttcaaaaatcttattgccattaacatctttcaatccggtgtactgctcaactacgtatttatcagggctcatttcagcgaaatttaaaattgttcctgccctaccatatttcatagtttgcccgaaatttgaatctttaaatggcgtataccacgctctaaattctggtgtcattcgtcatcaccctcacgatctacaaatatctctgcgatggcattaaccactcgatcgttatacgcaagatcgttataaccgtagtgtgctaattcccatttaatatcatttttagtcattcatcgccacctagctttctgccacacattgggcaatatatgatcgtcacgttgtcttcataaaattctgaatccatcatccttaatgacaccttttttgaattgaatacaatagtcgcctcaacattctcatttgaaatttctttaaatggtttgtggcaatacgggcaattagcctgtttttcttctaattctgtcattcgtctacctccacccattcatatcttttatcccagtgctgtatctcccacactaacttggcccactcactgaacttagtcatcatgaaacttcaaatccttgattcgctcattgaggtaatattcataatcctccatggcgtttaactgcataccgagaaatgtacattgctcgtctgagactgacgttacctggccaaccgtatggtattcattcgccaccctgttatagaattttttcaatctttcaatttttacaatcaattcggaactctcagtttctagttctttaattacttgtttatttggtttcattcttcaacctccgctacctcgtaaccatctagccatgcgcgagcgaactcatcactgtgagctcgaatccaatcgctttctttgcatgaggcttggtcccagtcaagagcaccatagattgcaccataaatattaatttcgccttgatcaagatctgtttcaccgcgcttaacttcctcaatatagtttgctacgcactctggaatcacaggcaatttcttatacgtcttcttgaaaatctcgtccttaaccagccactgtccacctccagctcctgttgcaatccaatcgccaatgtgacattccagttcgccttccaatgtcttgatgaaataacggcctcttggtaccagttcatccagcacggcttcactaagatcatctgccgattcgattcgaattccatacttttcaaacgttttctgccaaccgtcaagttgttcaaactcggttgttcctgttttgatgtatttagtcattgtcgtcctctagcaagtcagcctggccgtctgcttctttgtttgcactgtcaacatcgagttctatttgtagcggtgtaatcttaattccgataatgctatcgagtgatcgtgttaactcatcaaaacggccatctagcaattcagtgtcaacttcaaagtttacttttgtgacaccctgtttagttggatgaacatccgttaagacggctcgaacttcaatgctgttatctttaatttcatctgtcattttaaaaatctcactttcgtttatactcgggtaacaaaagtaacagaaattacccaaattcctatatatactattaatatatatttaagtatattaatgttacctgttaccaatgttcctcaaacccgttactggcaagggcttaactaggtaacattttttctagcggtaacattttatttttgttaccacttttgagtaacactttttttctgttaccgtaacttattacttgttacctattctttaacgtacgatctaacaggtttcccggctattttcactagttttttaatgaacccttcacgcgtcatgaccgttacaatattcttcttcaatgttttaccatcgcattcaatctgattactgtagcagtatagttcaacattattggtgaattgcgatactggtatgcggtcttgtccgacatattctgtgtccttaacgtgcataatcgcatcatcaatttcagaattgacgttcaagttgctgttgatttgctcaaagtcatgctgatacatcgctttgttaattcgatcgatgtcggcatcattcttgacgtagtatgctttcgcctcacccaacacattctcataccagctatctggcaattcaaaggctcgttgcttgatctctcccttgttaacgattagtggaatgattcgcctattgccacccatatcagtcagatattcatagtcatttgtggtcctcgcaatgacgaaatgtcgtgacttaattaatggattacgtccataagctggccgataggtgaactcacttgtagaaacaaactttttaaacgctttttctcggctaatttcagtgacttgcatttcatcatcattaattaacaaattttttagcatgacttcgaaactgtccttgcttgtatagctcataaattgatcagtgtaataatcttgaccaagccgtttcagaaacgtcgtcttgccggttccttgttggccaataatgtcgagtgagtattgaaacttacctgttgcgacactgtaagcaccggcgaccaagttaacaatccaaattcctactgcctgattaatatgctcgtcatcgttgccaaacacgtttttagcaatcgaccatagtcggggcttgccatcccattcttttgattcaatccagtcatatgctgatgagtacgtgttctgtgtactagccattgctatagcttcgttaacttttgagttggttaacgcaacgtcatacttgcgttccagaaatgtttgaatcaggatggccttgttgtctgtcatccggccatggtcaatcatgacctcttcttttgaaaaatcagatttaatattaatttcattaataaactcgtcatagcggacgtccaaattgtcattgatcatttccgcaattacggttgtttttttagcgcccaccttcccacttcctccatgctgtttctattgttcgatctacttcgtattgtggcagtccgcttttttcgtttgcgatatcaactactgcttgcgtttgtttgtcattgaaccccattgtgaatagcgtccaaactagcaaactcatgttattgttgcgtgccccaggttgaccgaaaccttctgtgatcattgccaattcgggaattgtctgcgtagtcattgtgttgctggatactgccacttgcgcattggtcttattagcttcataaaacgcccataaatcttgtggtagttcgacagcctcggataaatcagtgtctgggttaactacaacgaaattattcttactagccttaatatctaatccattcacgatcccaatagcttgcgtaatatattcggtgttttcaaagtaaacatgaactcctcgtcccgacaccgactgctcgatgacaccggactcaatatctggattatcgattttaaatcggtcaaacacgtccatactgtcgaagtcgaacaccacatagtcctcaccacttaataccaagccgatttcatacgtccttttccagttcgataaaatccaacgtctgtcagtcttatcagtcgcgtaagctctaaacggttgcttcgaggcatggtgttcgcgatcataggtgactcgtattggagtaatatcatagccttcgtcaatccatctaagcgcttcgcttttgattgccattgctagaaggcgttaacttttaagaatgtgtattcagggaaaggctgtgtgccatcactttttttggctggcgtgctcttttcaactttaacattgagtttatcgaccaaaatttgtaaggcttcaacgaccgcttcattccctcgccgaatagcatcaagactaagcgcggccttgtaatttttatccgataagattaaaggctgcataagctggaatacgtttcgttgccacattttttcgggtaatttacttccgtcagtcttttttcgactgaccgaaattcggaatccgttgtcggtattgccatcagcgtctgtaaattcaaactgcactgcagtccatgctgaactttgactttcatataatgatacatccgtaagctttgcttctgtgatgccgtcatcaaaaccaaacgcttggggttcctctgtgttttcgtctaactggtcaaaccattcatccatatttttcattttcattctcctaatctaatccaagttcttttaatttttcgttacgtgccttgagtgggtcgagcactgcatcaagtggctttttgagctctttttcgtcccagtcatagcgcttcttcatccatttggcttcatgcttgttattaatctcaatcaagccatcagaatagccaccgatgatatcaaattgtttgtcctttaatacaacgctcaaaccatcatcagtcatcctagctcgcatgaggtagtatacgttcagtcctgattgcgacagtgctctgactatgctagtaaatgccttgctgaattccgaatacccggcaccatagccaccgttggcatcctttagactgttggccttgtacttcgaaataatctcgtcttcaagtaattgagccatgtcttcgactgtatcgatcacgattgtttcatagccaaactcggcagcattatcgatgatgttaattacatcgtcgtacttctctggcacctcaccgttgtaacccgcttcctttgcgtttcggtcaaacgaaatgaaatacggcttacttgccttacctgccaacgtggtcttaccagccataggctcgccatatactgccaaccgcttagggagcggcttttttaaaatcggttctttaaatcttgtcattttgattgccatcaatcacacctccaaagtgtttgaatgcccaaatgctaccgtcgttaaccgccttagcacattccttacctcgatcgattactttcactgcatcgctaatgaacccgctaatggttacccatccgtcatataaatctcgttcggttaattgatagtcatagataaatggcgtgtccttatttttttgaatatacaaaatgtgggcatccgtcttgttaaacatgtgagcgtagaacgcaacctgacacacgtagttcacttcacgatggtctcgaaacgatccatattccagaaaaccttgaaagtcatttgaagcaaccgtcttaaaatcgtaaacggcattttccgtgagcatatccgctcgaccagtgacattgaactgaacctcacgttcgtccactagaatcgaattagcttcttcaagtgggatttcgaactggatattatctgcaatattcgaaacaaaagatcgtaagtggataccaacaatttcagcctctttaaagctacttttaagttgtcccttagtctttcctctggatgacactagaagctccctatcgccatctgagagcccttcaaacatatctctaccttcagcaatgttgtgaacgattgtgccatacaataaggcggtgtcgtcgccttcaaaccattttgactcaccagtataatcttccaaggcgcgcagtggatttcgtgcaaatttgaatgcccgtgtgggactcatgtgtatttttgcttcgttttgtactgtcatatttaatcctcaaacatttctgcattgaaatttgttttctcatccaatgccattttgatgttatcgtcgattgtgccatgaacgattaggtagtcccgagtaatcttactagcctgtccaattcgatagttgcgatattttgattgatcgaagtcaatgaaactatctggtaacgaccaccaaacggcgtgcttaaaatcatttaatgtaagtcccgaaccacttgaaatttgaatcagtacgaagtctcctttgggattaaattcatcaccgttcacgtgaccaaccctgtacttcttcaatgcttcatctagcaatgctcgctcggtgttaaacgtgtagaagataatcgttttgtcttcgccgtattcttctgccaccccatctaaccattcaagtttggccttgttattttggttctggcgttggtaaattcgacgctcaatatgattatcaaaaatgatcttgtcatcttttttgtaagacatccgtgtcttgcgataattactatcggcgttgaactcgatcaaccgttcataaatcggtggtagctccgtaatatcatccaatgtcaccacatcactcgtaatcgacttgaaccacgctgttaacttgtcggtttgcttgccaacatgccagattgggtacttgctccagtatggtgtttcagcaaccttgtataggtctttaaattgtttgtgtgtagcaacatggcggaaatacaaggcgtacatctctaggtcatcgaatttaccattggttggtgttcccgataaaaagatgaaccctttggccgtgcttaatactttttgtaatttctgtgatcgtgctgatttatttttgaacttgtgcgcttcatccacgatgataaacttgccgtaaatctcggatgatgttagtttcttcacgccatcagttgtgacaaccttcatgccgtttttaaagccaaccaagttagcatccttttcccaactcttcgccttgacgacttgccgaggtgcaaccacgattacatcttgattcggaaaccatttcattgcatggcataagcccataactgttttacccgttcccattttcatgacgtagtaataaatgctttttgacttagcaagttgtgccgcttgggctttgtataatttaaattctgtcgtagttccacacctccaagaatctctcccaactgtcgattacaaaccaagcgccaccattgcggatgatctttcgaccgtttgttttttgttcggggctgacaacgcccttgccatcaggtcgcttaatttctagtccaataaattgaccggtgggcataatcgtaattacgtcaggggttccgattggagtacctggtgagccgccttgcgtcttaacgacgaaccgattctcgctgcgcaaatacgaaatgatcctagcttgcaatttagcttctgatttcattcgacgtcatcaccttcaacaatttctacgtacttcaaaccatgtttaattagccggacagtgattctgctcattgatactccggattgtttactaatctctttaaccatggcatgcacatcggccggtagaaagattggtttcaaaccctctttagtcgtgtactctttttcgatgatgatttttggctcttccatttgcctacctcttttctggattaaattccgtgttgcattctttagctccgagttgttctaagacctgttctgcaccgcaaacatgaatgtagtggctcaaaaacattaaagcgtcgaaactcttgtagttttcgtgatccagagtgaaatatgattcgtcactataaatcggttgtcctctgaaatccgaggtaatagcggttggttctggatcaatttgcggattctctgaattcaagtcatcctgttgttcagtagtagcgtcccagttaatatcctgattcatagctccaccccattaaacggttgaactcggccgtcatcttttcacgattcttgaacgcttgagcacaattcttgtactccattgattcaggatcactgctaacccacaacgtgtcagttaataggtggtcatgtgcgtaaatgcgccgcttcatttcacgtgctttaactaattccattgctctattttcctttccgtgttaaattgaatgcgtaaaatattttcttgattagccgatatggggtgcgacccgtatcggtctttttgtataaacaattagttgtgattaaatagttattttttgtgatcgttgttgtaaactccttatgagataattattttaaaaattgaaagtgagatgctatctttgcaaaaacaaattaaaatatcattcacaaatatttcttcagctacatttgattttcaaataccaaacttttgtcctaactgtggtaaaacagtggcgccaattgttgaacattcaacaacttctaatagttcaaatgatacagattttttggttggtttattacttaggtgttccgatgaaaaatgtaatcaatattttgaacttgagtatcatggaacacgctcattacttcaaaacgggaatcatgcgcatcgcattgatgatcaccctgtaaaacaaaacactattccaccagttgacgacaattttccagcagaagtttccgaagtatctcccatattcaaaaagacttatgatcaagctctcatggccgagaacataggcttagaccaaattgcaggtgttggatatcgcaaggctgttgagtttctcgttaaagattatctaatctccgtaaaaaacaaacctgctgataaaataaagaaagacttcttaatgcccgcaatcaacgaaatcgactaccagccgattcatgatcttgcgacagctgccacgtggattgggaatgatgaaacacattacgttcgaacatgggaagatcaagatatcgaagatatgaaagctttcattcgttcatgtgtattcttcatctcatctgatttaagtgttattaaatctcaggaaatgattgcaaaagtaaaagcggaaaaagaagctaagaagaagcagtcaaactcttaatgtaatcaagcaataggacattcgtttctattgctttttttgcggcctcttctgcaattttgagtcttaatttaagttgcttaatctccttatcctgctctgtgttaatcaaacagatcacccttacttgcgtgccaacctagaaatccaccaatcaaaccaactacgattacaaatccaatctgtgatactgccatgcttgtcagatcctttgctatataaattttgtactcgatatttccctcttgccttagcttggattttaggtttagttgtacagctgattttcagatatccatttatcaactgcttttaaggaatatcggtatttttctgagtcaccaagtaacattcttgggaaccccggtgttgttacaatctgatcgatttttgtgggtgagcaatgaaacttctttttctgtaagtaagacttagtcacaatatcgtcatcgttcagatggtcatcaatcaggggctgcatcatttcaaaaagttttagagttagattcttcagtaatggttgacttgtttcatcatcgaattgaatattgaacgtttaaatcaccctctttcttattttcctaaagacgactgtacgtgcttgcgatatacttatttcacttataggaaagtgaggtgaaacgtgatgaggtttactggtgccgttgttaaggagcaaggtgtcacattttcaattattcaggtcaaaagtggttcgttgacacagaataatttgcaaaatgcgcagagacaggctcctaaaaattttcctagaccaattattttggccgagcaaacaactactggatttagatatttagggaaacccgatattgttaattttttaggtagtatttactcggagcaaattccttggagagattacaccgcttagcttctttagattgattggttttccatacgacttattcgaatgtgccagcattcgcttgagtcgtttatttttttgtcgacgattcaattactgcacctcccttctctggctctcacttctggtaggagcttttttgattttcagataattcaccattcttactttgctatacgtgtgtacacgtataatgaaagtgaggtgaaaatagtatgaatccagaagatcttgaaaagatcatcggcgaagttaatgagaatatatacaaatccgatttaactccagaaaagattgaagaacgtgtcaaagattatgaagacgagaatggacaagttgagataacgaaaatgctcagatttgtgatgcaagaatctcatgactacaccagtatctttgcacacgatcttatcttgcacctcgccgacgagggctatttagttgatccaaaaaagaatcagtaaccaacgtgttaccgtatagtaccgcctttaacgcttcgtgttcctcgctaccgcaaatagcttggagcacgttttttagttcgtctggtgtaccttcaattgttagtttcatttatttcacctccttagttttgtaatttattattttggcagcgttgcattgaactgcatttcacgtacaacttttactgacaaactttgccatagtgattgagttaaaccatattcagttgcaatggcaaccagcttattttttactacttcttcttgctcaatagtgattaatttttttgaattcatttctgtcttttctttctttattgaaactgtttactttagtggtatattgaaattattaatatcaaatggaggattaataattgggtacaaaaatgaaacaaaagatttgtctaaacggacaccaaatttctagtggtgttgaaccaaatatcattacaaatgaattttgtgaaaaatgtggggagaaagtgattagtacttgcccaaaatgcaaaacagatatttttggttatgataaagataatgaactttatgcaattactggtggagttaaggttccacaatactgtaaacaatgtggtgctccatatccgtggactgaagctgcccttaaatctgcacgagctttaattaaactatctgatctagaccaaaaagaaaaagaagattttaatgatgttgttcctgatttgatatcagatactcctaaaacaaaagttgctgcagtgaaggctaatcgttacttagccaaaactggggcttttattggtaatgcccttaaagacctcttggttgatattgcctccgaaacagctgtcaaagctatgcatctttgaccagcgaagccccacacctttcacaataattaccaggatttgtcatctgcttgcaattcgggcatttaattagtcccaattttcgaagctgatgattataaaacacgtctggtactgggattcttaaatgaataagaatgtacttcatttttattgttccttcctttcgttgaaaccgtttactttagtggtatacttggaatagttcatttatattggaggtgaaaaaatatgaatttaaaacaagcttcactgttcgaatatggtgttaatatgcttttgaaccaaatcgaaacagaaacttcaaaaaagtgtgtatggtttgctgaccaagaacgtttcatagcagatttctatgaacatgatccatttaaagatgatggaaaaatgatttcatttcgtgaacaatttgttaataatcttgtcaaaaatgatggttttggcgataaagcaagagccctatataatgatttgccaacttttatgaaacagcttaattcgtttatatcaaaattaaatgaatctgaatttgttgatgttccaatattaaaaaacgtcgactttattgataacgactcacaaccatttggtttttacattttcccagaatgtattggcttttctgctgtctctatcatttctcccgaaattgtggaaaaaaattaacgatatggtctaaagtatgttgaagctcagcagcttgttgctgggctttttcaatttcattttctagtacgtctccgttttctaaaacaagagataaacctggatttttgctttctaaggtttccttattaagtgttttaataccggttaatatttcatcttttttcattttgattttttccttctttaatttttattaatcaagttgttaggccgttgcttgctggtctaatccgtcatagattgccttgctcaccgataaatttagatgatacttatcctgtaaagccatcaggctaactgtgtcttctaaaattggctcacgttccgttaacatttgcggtgtcatttcacttttcttgaccatctttggatagccgaatttagttgataccgccttgttagcaatcgtattagccttcatgaagtccatttggactgggtgtgataatgattggcaaagttgattcatcgttttacgctgatgttccttatcaagcgttcggaaaatatcaaagccttgtaagcctgattgctcacgcaactgtttgatgacgctgaatacccattcttgaaattcttctgcctcttttttatggcttccaaagatcgctttgtaaattccgaattctgtcaaaacaagtgatttacgtccctgaccctggacttgcaaattgacagtccagatatatttttctggaattcgtttagtcatttgctttgtatctgagtaatccagtgcatcggaaacatctttagcaactgcaacccattcgttattaacttcaacaaatcggattgaatgtccattccatagttctgttttcatttttaagcctccttatcgcttttgtacggtttaaccgtaacggacggcaaaaaattaatttcgttatagctaacatcaaacacatcttcgattttttgaataacaggaacgtttggaaaggtcttgctattctcataattacgccatgtatcttcgctaacaccaattaactttcccgcttgttcttgatccaaaccactatttacgcggatagcttttaaagtcatcttcattgcttggcctcctttcgtaaataactatattacggttaaaccgttattacaagacttttttactttaaaaccgtatttttttaatttaatccttgatttatttacggtttagacgtatatttatctcataattcttctactaaaggagcgcaaaaaatgagcagtcttggaaacaaagaaataatggctaaaaatattcagagatatatggattctcgcggcattgatcgtaaaaggctatccgaagatttagatgtcagctacacgactttgaccgactggatcaagggaaagacttatcctcgcattgataaaattgaactgatggctagatacttcagaatctcaaaaagtgatttggttgaagaaccagatcaaaataataacgaagctgcccagacaattgctgctcatattgatgacgacacacccgatgatgagcgtgaacaaattattaatttcattgaaaacttaaaacgagcacgctctaaggatgatgattaatttatgtacaggtatgagcaattagctgaaacacggccttatttaaagattgaatatgtagtaccaccatcgcaccatatgggtggcttgcttatcgatgattttatttatttagatcgccatcaatcaaattgtgaaatgaaccaatggctgcaagaagaattcgcacactatgattacacggttggtgatatttcaaagcaggaaactttagatgaccgcaaacaagagaagctagctcgttcgcgtgctatggaacgaactgtaacgctagatggattgattgactgctttggtaaagaactgtggacacccgaagagattgctgattactttgacgtgacaattgagtatttatttaccgcattacaaaactataaggataaacgtggggtcatcttcaaacatagggcttattatttcgacctaagacgtaatgtgaatataactcggatagaataaaagtattgtccctacgcaaatgacattaaactgggtgaaaactaaatcttgggggatttattatgaaaaagatagcaacgcttggaatcgttgcagttgctggctttagtttagcagcatgtggtaattccgaagcttcaaaaagttcatcgaaatcatcaccggctaaaattgccaagcctactccaaaaaagataaacaaaaatatgtcaaaagttggtgtcgcacaatacaaaatcaactctgtactttctgaaaagatcacaaataaagaatcaaactataccgatgctgaaaataatctaagtgatttaaaacaattgaatcactcatattatcgagtaaccattaattatcaactaaaaaacactggggataaaccacttgatatgtcctatcaaaatacatcagtgatcgatgataatggtcaagattacaccatggaaggaaatagtggtggtttttgtttagatgaaggtgctggtggcagttctatacaaccaggttcttcaacttcaagttcatttattctcatttcaaatcacaagatacctgcaaacgacttcaaattaaatgtcggtgaccaagtggatcatgatggcaacacaattgccaccggcggaactgcaacatttcaatagatttatgtccactcacaaatgacgacaaacttaatattacgtccaagcgtgatcgacgctaaaagctgaaagaaaggatattgctagatatgttaaaagaattcaaagattttattgcaagaggaaatgtaatggatttagctgttggggtcataattggtgcggctttcaccgctattgtaaaatcccttgtcgccaatattattaatccatttattggattgttcctaggaaagatagatttttctgaattaattttttctgtaggaaacgctcattttaaatatggcttatttatcaattcaataattaacttcttgattattgcactcgttgtatttttaatggttaaaatgatcaataaacttatggtaaaaaaagaggaagaagtagtagaagcaacaccaacagccgaagaagcttatttaaaagaaattgtagaattattaaaacataacgataattctgacactagtgcaaaaagttagtactaaatgaaaaagcagtttctctctcgtcaagaagttggaaaatattcagattatactcaaactaatactcaatttttttgctaaggaataaattatcttgattaagcatttaatttaagaaggtatgcctagtggaaattgaaatttttttactagttgtaatcattttaataatcatatgcctgtttataaaataataaaaagccatatcccctcctgattggatatggctgtacatagaagtgaatcataagtaaacatattactaaactcgaaaggaagtgaatcaaatggctaaggaaaaattaaccttacaagggcaaatagaccatatgtctgaaaaagaaattgaatttaacataatgtccgttgctgatgcaaaacatatgttatcgaaggttaattactattttaaagttacgtcgtaccgctcaaattttgtaaaagactccaaaggaaaatatcaaaatttagattttgcgtacttaactgatctagcatcaatcgatatgcaacttcgagattatctatttgatttatcgcttgacatagaacatgggataaaagttaccctactagatttaatttcgaatgatgagaatgaggatggatactccattgttcaagattttaaaagtagccacgaaacacaatacacacaaactatgaattatcttcaaagaaatcggtatttgagtgatatgtatgctaagcatcatgacaatccagctatttgggtgtttttagaagttatgactttcggtaccttatccatgtttgtagatttttatttaaatcgaactaatacacgtagagtccgaaaaattcataactatttgaaatacagtaaaaacatccgcaacgcctgtgctcacagcaacccccttctagttaatttattttcaaatcgtgaatttttacgtagaccttccgctccagtaaaaactgcagcaagtcagatgggcgttcaagataattacttgcaggacataaagataaatgatttggtctcgcttttttacctccatagggacatgcaaagtgagaaaatgagtgaacacagatgtaggcaaggaaaacgtctgataaacagattccataggcatgaagaatggtacgcagcaaatgtacagttaaacacatatttttcgattttaaacaaactgattgactatttaagcatggactagtagtattctatgtaaggaaaaaacggttcgaccgtttgctaaccgaggttatgccaaccgttagttattaaatgggtaatcagtgtaaaaagctggttacccatttttcgttttataaaaaaagccatatcccctaaactttggccggcttaaggatatggctaaacgagaaaatcacacacatagtgcgcttttttacatacataattttaccataaatcatgaaaggtggtggtgctaaatttcattcttgccttagcttggataactaaaaaaacaaaggatgaaataaaatgaaaaatttaaatgaaacaaaattgaagtcagacactcggatttttaagtatgacactaaaagtggcgccaaacgctataaagccaaatttagtcgcactatctttggtaaacccatcggctttgagaaacaaggattcaagagccttgctgaagcaaaacagtggtctgatgaagcagtacgtaatgctaatctcaccaaaggaaccgctaaagatttaaccgttgaggaatactatcagcgttggactaatcgtcatatcgacgaatgggaacctgatacctataaagactacgcgggaatttttaaacgtcatattctcccccgctatggcaacacaaaactaaacgatatcaatcgagatgaatttcaatcttacctcaacagtctccatactatcgaacggccattcagccgcggtgtaaaagttggttatgcttctaaaaccattggtacgatcaagcgtaatttaagcaccatgctgaacgaagcggtatccgatgagctgattcctttaaatcgaattgcgcgttgtcgagttaaagatacggataaacataaacgtaacgtgcagattagtgaacagcagtacgctgatgcgcttaaagcggccgatgaggtactttcaccaatgcacctagccgaatactacctaagcctgttagcgttgcgacacggcgaaatattaggcctcaggccacagtctattttcttagaccacgttcacttggatttagcccgaactgctgcagcacccgaaggaacaaccttgaagaatcaacggtcatatcgtgatgttcctatcacaccaaaagtacatcaaattcttcaagctggtattgaggagtcccgccagatttatatggagtgtggcaaacaacttaaaaaagattcatttatttttgtgaatcgtgatgcacaaccccaaggaataacgacaatgaaccattactttgatctggtatctgataagatagggttccatgtttaccctcacatgatgcgccacgcatttgcaacgttcaatttaccaaccgctgctgatccagtcgatgtgcagaacattatgggtcattctagttttgatatgactcaatattatgatacaggttctaaaaagcgtgaaaaaacagtcattgatgattttgccgcttttcaataaaaatatgcacaaaaaaatccctaaccccttgagtgacaaaggattagagaagttcccgaatttgacctctataaaacataagattcccgaatttctcccgaatgatatagaaaattagagaaactttctaaaaagtgaattttcaagaatgctgatatagcggctttaaaccgttctatcatttcctaatttcacttcaaaaaatagtaacgtgtcagctccaaagcagactgctccattaccaacttgccgtgttcattcaaaacatcaggactaatttctgtcttatgtccgtattcatacgcaattgcaagatcatccttaattgtttcaggcgttgttgaatcgacaaagaaaatgacctcaagataataggcttctcgataacggtacaaatttgtcaccgcattttcaagttttaaaacacgtgcgacctgtaccatactctcaaaatcattgagttgaataaccgttgtgctcttttcaagactttggtcatttaacgcatcgtcaacaccgtcattttcaaccgttgttttccgtttatcctcggcatctgtctgttctaactgacgctttaaaaattctgaaatatcatcttgatgaatagcatcctcatcttcactactttgttcatcatcatcaattccatttttgctaatgaataattctaacccatttctatttggcaacacttgaaatgtcacagaatcattatcttggaactgatgttctgtatccacttcctctaaaatactgtaaaagaagctttctatttgctgatgattgcctaataaatccaatacggtaattccacgcgcacttaaatcatcatttccaattaaaacacgaatcgtattttcattgattctttccatttccactattcaagcgccccctttcaatccacatttattgtatattctaactgtttttgacaaaaagtaaagattcttgctgacaaaaaacacctgatacacttaatagtagtatcaggcgtttctctcctacatcatgtttgcttttctgcgtgccttagctaactctaacgcacgaacctcacggggcaagaaacgacgaatttcatcttcgttgtatcccacttgaatccgcttatcatcaatgataattggtcttctcaataagccggggttcttttgaattaaattgtacagactcttcataggaagatcgtctaaatcaacgtgaagtttttgaaatgcttttgaacgtttcgaaataatttcctctgtcccattttcagtcattcgaaggatcattttaatttcatccatcgtcaaaggctcagaaaaaatattacgttcagtgtaaggaatattatgttcttgcaaccaagcacgagctttgcgacaagatgtgcaacttggagatgtataaagtgtaaccatagtaattgcctccttgaaacatcatgataagtcatgaagtaattcccttgtgtgattacattatacaccaatcagccaaagattaatagactattattagttaaataaaaataaaggtcaaacttttttatatactatttttacaaataagtctaatacatatcatgttattcactattccatgcattatgcatctatgagtcagttgttcgcaattcttttaaaaataatgcttataaaaagattttatttatgaatttttcttgaagattttactatgattgccaataagttatagaatgattgataagttggtctgtgcacactgaaccgttatgtcatctttaatgacttctcgcgcctttttttccaactcactggctgccacattctgtggcagatgtgacatcaataaccgttttacatgggcttcattaacaatcttgccggtttctggaaccgtcaaatgccacttactacctttaggctcactcaaaaagtttgtatccgaaatcatcaaatctgtatcttgaacaaattttactaattcagaaaaataacgggtatctgctgtaaacacaaaatttttacccgaatttttttcaactattcgcattgcaaatgcatcaactggatgttgaacgggtaaaaatgtgatccgaaacggacctaaatctagtggttggttagtttcatatggcattgcctgagttgaatttggccaatttaaccgcttaaaattaaccatatctagcgtgtgtccgtaaatgggaagaagtggttcctttttgattcctgggtttaattgccaataatgttgtaacacccctacatcagcaatatgatccgcatgataatgcgatagaataacagcatctagttgtaagggatctaacaccttctctagttgaataagcgccccgctaccgcaatctaagagcaaattaaagtcatcactctgaactaaatatgatgatgttgcttgtccattatatggatagccaccgtaaaaaccaataacagtaattttcatttattaagcctccattttgatctaattcgatggtatcattttcattcaaaagttaaaacacctataatggaagtagaaaccaaaggaggttggtcaatatgctaaaaacaataagtgccactttcgggagcaaaaaagtattagaaacggtcattaaacgccatcctgaaagacagtttaaactgttgcagtccaattctactcaacaacaacttcaattgttagacctatctgataaaccaacaatttttcagtcttctgttgaataccgtgtgcttggacattgtggtagtaacgaattcagaggcctttcaaactttgaattttttaaacttgaattagatgatcaaaaaatgctgcggtcagcagttaacaacagtttattaaataatccacccaaaaacttaattgcggcctatcttttagaaaataaatttgaatctaacgaacttattattttaaccatgtggccgacattaaaagactttaatgattggaagcatggacctgattataagttcttagaaagctttaacagcagtcaagaccggtattaccagcgaacttaccagccagcttaagtttaacaagttaattctaataaaaagaggaagttatgataaaagcactatcataacttcctcttttgttgtttgttacggtccgtacgagactcgaactcgtgatctcctgcgtgacaggcaggcgtcctaaccag

SEQ ID NO: 427 - DNA, 15686 bp, Unknown
  Metagenome-assembled genome
tctctcaaacccggctacccatcatagccttggtgggccgtgccccgccaactagctaaaaggccgcgggccatcctcgccgtctggctttcccgccctccccatgcgggggaggcggagtatccggtatcatccacggtttcccgaggtgccggtgcgaggggcaggttgcccaggttactcagcgtcgccatattatcccacccttctaccttcgacttgcatgtgtaggcgcgccgcagcgttcatcctgagccaggatcgaactctccgttcagatatgtccatgccctgaggcatgcactatcggatgtatggagcctccgtccgctttccagttctcgccgatctggtcatgtctctcaaagaattgaatcgacggatgctgtcttgtcgatagcatcgctcacgtctgtcttccgatcttcgatcgcagtatccggttttcaaggttcgcgcgcctgtctgcgtcccgctcggtgcggggtgcctcagcgcgagaagaaaatttacacggctccgctcccctgccatggggaaagtggggcttcacagaatgttcacaaatggtgaaaggacgcccggtgcacctggcatcgcgccctttgaatggcttgcatcctcatcggagcttgaatggcttcatttcctgctgtttctctgctccgtggtcaggaattcctggaacaagatggattatatccagaggcgccgacaggcttcattcccctcggcaaacgtaacagcgccgcaaaacgcggacccttagacttgaacatcaggcaatgcactttccggagggcaggctatggataccatcttctccttcacgctccgcggcacgaagacagccaacgaagatgtcttcggcagggcaggcagctatgcctggatgatcgacggcgcgaacgatgtcttcccgaccgcccatttcgcatcaagcgacagccagttccttgcacgtcttgtctccttcgagctcgcaacccatgcagatgaattcccggcccttccggaagacgatcctgtctcccttatgaaaggccctctccttctggcgagctggccgcaaagcttgaccccactattgaggaagtcccagcctatacactcccctcctttgctttcatgctcgtacaggacagattacgcccgctcgcgaagcaggcagctcggcgggccatctttcataagggagacaaggatcgtcttccggaagggccgggaattatctgcacatgggttgcgactgctcgaaggagacaagacgtgcaaggaactgctgtttcgcttgagcgaaatggcggtagggggaaggacatcggtcggcgccgtcgatatccagcccatagctgcctgcccgccgaagccctgccgaagacatcttcgttggctgtcttcgtgccgcggagcgtgaaggagaagatggtatccatagcctgccctccggaaagtgcattgcctgatggttcaagtcaaggggtccgcgttttgcggcgctgttacgtttgccgaggggatgaaagcctgtcggcgcctctggatatatccatcttgttccaggaattcctggaccacggagcagagaaacagcaggaaatgaagccattcaagctccgatgaggatgcaagccattcaaagggcgcgatgccaggtgcaccgggcgtcctttcaccatttgtgacattctgtgaagccccactttcccgcattgcagggggcggagccgtgtaaagtttcttctcgcgctgaggcacccgcaccggcgggacgcagtacagcgcggcgaaccttgaaaaccggatactgcgatcgaagagatcggaagacagacgtgagcgatgctatcgacaagacagcatccgtcgattcaattctttgagagacatgaatccagatcggcgagaactggaaaagcgggacggaggctccatacactcgataggacatgcctcagggcatggacatatctgaacggagagttcgatcctggctcaggatgaacgctggcggcgcgcctaacacatgcaagtcgaacggttaagccaccttcgggtgggaataaagtggcgaacggctgagtaacacgtgggcaacctgcccctcgcaccgggacagcctcgggaaaccgtggatgataccggatactccgcctcccccgcatggggagggcgggaaagcccagacggcgagggatgggcccgcggcctgttagctagttggcggggcagcggcccaccaaggcgatgatgggtagccgggttgagagaccgaccggccagattgggactgagacacggcccagactcctacgggaggcagcagtggggaatcttgcacaatgggcggaagcctgatgcagcgacgccgcgtgcgggacgaaggccttcgggctgtaaaccgctttcagcagggacgaggcgaaagtgacggtacctgcagaagaagccccggctaactacgtgccagcagccgcggtaatacgtagggggcaagcgttatccggattcattgggcgtaaagcgcgcgtaggcggccagcctggtcgggagtcaaatccgggggctcaacccccgtccgctcccgataccggccggcttgagtctggcaggggaaggcggaattcccggtgtagcggtggaatgcgcagatatcgggaagaacaccggtggcgaaggcggccttctgggccacgactgacgctgaggcgcgaaagctaggggagcgaacaggattagataccctggtagtcctagccgtaaacgatgggcactaggtgtggggggatcgtccctccgtgccgcagccaacgcattaagtgccccgcctggggagtacggccgcaaggctaaaactcaaaggaattgacgggggcccgcacaagcagcggagcatgtggcttaattcgaagcaacgcgaagaaccttaccagggcttgacatccaggtgaagcggcggagacgccgtggccgagaggagcctggacaggtggtgcatggctgtcgtcagctcgtgtcgtgagatgttgggttaagtcccgcaacgagcgcaacccccgtcgcatgttgccagcggtccggccgggcacccatgcgagaccgccggcgtcaagccggaggaaggcggggacgacgtcaagtcatcatgccccttatgtcctgggctgcacacgtgctacaatggccggcacagcgggctgccactgcgcgagcaggagcgaatccccaaagccggccccagttcggactggaggctgcaacccgcctccacgaagccggagttgctagtaatcgcggatcagcacgccgcggtgaatgcgttcccgggccttgtacacaccgcccgtcacaccacccgagtcgtctgcacccgaagtcgccggcccaacccgcaagggagggaggtgccgaaggtgtggagggtaaggggggtgaagtcgtaacaaggtatccgtacgagaacgtgcggatggatcacctcctttctagggagcatatcgctattccagaaagacaatacttacagacgggccttcattgccgccaattccaggcccacgtcccgtctccgatgtccgagagagcagcatccggtcctgagggctcgccctcgcacccgtaccttgagagccgcatagcgcaaaagcaatcaatatctttcttcaatgaaagtcatcagcatctgatcgctagatatgcaacaagcacagcataagacacccgagccatcggaaatgaagatggtaagggcgcacggtggatgccttggcacaggaagccgacgaaggacgcgacaagctgcgataagctgcggcgagaggcacatgctcttggacccgcagatctccgaatgggcgaacccgcgggggaccatccccccgcacctccggcagaacgcatatgccggaaggaggcaacccggagaactgaaacatctcagtacccggaggaagagaaatcaaacgagattcccccagtagcggcgagcgaacggggacgaggccaaaccgcggagcgcactgcgcccgcggggttgaagggcctgcacatatgtccatggatgcacgagcggaacggcatgggaaggccggcgagacagggctagagccccgtacgcgtacatccatccatgggcggcaggttcctgagtaccgccggacacgtgaaacccggtgggaagcaggggggaccaccctccaagcctgaacactctcctgtgaccgatagcggacaagtaccgtgagggaaaggtgaaaagcaccccgggaggggagtgaaacagtacctgaaaccgtgcgcctacaagcagccggagcggacaggatccgtgacggcgtgccttttgtagaatgagccagcgagttgcggtgcgcggcgaggcgaagcaagagagccagccgcagcgacagcgagtccgaacagggcgacacgagtcgcgcgccgcagacgcgaagccaggtgatctatccatgggcaggctgaagcgggggtaagaccccgtggagggccgaacccacttaggttgaaaactgaggggatgacctgtggataggagtgaaaggctaaccaaacctggagatatctcgttctccccgaaatagctttagggctagccccaggcatttaccgctggaggtagagcactgaatggtcgcgggggcctcaccgcctaccaacaccaatcaaactccgaatgccagcggtccagagcctgggagtcagaatatgtgggctaagccgtgtattcgagagggaaacagcccagaccgcccgccaaggtccccaagtccatgccaagtggcaaaggatgtgcgtctgcccagacaaccaggatgttggctcagaagcagccacccattcaaagagtgcgtaacagctcactggtcgagtggacatgcgccgacaatatacggggctaagcatggcaccgaagcggcgggctgcgccacagggcgcagcggtaggggagcatcccgtcaggggcgaagccggaggacgacctccggtggacctgccgggagggagaatgctggcatgagtagcgagagcggcgtgggaaacgccgccgccgcaaacccaaggtttcctgggcaaggctaatcctcccagggtcagtcgggagctaaggcgaggccggaaggcgtagccgatgcacagcaggcagacattcctgcacccccgaaggggcgctattaccgatggggtgacggagaagggcagctcggcggggttctggacgtccccgtgatgccgcgtaggccggaaggcagggaaatccgccttccgcagaggccgaggcggcggacgaagccataaggcgaagcgagtcatcccatgcttccgagaaaagcctctagggagccccgaggggcccgtaccgcagaccgacacaggtgggtgggtagaacataccaaggcgatcgggagaaccatggttaaggaactcggcaaaatcaccccgcaacttcgggagaaggggtgccgcttcgggtgatggggcatgcccccggagcctggagcggccgcagtggaaaggtccaagcgactgtttatcaaaaacacaggactctgctgaagccgcaaggcgacgtatagggtctgacgcctgcccggtgccggaaggtcacgaggagctgtcagcgcgagcgaagcagcgaatccaagccccggtaaacggcggccgtaactataacggtcctaaggtagcgaaattccttgtcgggtaagttccgacctgcacgaaaggcgtaacgatttggacactgtctcgaccatgggcccggcgaaattgcactagtcgtgaagatgcgacttacccgcggaaggacggaaagaccccgtgaacctttactgcagctagacattggctgccggttcgccgtgtagaggataggtgggagacttcgaaccaggggcgccagcctctggggagtcgcccttggaataccaccctcggcgctctggcatcctaacccctcgccgtgatccgggagggggaccgtgtctggtgggtagtttgactggggcggtcgcctcctaaagagtaacggaggcgcgcgcaaggtctgctcgggatggtcggcaaccatcctcatgagtgcaagagcataagcaggcctgactgcgaggcagacaagccgagcagacgggaaaccgggctctagcgatccggcggcacagagtggaatggccgtcgctcaacggataaaaggtactccggggataacaggctgatcttccccaagagtccacatcgacgggaaggtttggcacctcgatgtcggctcatcgcatcctggggctggagcaggtcccaagggtatggctgttcgccattcaaagcggtacgcgagctgggttcagaacgtcgtgagacagttcggtccctatcctccgtgggcgcaggaagactgagggaggctgcccctagtacgagaggaccggggtggacggacctccggtgtgcgggctgtcggccaacggcactgcccggtagctgagtccggtcgggataaccgctgaaagcatctaagcgggaagcccatcccgagatgagtcttccttatggtaaggccccatgcagaccacatggtagataggcagcaggtgcaagcgccgcgaggcgctcagccgagctgcactaatcggccgagctcttcacctccgatgcccggagcgtgaggatgctggacatggagattgccgagcgctgtgcggcccccagggcacggatggacatatgaatgccctgtgccggccagcggccatggcaggggaggcacacctggtcccattccgaacccagaagttaagcccccgagcgccgatggtactgcggagagagtccgtgggagagcaggacgccgctggccagcagagggcattcgtgccggagagggaggggagcgcatccgcgcttccataactcacggtcaaatgggtgctttcgtacaattgtgtagaagatgtgaagccccactttcccgcattgcaggggagcggagccgtgtaaagtttttctcgcgctgaggcaccccgcaccgagcgggacgcagacagcgcggcgaaccttgaaaaccggatactgcatcgaagagatcggaagacagacgtgagcgatgctatcgacaagacgcatccgtcgattcaattctttgagagacatgaatccaatcggcgagaactggaaaagcgggacggaggctccatacactcgataggactgcctcagggcatggacatatctgaacggaagttcgatcctggctcaggatgaacgctggcggcgcgcctaacacatgcaagtcgaacggttaaggcccttcgggcatataaagtggcgaacggctgagtaacacgtgggcaacctgcccctcgcaccggacagcctcggaaaccgtggatgataccggatactccgcctcccccgcatggggagggcgggaaagcccagacggcgagggcccgcggcctgtagctagttggcggggcagcggcccaccaaggcgatgatggtgccgggttgagagaccgaccggccaatgggactgacacggcccagactccacgggaggcagcagtggggaatcttgcaacatgggcgaagcctgatcagcgacgccgcgtgcgggacgaaggccttcgggctgtaaaccgctttcagcaggggacgaggcgaaagtgacggtacctgcagaagaagccccggctaactacgtgccagcagccgcgtaatacgtagggggcaagcgttatccggattcattgggcgtaaagcgcgcgtagcggccagcctggtcgggagtcaaatccgggggctcaacccccgtccgctcccgataccggccggcttgagtctggcaggggaaggcggaatccccggtgtacggtggaatgcgcagatatcgggaagaacaccggtggcgaaggcggccttctgggccacgactgccgctgaggcgcgaaagctaggggagcgaacaggattagataccctggtagtcctagccgtaaacgatgggcactagtgtgggggggatcgtccctccgtgccgcagccaacgcattaagtgccccgcctggggagtacggccgcaagctaaaactcaaaggaattgacggggcccgcacaagcagcggagcatgtggcttaattcgaagcaacgcgaagaaccttaccagggcttgacatccaggtgaagcggcggagacgccgtggccgagaggagcctggacagggtgtgcatggctgtcgtcagctcgtgtcgtagatgttgggttaagtcccgcaacgagcgcaacccccgtcgcatgttgccagcgtggccgggcacccatgcgagaccgccggcgtcaagccggaggaaggcggggacgacgtcaagtcatcatgccccttatgtcctgggctgcacacgtgctacaatggccggcacagcgggctgccactgcgcgagcagagcgaatccccaaagccgccccagttcggactggaggctgcaacccgcctccacgaagccggagttgctagtaatcgcggatcagcacgccgcggtgaatgcgttcccgggccttgtacaccacgcccttcacaccacccgagtcgtctgcaccgaagtcccggcccaacccgcaagggagggaggtgccgaaggtgtggagggtaaggggggtgaagtcgtaacaaggtatccgtacggaacgtgcggatggatcacctcctttctagagcatatcgctattccagaaaagacaatcttacgacgggccttcattgccgccaattccaggcccacgtcccgtctccgatgtccgagagcccatccggtcctgagggctcgccctcgcacccgtaccttgagagccgcatagcgcaaaacaatcaatatctttcttcaatgaaagtcatcagcatctgatcgctagatatgcaacaagcacagcatagacacccgagccatcgatatgaagatggtaagggcgcacggtggatgccttggcacaggaagccgacgaaggacgcgacaagctgcgataagctgcggcgagaggcacatgctcttcgacccgcagatctccgaatgggcgaacccgcgggggctcatcccccgcacctccggcagaacgcatatgccggaagaggcaacccggagactgaaacatctcagtacccggaggaagagaaatcaaacgagattcccccagtagcggcgagcgaacggggacgaggccaaaccgcggagcgcactgcgccccggtttgaagggcctgcacatatgtccatggatgcacgagcggaacggcatgggaaggccggcgagacagggctagagccccgtacgcgtacatccatccatgggcggcaggttcctgagtaccgccggacacgtgaaacccggtggaagcgggggaccaccctccgcctgaacactctcctgtgaccgatagcggacagtcccgtgagggaaaggtgaaaagcaccccgggagggggtgaaacagtacctgaaaccgtgcgcctacaagcagccggagcgacaggatccgtgacggcgtgccttttgtagaatgagccagcgagttgcggtgcgcggcgaggcgaagcaagagagccagccgcagcgacacgatccgaacagggcgacacgagtccgcgccgcagacgcgaagccaggtgatctatccatgggcaggctgaagcggggtaagaccccgtggagggccgaacccacttaggttgaaaactgaggggatgacctgtggataggattgaaaggctaaccaaacctggagatatctcgttctccccgaaatagctttagggctacccaggcatttaccgctggaggtagagccctgaatggtcgcgggggcctcaccgcctaccaacaccaatcaaactccgaatgccagcggtccagagcctgggagtcagaatatgtgggctaagccgtgtattcgagagggaaacagcccaaccgcccgccaaggtccccaagtccatgccaagtggcagatttgcgtctgcccagacaaccaggatgttggctcagacagccacccattcaaaggtgcgtaacagctcactggtcgagtggacatgcgccgacaatatacggggctaagcatggcaccgaagcggcgggctgcgccacagggcgcagcggtaggggagcatcccgtcaggggcgaagccggaggacgacctccgtggacctgccgggagggagaatgctggcatgagtagcgagagcggcgtgggaaacgccgccccgcaaacccaggtttcctgggcaaggctaatcctcccagggtcagtcgggagctaaggcgaggccggaaggcgtagccgatcacagcaggcagacattcctgcacccccgaagggcgcatttaccgatggggtgacggagaagggcactcggcgggttctggactccccgtgatgccgcgtaggccggaaggcagggaaatccgccttccgcagaggccgaggcggctgacgaagccacaaggcgaagcgagtcatcccatgcttccgagaaaagcctctagggaccccaggggcccgtaccgcagaccgacacaggtgggtgggtagaacatcccaaggcgatcgggagaaccatggttaaggaactcggcaaaatcacccccgcaacttcgggagaaggggtgccgcttcgggtgatggggcatgcccccggagcctggagcggccgcagtggaaaggtccaagcgactgtttatcaaaaacacaggactctgctgaagccgcaaggcgacgtatagggtctgacgcctgcccggtgccggaaggtcacgaggagctgtcagcgcgagcgaagcagcgaatccaagccccggtaaacggcggccgtaactaaacggtcctaaggtagcgaaattccttgtcgggtaagttccgacctgcacgaaaggcgtaacgatttggaactgtctcgaccatgggcccggcgaaattgcactagtcgtgaagatgcgacttacccgcggaaggacggaaagaccccgtgaacctttactgcagctagacattggctgccggttcgccgtgtagaggataggtgggagacttcgaaccaggggcgccagcctctggggagtcgcccttggataccaccctcggcgctcggcatcctaacccctcgccgtgatccgggaggggaccgtgtctggtgggtagttttgactggggcggtcgcctcctaaagagtaacggaggcgcgcgcaaggtctgctcgggatggtcggcaaccatcctcatgagtgcaagagcataagcaggcctgactgcgaggcagccaagccgggcagacggaaaccgggctctagcgatccggcggcacagagtggaagggccgtcgctcaacggataaaaggtactccggggataacaggctgatcttccccaaagtccacatcgacgggaaggtttggcacctcgatgcggctcatcgcatcctggggctggagcaggcccaaggttatggctgttcgccattcaaagcggtacgcagctgggttcagaacgtcgtgagacagttcggtccctatcctccgtgggcgcaggaagactgagggaggctgcccctagtacgagaggaccggggtggacggacctccggtgtgcgggctgtcgccaacggcactgcccggtagctgagtccggtcgggataaccgctgaagcatctagcgggaagcccatcccgaatgagtcttccttctggtaggccccatgcagaccacaggtaataggcagcaggtgcaagcgccgcgaggcgctcagccgagctgcactaatcggccgagctcttcacctccgatgcccggagcgtgaggatgctggacatggagattgccgacgctggtgcgcccccagggcacggatggacaaggaatccctgtgccgccagcggccatggcagggggcacacctggtcccattccgaacccagaagttaagcccccgagcgccgatggtactgcggagagagtccgtgggagagcaggacgccgctggccagcagaggcattcgtgccggagagggaggggagcgcatccgcgcttccctccctctgcctttatatgccagcctggcagaggggcccctgcccatgcgggggcccttcctgcatctgctattctgtctctggcagctcggggagaccgaactcttttctcagtgcctggaagcgtgccttctccttctcctttaccggcttagacgtatcgttcagggtgtggtgcatcacgtctgcatctttgagcacctcatcgaaggggctatcgatccgatccttgctgtcatggttatagatggcagaacgatcatattggtctttcgggggtcgtgagattcagctcatctagtaccgttcgggcgagtgctgcgcccctgtgggcatggtcgctatagctgcccgtctcataagctgcgagatcatgaagcattgctgccatagaggcaagctcagcgttctgcccgcgcttctcggctatgagggtcgccgcaagggatgccccataaagatgtacatatgcgcttctcctggtcttctggtccaggcatcaagcctggcatcgacataagccctcagctgcttgagacgtgacatggtgcctccttaggacgatatctccttgtatcgtacgctgaagcggaaggggggcagcggtcccggcaaacgctgcaaagccttacaggcctttggggctacgttcgccctcagccctgcatgtccgattgctgatggggtatatcatgtcatcggtcgctaacccctgagatctatgaggtgattgcagtggcacgtatcggcgcactcgaacgaggcggcacaaagatggtcatggcaatcggcgatgaggaaggcatatcccgagcgcgattcggtcccgacgacactcctaggagtgcgtacctccgatggtcgaatggttccgtgagcgcaatatagatgctctcggtatcggtgctttcggaccgacctgcgtcgaccccgcaaacaagctcttcgctccatcctcgagaccccgaagacggcttggcggtactacaacttcaggaatgccttcgtggagggcctccatatccctgtcggctatgatacggatgtgaacgttgcctgcctcggagaggctgtctacggcgccgccaagggtcttgactacgtcgtctacgtcacgatcggcacaggaatcggtgctggcgtcatggtcgaaggcaagctcatgcacggcatgatgcatcctgaggccgggcacatccttctaaagagggatcctgaggatacagctccgagcagctgcccctatcatgatgactgcttcgaagccttgctgccggacctgccatccagaagcattggggaaagccggcagctgagcttaacgacaatccgcgcgtcgggacctcgagagctactaccttgcccagggcctcatgacctacattctctgctactcgccgaagaaattgtcctcgtggtggcgtcatgcaccaggagcgctcttcccgctcgtccgcagcaaggtggcgcacatgatgaacggctatatcgtgacaccccagatgcaggatctcgacagctatatctgtctgccggctgcaatggcgaccagggcatcctgggctcgctcgagcttggcaaggaggcgcttgccgaagcataaagcaggactgagacagtgcgagatggagcatgcccgtaccggaaggtgcggcatgctccttatctagactatctagatggcaagcgctctacgatttgagccaatgcctgcaacgggagccgccgcagacgaagaggcgagcgttgcacgctgcctccttcgtaacgtacggcgctctcctgccctatatctgcagcgccatggaaaaacctgcaataaccggattcagtcatgccttggccatactagcgatattagctagtgaatacggacgcaaatcacatgaacacctccgtgttcattccgtttagccaccacattctgcgccacattgttggcggtgcagctgctttggatgctgtcaggcatgtctgccactcggcgcgttgctcctggtgcatgcagtccgcagcacatatgcgtcgccgcatcctggttcaccaatgccgttcgaagtccatatgctgagcggggagtcttagaccaccatccgggactcttctcgtagcgagatgcagaggtaagtcatggatggcgcgactgggtgacaggtaggtagcctctcgaggtccgagacgcgcggattgcgttaagctcagctgtccggcttccccaatgcttctggaatggcaggtccggcagcaaggccttcgaagcatctcatcatggataggggcagctgctcgtaggctgtatcctcaggatccctcttgtcagaaggctgtggccggcctcatttgcatcatgccgtgcactgaagcttgccttcggacacgacgccacgcacgattcctgtcagatcgtgcctatgacgacttagtgtcagaccgcttgcggtcgccgtagtacagcatctccgatgcaggcaacgttcacatccgtatcataaccgacaggatatggaggccccacagttcaaggctgacgttgtgagtaccgccagacggagccgcgtcctttcggggtcgtcgatcgacggcatggagtgtccgaagacatgtccatcactgtctttgcggggtatcggacggtacctatggacagatgtccagagcgaagcgatcagaatacgagagcatctatattggcgctcacggaaccattcgacatcgaggtacgcctcctcaggactgtcgccgggaccgaatcgcgctcgcgatatgttccttcctcatcgccgattgcatgacctctttgtgccgccggctgtcgatgccctgatacgtgccatgcaatcacctcatcgatctcaggggttatctgtaccgactgacatgtatctaccccatcacaatcggtaccttcagggctggagggcgaacgtaccccaaaggccttgtaaggctttgcagccgtttgccgggacgctgccccctcttccctgcgtcagcgtacgatacaaggagatattccgtcctaagaggcaccatgtcacgtctcaagcagctgaggcttatgtcgatgccatgcggcttggatgctcctgtgaaccagagaccaggaaacgcatatgtacatcttttggggcacccttgcggccggaccacatcataccgagaaagcgcagggcaaacgctgagcttgctctaatgggcagcaatgcttcatgatccgcagcttatgagacgggcaagctatagcgaccatgcccaggggcgcaggcactcgcccgaacggtactatatgagctgaatctcacgacccccgaagaaccaatatgatctgttctgccatctataacgcatgacagcaaggatcggtcgaagccccttcgattaggtgtctcaaagatggcacgtgatgccaccacaccctgaacgatacgtcctaagccggctaagaggacaggagaaaggcacgctccagcactgagaaaagagtgttcgtcttcccccgagctgccagagacagcaatagcagatgcagagggccccccccgcatggtgcgggcgccctctgccaggtgcgcatataaagctcagaggaggta

SEQ ID NO: 428 - DNA, 40474 bp, Unknown
  Metagenome-assembled genome
ttagtatgggttataatagcagtaacgtttactggaccatactgtataatggagggtgtctcaatggacggattattttcggatgaattaaaaaagctaaagtggcacttattgaaatgggaattaacgtcagtgaacagatctatcaagcaacgaaggcgtttattgaccacgataaggactcgcacaacatgtcatagaacaagatcaaactactatgaagaaagaaactgggttgaagttcaaatggttggagctatggcgagggaggggctggatgattttgcgttcctcaattattagtattttaaaggccagttcaatttgaacgaatcgaatcggcgatcatgccgttatattgcacggcaaacgattcgcgttagtggtttcacggtttgtgggaattgaaaatgcgattgctgagatgacggcttcggttcggagcatgctagaaaaaagtattggatgcgtatgcccagcatatgaacactaggttctctcttttacttatcttctcctacttcgtttttaccttctcttccccttctttttcgttcctcgtcccttcctcccgatcccgcccctccctccccctcctccattgcttccgtgtaaagattatgtaaaaaatagaaagaatttaaaattaaactacgcgcggtataataggaatctttatttttatgtggctcttagaacctctatatttgtgctagtttgtccccagaaagtccccaagaataaaatagagtacgtagcacctacgccttaattggtataggtgctatttttatgcaaataaaaaagcccctacccaattaaaggtagaggcttaatttgaatggtgctccattctattacgacgagtgctcccgtctcacgatctcgattggtcatagtatagcattttatttcaacttataccaacttatcggataagttgaaataagctcgtgcaagctcatcaaaactatttttaaactggtcgaaatcgaccagtttagattatgcaaatagtttataagccgtatctttaccaaccacaccatcagctgataagccagtaactgattggaactgtttaactgctgactgtaacccaccgccaaagataccatcaaagccgttaactgaatagcccttgcagatcaaagcaccttgaacaatacgggtcatgttgccttgggcacccttgcgaacagttttaaatgctccctttgatccggagccaaaaataccgtctactgcaatgtgaccaccaaactgccgattaatctccgtttggattgccttggcaagtgctcgcttggttgcgggaccatttaaattgtccactactaggccggtaccataattggcattcaaccatgattgaacggtcgcaattgagccagtcgaagtcttggctgctgattgagctggtgtgctagttgccacattggtgaacgttacttccccgctgatgccattcagtaagtccttcttgaactgggcttcactaatgccccacttgttcagaaacggcattgggtccacatggtctgatcgattggctggttgatgttttgaacaatagtcatgggtcatcaagcccttggaacctgtgttgtattgcatggcaatcccaccttgtttggcaagttggcgtgctaatgcaatgtacagtttgtatgactgttcaaattcagccttgctattgaccaactcactaaattcaatagccgcataggtgttgtgattccagccaccaccaacgtcccaagcacctcgacctgtattcgctacttgatagaccttgccttgacctacaatgtgagtataaaaggcattcttgtggccaccgttatcaactaaatacttcacttcattttcaatcgtggcctttggattgcctgttgaatgaagatgaatctggtttgctgtggttgcaatgtttggttgaccactaaacttgtgtactgtaatgtccatgtttaatcacccttcttttctttctcatcgtcaattgccatctttttaaatttacctttaataaagtctggaaatggaatccccattactgccaaattttccataattgacacaccatattggccaatataaaagacaagtgtagcgttagcgatactggtaaatcctaatgcatccatgagcggataggtaaacataatcagagtcatgattgcaaagtgtttaatggccccttgcaagcccgttgtgctgtctactttcttctttgctttcggaaagaatgacttaaaaaatcccagaaacatatctgctagcactaccaacagaaaagcttccatgaacggattatcaaccatttttctggctgaaattaaaactaagctaaatgtgaaaccgggtggcactcccattattgcatctcctcaattttatttttttgtaccaattaatgcggcatactcggctgctgtcagtaagtgtgcttcattaattttgacggggtacacttcaccaacgattgtttgatattgatccagactaatatagttctctttcaccgtccgttgcatgttttcgatggataacgtccccgcatcaaatgccgttttgagttcgataaaatttggaaaatcaatcattctttcacctcattaatacgttggcatgtaaggcgccacgtgtgatcctacacttaacattggttgtgcaaaatgaataatgttcccattgtgttcattgttgtaaaatgcaaacctgattgaactagtcccactcggaacagttatcggattaaatgaatagaatttccaccctgttgaaagccccttgccagcatcctgaatggttgcagtgtagttcgttccgccatcaacaaaatcgataaatgcgccaccgttcactccaccatcgtttctcacgatgttagcccaaaatgaaatgcaaacttgattaccgctccaaggaaaattcgctaacgtttgagtacagaagtttgatccaccgggagacaccatttgcaaaacaaaattaccatcatgaacgtcgtttgacacatatcctgctgacccagtgtcccaattattttttccattgacgaatgatgaattacgaatcaaatttggatgcgactgaaccgaactcatcatgtcgaaccagtcaaaagctcttgtacttccagtttcactcatttcagacaaatgtttacggacatcttcccagctgacgctaatattgttagactggtcagtcccattgtttaacgtacccgcaataccgcttgaatccaaaattccactcttttttgtattggcattagacaagctaatgttgtccgcatacacttcggtgtgaatgtatggattgtttttcgtatactcggattgattgacataagcatccaatgtgtaacccgtagggcttataaccgtcttgagcatgcccccgtcagccatagtagaaatatgcttcagcatgccatccttgaactccatggaacctttgtactcgttttgtgactcatcgaagtagtcaaacggcaccgtaatatctggtgaattaatcgtggcagaatcaatctcaactgaaaccaatttagttagtactagcgtgctttgatcaatctttgacggtacccatttgccaccagaatagacagaaaaacctgtgatcttttgaccactggaatcagtcgttgtttggtaccaaaagtccccatccttggggcttgctggggcagtcgaactcatcgtgaccacaggcacgtcctttgatcccggttgaccttgtaatccttgagcaccccgtgtgagttgccaagtgtacttggtggggtctgttgattgtgcttttgtattgtccgaatacgtccccagataatcacggttgtgagcttgattctgatcagtagtaaaatcagtcttcccatcaacactattagcataggcaatatgcagataggcgtcttgcccgtccttgccatttgctccggcatcacctttaatctgtgaccaaagatattgacttggatcagaactatccgcttgaatgtagtcagtatacgtacccatatacttcggttgcacattatcctcaacagatggcaaccacggagtagctacatctccttgctcaagtttgtaatggtctatctgtaaatctttaccaaaagttgttgcccatgctcctgaactagcgtatatcaataatttgacttcggttgcgtctgtaactttaaacgaccatctgattttgccatcttgtattggtgctgaataaccagcccagcttatattcaaatcattatcatatgggattaaaaaaacagacgtgtcgcttccacggaggtacttcgcattagacgtgaatgtccacgttccaggagttaatttgtcatacaacaatttgtaatgctcggcatcgccgtgtattgttgtggccgccgcactatttttaataaaattaggattcccaccaacataaaatccagttttaccatccgatgaatcagcatatgcaatatgcaagtacggtgtttttccatcggcccccgctttaccgggtattccatcgtttccatcgcttcccttgatcaatgaccaaccgtacttggtgacgtcggttgaatcggctgcggttgcgtccacatacatgcccatgtacttcttggtgccgggttcttgactaaatccagccccgtttacatcatccgcataggcaatatgcgtgtacgaacttgttccgttaacacccggtataccttgacttccgtcatcacctttaaactgtgaccacgtatacatagccggatctaagctatcagcttgtgtgaagtcggtataggtaccgatgtattttggttcaacgttgtcttcaacagctggtgtccaaggtgtaaaatctccaatttccaatttcgcatttgtaataacgaatggatactcatcagtattgtttttcataaaacgaataaacatactagatgtttcagatgttgaataatccggatctgaaatactgtatgttaactgaacgtttacatcatccgtgattccttttggatacgtaaacgacttaccataccaaggagattttccaaagtacaacgttccattaaaattatcagtcaacgctttatcagccgtgattgtaaaactgattttaattgcattagcttgtaatctatctgggttagaccagaaatccttgctaatgtcgaatccacgccaatcataattatcagtaccattcggatgggctgtccgtttagcagaatcaacaaaataatttcgattaccaccaacataaaatccatctttaccatctgctgaatcagcccaagcagtatgaaagtacgaagttttaccatcaatacctttttcacccggttgtccgtcgcttccgtcttgacccgggttcccttgagggcctttaaccaacgaccacgaataggttgtcggttctgttgaatcagcttgagtgtaatcgacgtaggtgcccatgtaggcatactgtttgccatccggattctgtactgtgaagtcagttgctccgtcagcactgtttgagtacgccacatgaaagtacggtgttcgcccatcggtaccaggcttccccggtgtcccgtcagtaccattggttccatccataccacgaagacggctccacgtgtactgcttgtaatcggtcgaatcggcttgatttgtatcagtgagcagtccaatgtattgagcattggtaaagtatgccaggttgaatccagtcgccccatcagcactgttggcataagccatatggacgtaggttgaaaccccattggttccatctctaccattagtccctgggattccctgtttaccatctttaccttggatgccttgaattccttgctcaccagtcagacgttgccagtgcccggcgtaatcggctgggtcatcacttggtactggttgattgaccttagctacaatcgccacgtaggctttatctttaggactttgactcatattagttccctgatcatcgtcagcgtagcgaatccatacatagctagtggaaccattcttgatgccgtttaccttagtacgaagtgcagcaatctgttgcgttacggtgtctgttagcaccacgtaattagtgaacgtgattgaccctttggttgcgtcagtgtatgacttttctaatgtggcaacccgggcttgcaagtacaatgcaggattgtagtcatgatcaatgatcgtcaccgtgtcgccaatatctaaattagggtcaatcactttaacttgagcatcataggtgaactgtggttgtgaccgggtttgaatttgagtcaatgtccggttgaataattccgcgcttgacttagtgtcatattcgtagaaatcttcgatgtaaccttgatcaccgggattaaattgtgcatttgcagttctagcccgcaagaacttgtcacccttggtggtgtagaagtccccgtcatcatattctaggtctataaagtccacatattcttgtggtttattagtatctacggtcgaaccatctgcatcagtttctgtgtcttcaataactgaaccaacgccggccagcgccgtcacaaactcttgccgggtttcagttttttgaatattgtccagttcctcgttgtaggtaatctgaatattatcttgaaccgttccaattttcttatagacatcgatcacgtacttaacgggaaccggtccattcatttgaatgttaaaaatacattctgcatcatcaaaggctttgagcactgataatagtcgtcccaaaccggtatcacgtcccgtgaatgtcagcgcccgggataaatcagctaattgattcacacccagttcccatggggtgccatcagtgatcacattaaagtattcagcgaatggcttggcatcggtgtagtaccaaacgtcacacgctttgttgaataagttgataccaacgtcttcgcaatgcaccgttttgtaggtttgatactcgtcatagtacagaatttcaaatggccagggccgtccctgatcgtccagcattgtaatgatgttaccagatatcatgtactgagtggcttcatccgacttatttagatcaaacacatacgtgctggccccggctgtgagttctttatggtgtaaatcattataaaagccgtcagtcgttgctagaacgttcttcgatcgatctaatacatacagttgcaatcatgccaccccctacaagtatttcttgcgaatatatgccttaatgctaggcattgacgcaaagtctgaatacaaaaatgaaacaatattgttacccgggtacaccagaatcggtttcgaacccatgccttgaattgctaagttcagcgctccattgacccgggtttcaaccttgttctcggtaccttcaacgctaatttgatcaccatcttcaaacgtgtttggtacatctacatatttatcaacattttcttttctgaaccaaaaatcgaacagcaccatatttgacacctgtgccacacttgaccactggcagatttgataagtccaaccagttacctttttagcaccacttgttgtttggtcgaaagtaattgtttgacgcgcacctgatccactttcagtgtcctgaacgtccactgtccacgtgttaccgaatcgttgaattttgaccgtacccacaaacgtattccagcggggattgttgtcataatagacattttgattatctgaatttctgaccagcatagcggtattggcattggcaccagtgacaaattgaacagtcactaatcgttcaccagccgccgcgttcagcacaatgtttgtcaaaccggtatcagctagttggctttcaaacccaatctttgtttcacaggtaaagttgtccgatccggtcgttccttgactatcttcccatgtgtctcgatgcactgaaggcccgtgccatcctcggccggttcctgaagtagccgcgccaaagttgtaaccagttgaaggctgatagcacattaaagcccatttattacgattggaaccgatataaattgatccaacctgccggatgtcctcatcggcacctgaaataccagcattaattttgaattgagctaaatcagtggccgccttattaattgtgaatagagtttccgacttctcgacctttccaccatcaatctcattagggttaccaatcaagacgcttcgatcattgcttgtgatacctaagaacccattgtcctcatgattagttacttcaaaccgtgcggctactggcaatggcccatcgttgacaatattcattgcttccgcttctggagcatcggtgacaatttgagcgccaaaatagtcaagattgatgacactatcggtggtatcaccactcacagcatactgtggaaagatattgaaatacaaatagccatctgctgaagcgtaactaaacaactccgttggagtggcgtaactaattgtgaccagtgacggtgtaggtgaattggtactggtactccccacccaactattattctgatcccatacttgaatgcgagcattgtttccactcgcacctgaaccactaatcactgcactgaatcgagcactgacaatgtactttttcagccattccaatcgttgctgacggctgttaatcttgtacttgtcccagtagcccggttgcgcttgctcataggcattcaccaaatcaaacttcactaacagatgcggtgcggtttgctgccaatagtcttgactagaaacaatgaatgaacagttgtaccagttaccttcaccattttcagcgtctgaatatctgaaatgaattcgtagatctttgttccccattcctttcttataaggaatggaaccatagaatccacagtgaccaccgttaggataattagggtacacgttgtgcacgtccgggcggtcagttagatcaaccttcacccgtccatattcgttgctccagtcagcgtcagtaatgatgatgtagttatatgggtgagtggcatattggtcccaagcaaaccacccaccaatttcgatgttgttaccattcaaccggaaataatcgagcgccccagttttaggtgaatcagtcgccagtggaaacagtgtctgtgtaatttcagtggttcgtttaacctttgaaactaccgtggcacatgtgccgtcaattgacgccagtttgctgtatagatcggttgtgatttcttgcgtgtaggcactaggtggctgcattgccaccgtgataggttcttggcttgcatagatcgtgtgaggaactttagcagtctgtcccattactttgccgttgaagtcattctgaaccgtgtactggcccgcatttgaacccagatcgaactcatcttcacgtacactgtatgcaaacgggtcattgcaaagaatggtgaagtcactcaccactgacaacttcccgccgtccgggattgctgcttcttgtagggtccccacgaagtatttttccgggtcatccgcaaaatagaacttgttatcaacgcctgacaaaatactgtttaactcataaaaaatagccctgaatctctccgggctacttgcgtttactaaatatttgattgtgatttcacgcggtgggattgaatgaccttgaatccgttcaccatcttgttgaccgactttgagcgtgtctaatgtttgaccaatcaattcacggccaattacttgcaaagtttgatactccggaataactttttcaatggtcacaccattgaacgtcatcgcttcggatggcaaaccgtccgtggccatttcagttgttggttttaaatctctaaatccgtatgccattattcatcccccttagcgttgaccgtgaattcggttgttctgtgtgtccatgcggttcaattcttgttgcattggtttcgctgtgattcgtgccacttcctgcccgtctaagttgaccggtacttcaaccgtccagtcgttggccacattcaattcatgctccatcgcaccggttaaactactgttgtttaaacctgtattaacagaaccaaacgcatcagttaattggaactgatcggtatcaacaaccgctgcccttgccattgcttcactggcatcaatcaccgcaccagtgttcttctgaataccaacagccatcccaagcgctacgtacttaccaacttcattacgcatgattcgagatggtgaatggatgtgaaggaagctcttggcggcatcaaccgctgatcttgccatgttggccgcggcatcagcagcgctcttgattgcaccactgataccacgaacaaatcccattacaaagtcacggccagcgctcaccatgttgcttgctactgatttaacagcgttagcggctccacgaataccatttgacgcaatcgacttgactgtgttccatccgctagtgaacacggactgaatgccactcatgattgaagatacaactgaacgaatggcactcattccacttgaaacacttgaacgaatcccacttatcacactaataaccacgctcttgattgcattccaaatactggtgaatactgactgaattgcagtcaatacactagtaatgaccgactttacggcattgattccagtggtgaccacgcttttaatagtgttccagatcgttgatgcaacaccttgaattgctgaccatgcacctgaccaattgccttgaatagcagccgttacagcgttaatgatcccagctattacatttaaggcaccagaaacaatagaagttataatgctccatgccgcggtaactacggcttgcaccacagaccatgctgccgtccacactgactgaataactgaaaccacagttgtgatgattgtgacaattccttgaaagagtccagcaaagaatgggcttagaacctgccaagcagccataatagccgcaataattggtgtgaaaatcgttactaacatattccacgtggccgttgctactgtaacaatactggtccacaacgttgaaaaatatgcggataatgattgccagattgccattattgccgtaataacaggcgtcattaatgtaacaagcaagttccatgctgctgtagctaccgtcacaatacccgtccataaagtacccatgaacgttgcaaaagtttgccatgcggcttgaatggcggctaccacagtagttacaatctgttgaccggttttagtttgagtaaagaaataaaccaatcctgccaccgctgccgcaatagcaacagccaacagaacccatggatttgagagtaatccaaatgccttcattgcagttgatgcaatagttgaagcaatgccaagcgattgcatggctttggcaaccatagcaaccccagccacaatttcaagaattggtccaagtattccgcctgtggacttgttcagtgacttgaaggcattaaccgcaatctgcaccgcggcacctgcaaccttgaaagctgctgacagaacgccaccaaccgcattagcaactgaattaacaatatttctgaaggttgctgaagtgttatataaatctctaaaccctttcacaatcagcataatcccagcaaaaatagccgcgccagcaaatgctttgctcatcacgctagataccatcttcattgcggggcctaatcccttgatagattgccccaacgtcgcaaattcagccgttaaagtcatcagcttaccagcgatcatcattaatggaccaactgcggctgcaatacctaacattgctagaacaaagttctgcactgccggactggcatcgttaaacttaccaaccaacgccgcaatcgtattggctacgcttttgatggtgggagccatcttatcaccaataacaatagcggcagattcaaaggccccacctaactgttcgacagcagattttgcattgtcttgcataatcttagccatatcagcggctgatccttttgaattttttaatgatttagttaatgcggctagttttccatcttgttcaccaagcaatacgttcattgctcggccaccttccatcccgtagatggtggctagggtattggccttttgttcatcggtcatccccttcatcttgcctttaagttcgctcacttgcttagcaaggggcttcatcttcccaccggaatcataggcactgaaaccaagtttgtccattgctttctgtgcttcagcagatggtttttgaactctcattaaggcttgagccagtgtagtaccagctgttgaaactttcagtccattatcggataacagaccaatagcagcggacgtctcttcaagggacagccccgccgcatgtgcttgtggtgcaacgtacttgagggcttcccccatgtcactcgcttcagcgttagtcttagccgctgctttagcgaatacgtcagccacatggctagatttaccagcactcaaaccaaacgcattcagtgctgtactcatgttttctgcggctttagcaacatctccaccagatacggctgccaagttaagaacccccggcatagctctcatgatctgagttgagttcataccagcagacgccagattttccataccttcagccgcttgtttcgcactgaatgcagtcttagcaccaaggtcaatagcttgtttcttcattgcccccatctgcttacctgttgcccctgaaatggcttgaacacggctcatttgagcaccgaagtccattgacgttttagcagccgcaatagccatcaggccaagtggcaatgtgatacctttggttaatgttccaccaattttagatactgtggcaccaacttggccaagtcctgtttgcgttccagcctgaaaactagaaacactttttgccgctgatctgaaagtgctgctaaaatttgaatcaacagcactaatgaccgcattaaccgaataactttcagccatttacaccaccctttcgtttcaaataatcctgaaggcgaccgtttacaatttcagcttttttacgaatgtctgcttcttcagcttgcttactatctacgattcggccgtgtgaatgacgtatctttattttacgaatttgtttttcgtcagaataaaaatcactgaacttacgatacttgggttgcttcccactcttgtttgtagccttaacggtttgattggcccatgcttgcatatgaatcaatcgttgctgatcatattcacggagctgggcggcttcgacgtacatgtcatagtcttccaatgacaatctgcctacttcttcgatagtggtaaatccaagtttatgcaatccagtgataatcaaatcatgataaacattttcgctataatcttcaggttttagttcttgtcctcttgattttgagccgcttctagtgatgcttttgcggctttcactttttttgctaacatgtttttggcttccatagcttccgcaatttcatcggcgatcggttgaatgtcttcttgttcttcaatccatgcgtctaattcttctccaccaatacgtggtgtttcggttgaattagctgctaataggtagttcgatacaatttgtggctgagcactcaataacgtgttaatagtgaggtccaagccaaagccatacttcatttgcattcctgatacttcgggagcaaacaatttatctaattcccgtaagaatttaataccaaattcaaagttatattttgtgccattgatagttttttgcatttttaatttcctccgttaatagccgccggttaccctattgtttatttcgtaggcgacttcaattaattaacctgcaactggttcagcaactgtgattgttgatgtagcaaccttggcaccatctgttgtggtgtaagtagcaattgttgtcccagctttaactccggtgattgttccatcttctgcaattgtagcaatagacgtatcgccaattgaccacttgccagttttgtcagtagcatcatctggtgaaattgttgccactagcttagctgtcttgccgacttcaacgttagccgtcgtaggagccaccgttactctcgtgacggctacggttttgggacttgcgtcttcttatattcttcatcagaaacaccaccaccgtttgtagaatcaccttcagtgaatgccttcaaaccgcggaatgcgtatgccaatgccgccttagtatctccggttaatgtgacccatccacgttgtggaaccccgtcaatactgaacgaagcatcacctgttgaattgtcatcggcatcgttgtcggattccatttcgttaaccacaccctgcatatacttggcgtaatattgacctgccgcatttttgcgcgaaagatcaacttcccatgcttcaatcttttcgtggttttcaactgaatcccataacaactcattggtttcgtctgcacttgcaaggttttccacttcaagttcagtttcagccggtgaaatggtgtttacattaccatctttcgtagccgtcgaatcagaatcacttgaaacagtcaatttgtgtgttgtttgtaatgaaagtcgcattgcgtctttcactgctgcgtccgctaacttacgtaagaacaaaattttgtccattccttgtgtagcagtaaattcatttgccatgttttattccccctaaattaatctaaattcaaaatccataaccccatgccacagaaacgaattaggtacactggtatcaccaataatctgagaacttgaacccttcacattcatcgcaacattgtagaattgcaattcacgcaatctttgagcgtaagaaaaaagtgattcctgaatgtcagaaacctgctttctttgcgttggtgttccccatgtgttcatagtgatgtgtaacgaacctaatccacgtgtttttgtggaaatattaacggtttgaacgtctccaatatccacgaatggataattcaccggctcatctttcaatggcctgtgatcgtacgtttcaaacccaaggcttttggataatttgtacatcgaatcaaataaatcttgatcgggtgctttcaatccaatcacctactttaacattctcatcaaatcttttacgaaaattgctttttgtacttcaaacgccggtttcaatgcaggctgtgcgctcatgtaacgcgttcctaactccaaatatggtgaatagtatgttcccattcccacaattccacgcatacccatgtcggtaatctgataactgatgcttctctttgtggcacccgtaggcttcacaaacttattaccttcatagtgtccatgatagacagcacgtcgtactgcaccagcctgcatttgagccgtgttttcagccactaagcgtctaactccgctcagatttgtgttgtttaatttgctttgtaacttatcaattccgtaaaacttaacgtctaacttactcatgcgattcacccacaatcaatgtatctgcattgagcggctttcgtgaagtcaatcgaatatacttagcagcatcatccggtaaggttaaccattcccaatcgaaccacacgggttctgatagacagatggttttagacttagtatcaacatccccaaacagttcagtggctcggtctgtaccggtatcaaccacattcccaagaatggtctgtaacacttcattcgtcgtgtcatactcccctttatcagggtcataagtcttaactggtttatgaaatgtaactaatgtatcgaatctcatctaaccacctgacttcctaattgcatatggattcaagaatcgaattttgtgcttatccgctgaatcttcagcatgatcatcaatccattgctggtagtcatcttcaaattctgcaaagtcatctgtttcgtatgaaattgattgcccctcttggccatacgaactcataccctcgtttttgaaccggttaaaccgcttgacaaccacaccacgaacaacaaatccaagttcatcaggaacggttgtagctgctcctttgagcttaatcaagaattgatcttgggtatctgttaaaatctgactgattcgttctcttgacttatcaaacgctgcgtctgaaagctccagtcgggcttgaattgcactcattaattcagtgttatccacctgattcacctcactatccagccggtactaatgcaagcaagtctgccttcacagtcttaccagtatgatcaatgttgtgagcatctaaccatgcagtaatttcagcgattgtatttgaatctgttggtttcacatcgcctgatgggtcgaactcacctgcgttttcagcagggactacgcttttggggctactgttgccacaaccacgtttgcatcgttgtacaggtaagtagcatagtgttcatcggctgtaattgtggtcgtcttagtgacaatgttacgatcagtttcaacttgtgcgccacgcttcataactaacttcaatgcaggctttgcgttatcaacacgaatgaaaattgcttcgcccttagcaagtttgtttgaacgtaaaatctgaacacccaacacatcaaaataagttcctgaaataagggcattcgcacctgcttcagaaccttgcttcttttcaattgcatcagcacggaccaatgatgcgtcagatgggttataaattgccacaaccgttgcatcttcttcatcactgaacatatcaacggcagttcgaataccattgacatccggtgtgattgaaactttctgcgtcccagtttttgctgtttgtagcatatcgttatcaaccttgttagcgatagataatccaagttgcttagttgattcgccaaccggatcacctaaaccggaaagaactgattcgtcagtaatcgaagtcccttttccggccttcttgatcttaactgacttagtggttgacccgatcttgtctaatggaattggttcaccttcagcaacgtcttgtgcatcaccaatgtatgtgaaagctgggtacgttaatgtatcaccgggtgtccctttgagttggttatcaactactgccaacttagtgaatcgaagtgcttttgttaattcatatgaaacgactggtgccataacttccgggttcaccaagtctgctaatttagtaggtgctgtatctgccattttaaattccccctgttaatttcttaaatagttctggattcttggcttgcaaattgaccttttcagccatcgtcatcaaatcaaattgttcttgggtcacattagtatcaacaggtttgccattgacctttggtgtcgaacctttcatgtactcttgacgggtggcttccttaatctcgttcgcaaagtcaattaatgctttggcgttgtctagcgtggtttcatcctttgcggacacaaccattgccaacacgtctttgttcacactcaatccggcttctttgaacacttcgtccgtctgttgactggcttccatgatcttaaccttgtcacgtaaattttgaagttcggtatctttggcggcttgttcctgcttctttttgtcgtcgtcagatagcttcttcacgttgaccttgccagattcgtagtcagccaatttggccttgagttctttcacctgatcaagtgcgctgttcttttctgcttgttccttaccaatacggtgctttaacttgtccaccactttatctgaatcaacagtttgatcgtcaatagccgtttcagtctgatcagtgttttctgtacttggcttggtatcaactgtttcttcagttttggtagtttcttcagtttgtgcttcgttatccatagttataagctcctctcacgcattttaagacttgggagtctaattacacatgttgttctttaaatgccctgcaacgagggaaaaagggcacaaaaaaaaagcgatagcccttagcaagctaccgctcatatttaattcttaataaattagttttaaagtaacgctcttgttaatgtttcagtgccagtaattttatcaatgacaagcacctcaggcagtccaacaggattcataacatcactactttggtcatcatcagatagtaaataaaaagcaaaaccatatggcgggtagtcctcgtctcgaagttctgcaccgatataaccatgcttgagtgcatatgctttggctttttctatggcagatgccttatcaatttctttgaatgtcccaatacccatctatttcaccgccttaacaatcattccaatgttttccatatcaatatacttatcatcagttctattataaaacacgcctgttcggtattgcacgcctttttgagtgacccgatttttaaatttgttatcacccatgtactcttcgaagcttttagctgttctaccaggttgagcatcaactaccagtattccatcttttgttcgctcaacgttaacaatgtgagcagaattcgcacctttccaactccattggatcgtcccccgctctccgagggtcatctgattcacaagtgctttagtaacttgacgattcgtgttggcatcgacaaaggctggctgagaaattgaaccatctttatttcgccacatgtttgctggaatttcatatacatcatgatgtgttccaccgttattaggcaacgcttcaacatcataacccctacgtcgaagttcatacgcgggtgcacaacgttggcaattaactgaatacgatttatgttcctttctcattgcgtcaatccgatcgtacagatcattgtaagctgcgctatacttgttggttaaattctcataatgaatagccttattccaatcttcatcactatacgtactgtgatacagtttgtaatatttttcatgtcctgcctgagcactcttatactgtttccatgcttcgtcacgtttagctattaattcccgtacagcgtctccgcccatatagttagggtttgcattgtgatggtctgctttctcaatactcatcggtttgcccttaacggccacagaacccaagttgtgaggtgacacgcttgtggcttcctcattttcaatggctgagctggccgccttagcgggtttgatcgtccctttcttgacgtatgctgccttagcacaacggcagtaagggtgcgccgggatataaggcacgtcatcaattggatagattccactgttataactggcaatgtcctgacataccttgcaggcacccggttctgcaatccaaagcacgtccttaattccatactttcggaatgaactcatctgggcgtcatcttgcacccgcgccatttcagtaattgctaagcgttccgctgcgacccgtttgtttttcacggtgtcattgatcagcggcattatgttcttggctatggttctgggattgagaccaaagatcatggcttgcgacaactgaactcctaattgagtttgtaactctgccatccccagccacaatcggcttgaccattgagcgccttggaatgacgcattgaccacactagaagcacgcttaaccagatcgtcgtcccggtcttgaccaagaatcccagcttgacgggtcacttcgtccacataggacttcgacaagtgcgacttcatttctgattccacactcgcaccggcatcaactaatgttgcaccaatctgtgactttagcatttcaagccggttcaccttcattgtggtgttgtacagcttcaattgggcgtttgcttgatctgaaaaatccttttccttcaccatcttctttgcggtagctgaaaaggcttgaacgtcgtgggctttgactcgttgcattgcttcagccattgtgatgttctcagctttcgcataactcatgtaaaactgattaatctggtcgttgatgtccttgaacgcctgatcataaatcgattgcaacttcttattgaagtcttgatctttcttgaagttagacgcttgccatttctgttcacgtttcgtccaataggattgtgaatttgtcaacgaccatcacctaactttcgtcttgtgtctggtcatcggtcttttgaaaatcgtagtctgctgctgatggcatcaatgcttgagtttcgttattcatcttgtccacttccgctttggggtcctcgaccaaatcaggtagcagcttcagtttggtttcctctgatagcgttccaccaacattcttgaagttgtcaatttcatctgtgatgttacttggcaagttgcgagtgaagtcaaacttcaagtcctgccaagcgtctgctttagcggtacctaagattgacccagtagcaaagatcaccttgaacagcttacgtaactgttgtgtaaatttgcgttccttggttgaagctagatttcgcattgaaagcagatgatattccagcgacttaccactggctgcgttaccaaatgaatcatctgtgatgtttgacaccattgagatttcaaaaatccaattgttcaaacggtcaatgtggtgttcctgcgtatcgtcggcatttggtttctctaagaatccaacgtctgcttcaccatcgctgttaatcactcgactttcacggatattttcaagcgtctcttcgtctacgtccatccccagcaatttgaggtatgaatcagcaaagtaatcaatatcgttggccttttgactcacggtttgattaaccgaatcaatcagcgtttcaacgttgtcaaacaccccttggcgctcttcgttgtcgtagaattcagcagcgggcaccaacttgaattggttcacttgccctgcaatcacattgaattcaaggtcggttacttggtctgcttgatacaccgtcccagtcaactcgttgtccttgttacgaccaaacgctacaaacgccctaggacgccgtgcaacatcgtcatcgtagatcatgaaggattgttccggactgtattcaactagctgtgtcacgccgtcctcgtcctgataggcaaaaaaatagctgcgtccatacattgacgcttgctttgaaacttcaaaaaagtgatcaaaaaaagatgaactctgaatgaagtcttgcaacttctcattatcagattcatcttcaagtgtgatctttggtggaattcctgcaaagaatccgttgaacgtgtctgtgatgtacttggggtagttaaccaccaaacgattatcaggcgcgttcgaattgcttgcattagcttccagaataggatgttgaccagtgtaatacttgcggttcttaatcatttcagtttgaatattgttttcataataatcaataaaaccactaacatcatcagacgtcagcggctgttcttttggaaaaagataaatgtttccgaatgtactgattgtcccgtttccgttaatttcactcattacttcaccccttttatagacctcgtttgaaggtcttcagtttgttctttcccttcccgtagaattgatctagggaataccgtatagcatctattgcgtgattacttgcatcgacaggttggttcaaccatctaccttctcggtcctgcttgaacacataggtgttgaactcttcaatcgtgtgcgtgcagcgtggatgaatgtgaattttcaagccttgcatgaagttgatacccagctcaactgaatccttgcccttttcagcgcctttgattctgcgtagccctttacgcttcagttctgcgattgtcattgggcttgctgaatcagctttgatggtagctgctaacaggtctcgtttagccgtctcgtgaacaatgtcttcgaccaacagaccgggcttgtatagctcatcaaatatccacagctccatggtgtctgaatcaaagatcgaactaatcaacgtagtaggatcgtgggtaaacccaaagtccataccaaagaatgattccatccccttcttcagcaacttgtttggattgaagtccactacatcgaagttttcaaataccagaccttcagacacaccccattcacccttcactgccaccttggcacgccgtgggttacgaatcagcatatctttcaacgtcttgatatagccgtcgtccaagaatggattattctggtaggtcgttgtgaacgcccttgaaccagctaccgctgtatctgaatcaaagaacttgtgcttcaaccaatgatgttcattccacgggttaaatgtcagcactgtttgataataggcgttaggcgcgttgataatgccacgcatactttcatccaccacatcgaatgattcttctaattcgagttgataggcttcctcaacccatagcctacacaacgaaccaacctcaacactgatagaagtgattgacaatggcttgtcagcacctcggaacagtatcttttggcccgtcttaaggtaggttatctctggcatcgaatcgttgaatttaaacaacgatgatacccccataacatgtgctaccttttgcagtaacgaataggttgattgacggttggtgttggcataacgtcgaagcactaaccaattcacataaggcttggtgactatatcaaagatcaccttgcgggccactgcttcagacttgccagaaccacgactgcctttgattgcaatatatcgatcacggttcttgaacaatggcctgtatgcccgatcaaccatcttaggtaggttccaatcaatttcactcattgtcatcaccccaatcagtaatgttgatgttcacatcgtcctgcggtgggtgttgatcaaagccaccttgaatcttaaccaaatgttctagtgctttggtttgctgatcaatgtctggttgatgaacatacgtgacgtcttttttgacctcgcctttcaggttgtcaatgatcttactgtgtgatttgacttcttttcgattcgctatatccgaaagtaatgccattgcatcttctaagcttaccaaacggtcattcttgatctgttcagttcgctgtttgatgtattcctgaatttgaggttttctaaggttttcagcacccatctgtccagcagtcttctcactgtacttagccctaatcgctgactgtgtagcgttgccggtctcaatatagtaatccgcaaatgcttgttgtttaatcgttagtttcattacatcgaccgacaccacctttctgtgcaaaataaaaagccgtgctaggtttgaccctagacgactgctaaacagtctcacggcttgaagaatgaaacaaaatgataaatatattgaagtcgacaaactccccggatatggtaactatctaaattaccacaatatcattttctctcatttcactagaaattgtaatgacaccctgatgtcactcctgtgtcattggtggtttgcaagcattgacgccatctgagtacaaccgattaatttgacgcaaactgtaattggtttgttctgcgattgattccaatgacaagtcatcaatgaaatacaattccagcactcggctttgcttggcattttccagttggtcaaacacgtcagtgatttcatgcctgatctttcgtgcttcaactagaacatggttaattcgttcattcaattcttccttacgttcatatcggtcatttaaagttgtaggaactccaccgccgggcatgtcagttatgaccgggctgttcaactgctccatttgtttatcaagttcaaaaagtcggtcttccaaactcttaactaaacgcattttgtaccggtaacgaatcaagaatttcttattttgttgaaacgtgttttttacttcttcaatcgtcaaaacctcccgatataacaaaataacaaaaactttgctaacttcttatatactttaataacacataacaataacacttatatactacatatattctttttaatatagaaataaagaataattatgtgattctgttatattgttaccctaaatcgcttaacaccggcgtttgtagcataacaaaaactataacaaaatgataacagaataacaaaaactaacagaattggaacttttttgattgataacaaaataacagaatcaattttagtttttgttatatgcccattttgttatgtttttgttatccattttgttatcttagaaaaccatcaatttaatgagccaccaaagaaaaactatgatcaaggctacccatgaaattgcgaaaatccaaattactgcttcaaagatcgttctaaacattgtgtgcacaccgccaccgcctttcacactggttgaagattgcaacgttcaatgtacatagcacgcttaattttgccaagatcatccttactgatcttcaacgccaaatcagtcgttttgattcccgcgtacgtaacaatatattcatcatcttctagcggtttaccatcgttcatagcgaacttaccaacccaatcctttgccggtataatagtgcgaatttgtgaagtgttaaggtatcgatcatttctcaatctaactaacatacgtgcatcccctttaccaaaataaaattactaagcgcgttgggtcataagcaaacaaatacatcacatacagcagtgttagcactccaatccaagcgaacaaaccaacgattgcatgccacaaatcaatcttcatgcttcacaccacccaaaatatcaattacagctttggtttcttcagcactgaaacttgcttgacctaacttgccaaaatccagaacatgtacataactcgttgctgattgcatttgatgtacaagtgcgttctgtttcatacgtcgctgcttctttttgattgctgatcgtttatgcccacgtttcatttctattcaccatatctttctttccaaaagtaaggaacatcttcataaaatgatccgctattatacgtttgataaggccgctttctttgatcccaatatcgaggataaccgcctgatggtcttgattcgcgcattatagctctgacataattacgtttgcgtgctttaggcaaatccattaaaggagaatggcagaaaaccgtttgaatcaaagcatcacatttttctggcccatacactgttcgtttcatttctctacccccaactattcaggattaattcaggattttcgtgaatgttgccaataatctctggaatcatatcgtcccaaacatagtttctaaatccacctgtccatacgcaaaatccgccattaaaaaacataacttttccggtgtaatcagtgccttgataatcattttcacagtgaacaatgtcgccttcgaaaatcttattgccattaacatctttcaaaccagtatactgttcaaaaacaacgcgtgaatcgttaaaaacatcactaagaagtacaccataaacatcgtcataataaggaatatgatattccgtaatcattatttttctgcgtttatcccacgctctaaattccggtatcattcatcttcacctaactttctattacacatcgggcaataattgattgaaaatgcgtgcaatgcgtcagtgcttaccaattgacatttgctcaaattgatagccattgcatcaaaatcatcaataccttgaattactttgctaccccataagctctcattatcaaatcgactaccatcactatggcaatacgggcaattagcctgcttttcctctaattctgtcatttctctacctccaacaattcatatcttctatcccagtctagtcatcatacaactttaaattcttgattcgctcactgaggtagtattcgtagtcttccatggcgttcaactgcataccaagaagtgtacattgctcatctgagattgatgttaaatggccaatcgtattgtattcattcgccaccttgttatagaattttttcaatctttcaatttttccactcaattcggacttctcagtttctaggtctttaattacttgtttatttggtttcattattcaacctcctccacctcataaccgtctagccatgcacgggaaattatgtttgaaacctcattatctgtgtgtgtgtccatccagtcttcgatttgatcggtatcgtcttgtgtgaggtcttcaacggaaagcgtgtcatcaagtatcatcagcaatggagtgcctgcccgcttacatgtttcaatccactttgctaacgctttcggaatcaccggcagcttcttatacgttttctggaagatttcatccttaaccggccaatgctcaccgttaattcctgtggcaatccaatcaccgtcatagattctcatgtctccctcttttgtgggaatgataaagtagccatgataccgatcaacacctaatttggatgccttggcttcccattcatctggatcactacaatcatgatagattttgttccatttaatttcatcgaactgttcaaactcagtcgttcctgttttaatgtatttagtcatttaaatgaccccttcacggtgcaactgcttcaaccgttcttcctctgcgcggtaggtagcagctttctgtttgtcatgggtttcaatggccgtcttgcgtcccatccgccgttcatacttttcagcattaatgtggcagaacccaattgaccaagctaggtcatacataccgtgttccatcttccagaacagatcatgtccgttctcatccttgtagtaagttggtctaatttccattacatgccctcctacaatttaatttcgatatcggcttttttaatttgttgttcaattcgcttttgaagtcgcgattgcaactgttcagtgtcgatcgtaagtgaagctgtaatctcgccaattctaccttgtaccagttctctgatttggtcattaactgacccgctgtatttgttaaaggcgtctgcgataccttgtctaactgctgttgcaatttttttattaattgcctcttgaatttcttcgcggtggtcaaaaatatacttctccgttgccttttgtaattgttgcttagttacaatttccattacataccctccaatttcacatgtagctttttgcatttgtatacaacaagttcacgtgttatctggtttttcaatttactactgtttctgaaatattcgactgtatcatcgagtttaaatccgttcttgctaaatacttgtattacccaattaatgaatttaatttcacctttgctaaataattcattgagctgttcatgaagtacgtgatcacttattacaacgttaagttgtttagtttcaattggttcttcatgttcagaaaatacaatattctgtttttgagcacgttttctaattactgttttggtcattaatcgatgcataactggatcacgatttatttgtaacaatgttttctcaaacgtccaatgttgctcttgtgcttgtttgagataaacatcaatccgatgaccttcttcaacagtcagggcaaattgccctacccatcttcgatcttcagcttccacatttagtcaccatctttcagcaggtcagcctgaccgtctgcttctttgtttacactatcgacatcaagttctgtttgattgggcgtaatcttaattccgataatgctatcgagtgatcgtgttaactcatcaaatcggccatctagtaattcagtgtcaacttcaaagttaacttttgtgacgccttgtttagtcgggtggacgtctgttaagacagctcgtacttcaatgctgttgtcttttaattctgtcataataaattcctccaaattttatgtttgatttataagcccataataggtgttttaagagtttgttttgccttctggtatatttaccctcaaacgcgattagagttcccacaacatgctgtagtatgcgtaattctggtctcaaaattgattctgtgttcaaaggacgaatttagtttatgtttcttggttaaatatcaatcaataatttgtcgcttcaatccagtcataatctggatcagttctaacaattggattaggtgcttttccgtctttcgtagttcgcaattgcttagtcactccaattgctaccgacttgaaattatgagcacgaattacaactgcttcgactggtatgtgatacttcattgcaaatagcctaaaatatagcttattagccgtatcaataccatatggggtaaaactattcttaacgtcgtaaacgtgcttaaacgagccgtcaggtgccaatatgacgatgtcaggcgtatagctcacaccatagatacgagcacgtccaatgtcactgcctttgactagttcaaatttaagatgcaccttaactagttcgtgtggccatttgttcatgatgaaacgttcgtagaagtctagttctttctgactgtcccaattctcaccgtatttgtaaattttcttaccacgtttgtttagcgctgttgggctattcatttgactgttccttgtaaatcaataacgtgtactcggcttcaataacgtcttgccccaagaatgaactaacctcttttttgaacgttgtcgatacatcggttctatagcccaatgaatttaaacaattaatcttagccggcaattcatttacgctaacactgattgcatcaatcaatttcagtcctaaatttttagacttcatcagtctctccactcacccttctgttgttcctcattcaatgatcgatatagttgcgctaattcgatttgtattttttcttcatcgttttgtttgctgatatcaccgtcatatttagccttgagaatcatcagaaaatcattcaaatcttccaagtaacgccaccgttgtttatgttccgattctgctacccagatagcttcccagacggtttcaattcgtctttgttcataatgatccacgaacctatgaatcgtctcagatgactttgtatccagtgatttcagcatttgttttttcatacggttatagtgtgctgcacggttcagatagactttgaccgcaccagattctggataaccgtagtagttcataatttctttgtattggttgtaatccatatacgccatcatgtttgcttgatctccttgaacaacatttcggatccatcgaagtaaaagtcgatcttacctagatcgccttcccggttcttttgaatcagcagttgttcagcactgacgttgtcggcataaggtttgtgcaggaacgcaaccacattgctatcctgttcaatcgaaccggaatcacgtagatcacttagcaatggtgtcttgttgttgcgcgactcaattccacggctgagttgagcaagtgccacgatcggaatgtgtagatcattcgtgagcatcttcaactcacgtgtcactttctccagctttggtcgttgttcatcaattccttgtaccgaaatcaaaccgatatagtctacaattgccagatacttattggtcttgcacttagcggcgttctttttgatcgtctgcacaatctgatcaagcattggtgtggtgtcgtatacattgagtttatgatccttcaaccacttgattgcggaacgaaccacactcttctgaatgtcactcaatgaactggccgggtctcgtaatgactgtgacatgatgccagtatgtcgtgagatgaaccgattaagcatttcagccttacccatttccagtgtgaagtaatcgacctctagttttgaatcctgctgcaatgcttcgtaggctaggttgacgctgaatgccgttttaccaacgctaggccgagcaccaatggtgaacagcattgagccatacaatccaccacccacaatgtcgtctaacagatcaaatgtcttgattcctttttccacctggtggttcagccggtagtccaattgattcatcgcatcgtcaagacttccgtccgcggttgtatcctctgtgttgatcaagttgttcagcgattcgtacagtgcttctgcgttgtccgacactggcaatcgttgatactcactggcggcctctttcacttttcgagtcagtgcttgtttgcgaagttcactcacaatctgcggcaacatgtgtccagtgacaaacaggcggttcaaggagcttaggtcgtcatagttcaatccaaactgcggattcaggtaggacgccttgccccagatgttcagcaagctgtaatgctcagtgtctaattcgttgatggcctcgaccacacttcgatagttatgatccacaaaccattccgtgttgatgttcactgtatctagtagttgtggttcatgaagtaataccgttataacctgtcgttcaatttcctcgctattgattttcttcaccttcaaactcttttggatgttcagcaagatacttacggtcaaactcttcacgctgacgtcgtgctttttctttaacttgatccgctgacagatgcacaccatcatcctgtggttcagatgtatctaccggcatttcagtctggtattcgtcttcccatcctttctggttgaaccacgtaccaccttgacggatatattgcttatcacgtccctcgctagcaaccagttttcgataagcaactatgccatcttgtattgctttgtttgtagctccattcttgatggcacgtttgtatgcttttctcgcaacgtccttgccttcttttcgtggatacaacttccaaagcagttcaaaattctgttcaatttttgaattaccatcactgccagatgatgtagtgttttcttctttatcattcttatcattcttgttaggtgttaggtctttgttagctctttgtgaggtctttgttacttgctttgttaggtcagaattttcatcttggtaaaacgcccagttaacaacggttataaggcgccctgtctttgttgatttgtttgttagaaatcccaatttttcaaatcgttttagagaagtccttacattttgagatgatatattcttgcccgcttttgatttaatcgaatcaatcgaagtaataaattgaccgggcaaaacttcaaacttctcgcccaaccattcccactgcttgctcgaatgatttgccattgtcagtagagtgatcagcactactttctgttctggcgtcgataacatccagacaggatcatcaagtaatgatctgtacaatttcacccacccttgactgctcaactaaatcaccccaatcagaatggcaaatcgccaagcgccatgtttgccttccacaactttatttttcgctcaaatacttcttttatttcttggtactcggcttccgtgatcggatagcctttgttcaatagatcaattggcatgtttagttcatgctccaatcgatgttttacttttgtgtaagatagttttgccatgcttgccacctagaatgggaggtctttttctgaaatatcgattgaatcagcattcatacctgcttgagcgttctgtgcggcattgctgatctcatctgatttaaatttatgagcaacgtttggaaatttcgatacttcccactttttcacgtttaaattctgatacgtttttccttggtactctgattcttcatttttgacagtgatcaaaatagggcgatggtatagtttggcaaagtaatcttctggaaagctttcgaaatggaatttgtctggtaatccagatgcctctgcaaggctcatcaacatgcccttagggtactttccagtatctttcttaacaaaaatacgtcggaaaacatggtgacccttgaacttctggtcgctgatatcattgcgaataatcatgtcaatgttcataaattgagcaccgctctttgttgcgtcctctttaagcccgccgataactgcctcgtacgttccgtcatccggtgtagtgaaatctgttgcttctgagtaatctaaatcaaatcctgacattatttagttccttctttcttttctactttaggttctggctttttaccgaaatcaaacaattcttcgatcggtgctagtttgcgatcatcaaggcggttctttgcgaaaatagaatcgtcaccctgtaagatcacgcctcggccattagttttaggattaacaactacacgtccaacaacgtcagccattcccaatagtccatcacgtacgctcttgcgaatctgtggtgcatactggctaaatgtttgacccgtttcagttgtcacatcgttctgtgtctcccaagcggtcgttagtatgttgatgtctttcaatgaataagctgtgatcatgattcgtgcaaagtagttagtccattgactgtagtcttgcaattcattgctgattccgttgtgcgacttgcgtcccttttcaacaaaccaatctttctcaagcgatgagatattgtcgatcactaggttgtcatattgcttagctaactccggtgcctgtttcaaaaactcaactagttcttcttctggcttcgatcgatcaaactcgatcacatcaatatctaagccctcaagcacctttgctgaattatctaagtccaacactaacgttttgccctttaaatacttgatcgatgatgtcttaccaattccaggctttgaataaatgattactcgccaactcttatttcgtttgatattttttgcgtttgtaatttccacttatttatcctccggaatttttagttctctggctttgttgttcagttgccatgctgcttcgttgtatatcgcaattgtcaaatgttggattgcacgatcaatttcgtttgcacctcgtggcaattcagcacgagccaatcgtgccttttcactttcaaggcccttaattgcctcaccgtaagtgctatattgagcttcagccccttctactaagtcatccaataaactagccgtatgctcgtttaattcacctgacatactcattatttaatctcctccaattgttcaagtggtacttcacctcgatagcctttcaggagagctgtaacatacgcaccccgattaatcagacaaagcactgtaaatctatggttccggtacatcactggtgtatctggttgaatcattcgttctcctccctcgtgtatggtccaaagtattgattctctggattcaagtcatcctgctgttcagtagcagcgtcccagttaatatcctgattcatacttccaccccattagtcggttgaactcggctatcatcttttcgcgattctcaaacgctttagcgcagttcttgtactccattgattcaggatcaccgccaacccataacgtgtcagttaatagatggtcatgtgcgtaaatgcgccgcttcatttcacgggctttaactaattccattgctctattttcctttctgtgttaggattcgtttgaacgcttttttgattattgaccgatctgagttgcagcttagatcggtctttttgtatatgcaggatgtttccataagatatttatttttagcgatcgtttttatcaactccttatgggataattagttaaaataatattgtgaggtgtaatgatggatcctatgttaatgtccgctttttcaggagcgcttggtggcctaatgacaaaagcattcgatggccctttgaattctgttcaagatgtttggtttgcaaccgtgggatacaaaactgctctattaaggcaaaaagctgaggaacgcaacaaattacaaatagaagcctacgccaaggatattgcgtcagaggttgctaaaatccccgaaaactcgatcaaagaacccgactattcaatactcggcccagcgttcgaagcttccacatactacgtaaataacgaaacagtacgtggaatgtttgcaaaattagttgctagttcagttgataaacgaaaagaaaacgtaactagatctgcattcgttgaatttataaaacaaatgagcattattgatgcaggcttattaaagaaacttgccccaatgaactcggccccaatagccaatctgcaaacactgtttccaggcgatggaaatacaccttttaagtcagaaatagtatcaatggattttgaaaataatcttgtcattagaaaatccttgccatctgcgataattaatttagacagaatgggattgataaaggttgattactcaagctggaaaagctcatttaattatgatgaaaattttaagcaaactccggaatacatggaacttgatgcaaatattaagcaagaacatgtcaaatgttccaaaacgttggatgatattaaaacctttcatgtcaatgttaagcctggggctattccggccttagaaaaaatcattaaaacgaaagcatctattggaaaagggcaaatgtttcttaccaatttgggcgaagattttatctcagtttgtctttgatctttttaaatcttctaaaaaatgtctgtagctgtcttcatattcttgaaagaattttttcatccatatttcgttttgacgtaccattcggctgacgtaccattgactaataattgccgaaacagctatcgaaattaagattgttaatatgagcattacttttctccttccaaattcttaatataatcaagcaataggacattcatttctattgctttttttgcggcctcttctgcaattttgagtctcaacttgagttgcttaatttccttatcctgttctggattaatcatttttttatcatctccgtaaaactcacgtgtgccctaaccatccaaatcctcatcgtcgccatagatcatttcagcggtgagataaatcatgaagacaataggaagtgctaataaaattaataatcgtttaatcaaacagatcacccttacttgcgtgccaacctaaaaacccaccaatcaaaccaacgacgattacaaatccaatttgtgctactgccattgttaccaactccttttctgtacaccaacttcacacaaccacttatatacttttggccgtataaacactgtgtctcgaccttctaacttaatcattgcgttacttaagcccatttgctcaatgtagaaatcaatcacattacccttgcgacctaagtattcgtttagctccgttctgttcatgatcattggaaattgatcatccggtctgcgttcacttgctgccatgtgattcacctccttagtcgtctaaataaaggtcactcatgtctagtagatcagacatactaactaacgcttccatgtttagctctttcatgtcctctactgatgcgggctggttatcttgattcattactgcactggactggctgttaatatcgagtagaaactccaatgcttcacgtaaactttcgaattccattaagccacctcccgtttaattgcttgataccccttttcaaaatacagccactgtgggacttctttatcactgtaccgagacttgctgtttgaccaacggccatattcgttctgctcaggttgttcagcttttagccctaacttattagcaatacgacccaccatattcgctttgatgcctaacttgttaccaatatcagtcgccgtatattccttttgcttcatgactggaattgtcatttcaccggttaggacttcggcggctttggcatacagagtttgtgatgatgattcggaattagttgcctttgcaattttgaccatcaatgccgccttgcgcgtcttggcattttcttccataatttcaagtcgcttgttagcaactaacgatggttgattctcgtggattgcttgacgcatgttgaaatagttatcaactaattcatcgtagatatcccatgctgtatcatcttcaagaatttttagcagtttactgtagccacgttcggatagtacgtaaacatgttccgttcgattgcttccaatcaaacccatttcttgagcgaattgtctaaatggctcagacccatttagaagatcaataatatcgacaccatctttaaatcgtttacggttgtcattgattcgtcgattaatttcactcaatggttggttatgcagatttgcgatgtcttttgctgtcatcgacttcttgtctttaccgaacccaccttcgattccagtgaattcatatttaccgattctttcttttcctagtgcttgtagttccatttagtgaacctcctttttaaatcccatacttttcatgcaagtattcgtaaatctctgttactaatgattcagcacccttagtagtcatccgcttgttcaatgagagattcacaaatgtagttgatcttccaaaatgttcagcaagtgatccttgcgtttctaagtcgcgatggttagcaagccatgacttaattgcttccgccttgttgtttgtttccatatgaataaacatgtgtggcctccttttctttatttttattaagaaagttgttgtaattctctacaacatatcttagaatgtagacataacgaaataagccaacaaatccttatctatcgcccgtcaagatgatttataagtggtttttagtttggtcaatttcttaataacttttcttaacaaagactattctacaacatgttttagaatatagcaactaaaattctataacttctcttagattgtctttgatgatatcggaggaacactgaaatgacgctgtttgatagaatcaaagaaactgcccaaaaacgtggttactctattgcggaagtcgaacgcaaggcaggagttagtaccaattacatgtaccaatggaagaaacgaaaacccaatccagaaacacttgaatcggttgcgaaagttttgaatgtttccgttgaatatttactgggcagaaacgacacaccagaatgggctaccgaaaaagatacccatgatttgcagaaatttcttgaacaaaatgaagggtcgatgacctacggaggtgagaagcttaccgaagaagataaggaaaaactaaaaattgcaatgacacaaatattctggcgtcgtcataaacacaactagaggctcttattctatgaaaaaagaagacattattcgtacaaccaagttaatagtagatcgttaccaaacggctaatcctttccttctagctgaaaaattgaatgttgaagtagattggatgccacttggtaattttccattaggtaagactatttacgataattcagcgccactcattgtcctcaatgaaagaataaaaaataaacctatccagtatttcactttgtcccatgaattgggtcatgtaattttacaagaaggtttagtaggctactacgttggcgttcgatttggtcatgctaagttagaaaatgaagctaatgaatttgccgtttcacttttaggacaactctatattgaagaaaattacagaattcctaataactatttcgaactagttggctcttatggactaccagctgacaatataatctattaatattacgtccaaacgtgatcgacgctaaaagctactattggaggagtaacttatggcaaagaaaattcaaggtgacgatggtaaaacttatgtacagaaaaagccattctataaacgcgtttggttttgggtattagcaattgttgtaattattgtggttgcatctcaaatgaacggtggttcagattccaatagttcaaccgcttctgacaaaactagttcgtcaaaatccagttctgctagttcatcatctgaaaaagtcccaacagaatataaaaatgctctaattaaagccaagtcatatgcaacaacaatggatatgtctgaagctgcggttaaggatcaattaacttctgactccggcgaaggcttctcacaagaagctgcagattacgctatgagccatttaactgggatcgattggaataagaacgctctaaagaaagctaaagattatcaagaccaacaagcgatgtctccagattcaattaaagaacaactagtatcatcagctggcgagaaattcacacaagaacaagctgattatgctattcagcatttagatgattagaaaataaaaaagccatatcccctaaactttggccggttcaaggatatggctaaacgaatatttatggttaattgaattcgatgttaagatgtggggaatgataaatatatatggcaccaatatctaaaactctatgtatttttctagatgtaattagttttttattttcctttcccagtattttgaatgggaaagcttcctttagattcgttttattgctgcaattcactatattaattacacttcttggaattttaactgatactgtattgaagaaaaactatatcatttcctctttttcattgaaaaaatataccactaactcagttattatttatttatcaattattttaaccacaatgtcaataatcgtgctaatcatcgatcatacttcaggaccataaaaattgctgattaatcatatatttatgattacgtccactcccgatagacgctaaaagctggaaataaaaagccaacttctctcgtcaagaagttggcaaacgttcagattatactcaaactaatactcaattttttgttgctaaggaataaattatcttgattaagcatttaatttaagaaggtatgcctagtggaaattgaaatttttttattagttgtaatcattttaataatcatatgcctgtttataaaataataaaaaatgaggaggatcattatgaaaaaacaatttacaactgtcttatctatcgtcctattaattatagttgctatatttgcacttgttaacactgaaacagtaaaagtaaatcttttggttacccatttatcgctatcactcgttctcttgatttttttctgtgtactacttggagcactaataatctttctattctccattgctacaaatcttcgtaagcgaaaagaatacaagaaactagaagacgacaagaatgctgaaattaagcagcttcataaaaagattagcgacattaacaaagaaaatgatgccctaaatttaagacttaaaaactctgtcagcaagcaagacactgctaaataaaaaaagccatatcccccaccgaccaaagtttgggatacagctaaacgatagaaaacactattactagtggtgtctttgtgtactctattttagcacatggggacgaagctaaaaaggagaaatataatatggcaagttatgaaaaacgtggcaagaagacgcgtgttgttgtatctgtcacggaaggaacggttagaaagaaagttagtcgaacgttcgcaaccaagaaagaagctcaaaaatgggccaccaagatggaagctgaacgcaatgatggtgttagcattgttggctctaacatggcatttgcggactactacaagcaatggatgaaagtttacaagctgaacgatgtgaaagcaagcacggctcatatatacaatcagcaagcagctaccatcagtcgtatatttggcgatataacgatggcacaattaacgccattactattacaagctaagatggacgattacggtgaggataagcttaaaagcactgtaaatgacctgctagttaatattaaagcctcactacgagatggcctgtatgatggctatattacgcgcgacatatactcacgagttaaaccccacggtggcgctgaacgggttaagaaaaacaacgtcttgtctgcaacccaatttgagacgttgcagacctatttactggctcaccacgacgatttacgcgacttagctatacttgttatgctagagactggaatacgcgtaggagagtgtttagggctgaaatacagcgatgttaattcggtgtttgattttttggtaattaacaaaacgtactcatctaatgttcaaacaattacgactcctaaaactgctagcagtgttcgcaatataaaaatcactcatgagttagcagaaatgatcacagcacgaactgacagaaagaacgccactcgaatattcgaaactaccaccatgccaattcgtactcgcttgaacaacctcactaaacaacttgggctcactccaattactatccatggattacgtcattcacacgcttcgtatctgctctataagggtgtgtcgatcaattatgtatcagctcgattgggccataccaacaccacaattacacaattggtatacgctcacatgctagaggaagaacgggtcaatgaggcagacaaaacggtggaaatactgtccaagtccccaattgtccccaagaccaagatgacccattgatacatcaatgttttagaccccctctgtaaagattatgtaaatagaaagaataaaattaaaactacgcgcggtataataggaatctttatttttatgtggctttagaacctctatattggtgctagttgtcaccagcaaagtccccaagaataaaggtacgtagcacctacgccttaattggtataggtgctatttttatgcaaataaaaaagtcccctacccaattaaaggtagaggctaatttgaatggtgctccatttctatggacgagtgctccgtctcacgatctcgattggtcatagtatgcattttatttcaaacttataccaacttatcggataagtgtgaaataagctcgtgcaagctcatcaaaactatttttaaactggtcgaaatcgaccagtttagattatgcaatagtttataagccgtatctttacaaccacaaccatcagctgataagcccgtaaacctgattggaactgttaactgctgactgtaacccaccgccaaagtaccatcaacacagcgtctaactgaatagccctgccgaatcaagcaccttgaacaatagggtcatgtgccttgggcacccttgcgaacagtttaaatgctcctg

SEQ ID NO: 429 - DNA, 100312 bp, Unknown
  Metagenome-assembled genome
gtcatgagtaatcatgatcgttgtcacgtgatcctctatttaactgtcgtaaccagcgtgcacgatttgcttattattttcatccaaaccagctgtcacctatctaatacaacacttttggtaagaataagatgttgcgaatcagcgcgacccgctgccgttcaccaccggaaagctcgataatcggctgatgcagggttcgttcgggcagcccaacattatttaacgccgttaccactcgttgcgtatccatgacttgcttacgaatttgggacggaaagctaagttatctgccaccgtctcaccaaataaaagtcggttgttggaaacaatatggacttgccgccgatacatgattgggtcataactttcaatcggctgcccatcaaaaatcaaggtcccacttgttttagaaattggccgcaatgatccgtaataacgtacttttcccaccaccggatggtcccgtcaatggaatatgagcccagcggaatctgccaatcaacatcatgtaaaatatgttgatcagcgatttgataataactttttctaaactaatcaatgaattcatatgcccacccccgattactatttataatcattttcgcaccaatcccgatcgcacaatgatcggcgccgacaacagcggatgaaaaagtgctcagaagtcaataaattggacttatctgtttgatgtattaatacacgaacctgtgtagccattggcaagccatatgaatcatacctgagtcaaagtgtccgtataaactacggaggagttaattgaacttttaatttaatttatcattattttccttgatcgatcgtttttgtctagacatacgttttctcctatctagggagtattatatcattttataaaaaaacaacccccgttatctaactattagataatgggggttattttaatagtctttcctaggggtcattagttagaaatggaccctatttataattttgtacaagttcgaatagattatcttttattttgtttcgaacttttctaaaggcttgtagtttttctttttctgttccagtggcttttgcagggtcgggtaatggccaatgaatacttgtagcttgtggtggaataactggacatttatctcgtgcatcaccgcataaagtaacaattagattagctgaattgaagtaatttaaatcaatcagttttgaatactgctgactaatatcgacaccatcttctgccataacttgtactgcatttttgtttaaaccatgcttttctacgcccgcacttctaatttcaaatttatcggaaggaaaaagttcttttgcgtatccttcggccatttggcttcgacatgaattcccggtacagagaaaatagatttttttcatttggttactccttaatcataatattttcttttaatccatagtgctacatcaactaataagatcattaccggtacttcaaccattgggccaataacggcagcaaatgcttctccagaattcaagccaaatatagcgactgttactgcaacagctaattcaaagttattacttgcagcggtgaaagattgtgtcgcagaaattgaataactagttttagtctttttcgcaatccaaaaggttatgaagaacattaagacaaaatatagtaataaaggaacagcaattcttattgcgtccattggtagttgaactacttttgcacccttgacagaaaacatcactactattgtaaagagtaaagcccaagtagtaattctgcttatttttggtacatatttatcttcaaaccattctttaccctttgtgctaatgataaagtaacgagaaccaatgcccaaaatgaaaggaataccaagataaataaaaacacttttagcaatttcactcattgtaatattaattgtctgtgtttgtagcccaaagaattttggtaagacactaataaagaagtatgcataaacggaatatagcaaaatctgaaaaattgagttaaaagctactagaccagcagcataatcgttattaccctgcgctaattcattccacacaataaccatagcaatacaccgtgctaaaccgatcatgattaaaccaatcatatagtttggataattgtgtagaaagataacagcaagagcaaacattaaaatagggccaacgatccaattttgaactaatgaaaaagcaagttcctttttgtccttaaatacatcacccattttgccataattaactttggttagtggtggatatagcattaatattaagcctattgctattggaattgatgttgtaccgatagaccaactattaattattttagggagcgatggaaaagctaaaccgctaataattcccagtgccatagctaaaaatacccataaggtcatataacggtccatgaatgataaatttttagaagtacgcataatagccctccatatagatatttatctatgtataatgcaaaataaaaaagctaacagtttgaatgtgaatccttacatatgcaatggtcagttttagatagtatttgtgttaattcactaatcagtccttcttttttgtttgaatttaaagaataatagtgccacttagtatcttttcttacgttaactaatccacttttttccagaatactcatatggtgggatagagtcggttgtgtaaagttaaagtgtgcaagtatatcacacccacacatctcaccacaggacagcatttctaaaatcttaagacggttaggttcagcaaccacctttaaaagtgatgccaaatctttatactcatagtgcatcagtaaattcctccacattaaacatagacgattatctatattgtatcacatgaataatgaaaaagattgccgttcggacgaaattagattttttactattattacaaaaccagcagtattaatgtgttattcgccaaagccaaccatgtttttcttcatttgccgatttagctgttactttttgtggtaagtcaggttgtgtttgcttgtgagtagttaaatctaattgttgcgcctggtcagcaatcctatttgctgttgcaatctgttcatcttttacagttaattgccgccttaaattataagttaaaaacgacaataacaccaatcgacaagcaaagcttaaacttggttgtcgttcttgtcgttttttaaactaggtatcaatcttcaagctaaactataattgatttggttctggttgttgccaccaatgaatgttgctttaacagcaaatatcccgaattaacaacaactcaagtttgcatctagttttttccctaatggcttgttttgatacaccaaactcatcagcaagttctctaatagttttagaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcggggattaagcgccatctggcagttgatatcaatggctttccgcaggccattcacatgacgcgagcgaacgtctctgatcgagacggggccagtgcaatgatcgctttacatgccatgcatttacgccaggttcaaaatgtcttagttgatggtggttattcaggcgttaattttcagctcgatgtagccagtaatttaaacgcaaccgtgcaggttgcgaagcgcaatgagttgcatcgattcgaagtcatgccccaacgttgggtagtcgaacgatcttttagttggctagagaattgtcggcgactttggaaaaattgtgagcgtcaattaaccaccagtctgcaaatggtcgttttagcgtttttagcactattacttaagatattttagacagcttctaagtattttgacattaacaggcttctcaatgatcattgagaagcctgttactatctttatctaagtgtggattacgtgataagtcacaacgattaattacagcctaagataatcagaagaacaattcccattctaacgttagcaaagggcccatttctaaataaaaaagagccccatggacgattgcacgtagaagttatggaaactgagtggatacccatactttaaccaagcccaaaaattaattaaattgaataacttcactttttagacaatcctattggctattagtcactagaactcagattggtaaattaattgataacattggtgctcttaaaatgatatcaaataataaaaaattatgttacaattccacttagaagggaagtgtttattatgttaggaaaaagcgcagatttaggagactacggtccagcaccctttgcacctgatttaaaatcggctgctttggaaaatgaaaattatcgaactactttgtggaccggggatcattttcaaatcacattaatggctatcccagccggaggtggtgatattggtatggaaattcatcatggtaatgatcaacttatttacttagtagccggtattggccacgttaaaatggggaaagataaagatcatttaacagttgatcaggaaattcatccgggagaggctgtagttgttcctgataacacttggcataacgtgatcaacgctggaaaacagaccatgaaggtcttctctatttattcaccggtcaagcaccaaaaaggaactaatgaagccactaaagccgatgcaattaagcaggagggccctctggagggtactggtgaataagacaaattatttatcaaaagatatgatttatgtcaagaactaatggtattatttgataaataatttgaattagaattttttctgaactatgcaattaataattttttagttgcatttagcaatcgggacttatacaaccgaaagagtggaacatagttccacccttttaatttcaaaatatgtaaagagctgttataaaaatttttagtggaatttttataacagctctttattttttacacttgaatttacactttaagtgcaacactaattaaataaagaatggcccatggccaaatttctgtaaaatgatgtttgcgaaaacaatcatgaaaggaatttagccatggatcactacaagcatattaccatagatgaacgggaaactatctttttaatgaggaatcatggaaactcacttcgtgagattgccagcaatatcaagaaaagttactcaaccatttctcgagaattaagccgtaattctactggtaaatcctattcaccttcgaaggctcaggagaagtacaaacagcgcaaaggcaactgtggcagagtctctcttttgagtaatcctcaggtgtttgaagtggtgagagaacacttctgcgaagacctttggtctccggaggaaatatcgaatcgcttggcagtcgaaaagtatccggtgcagatcagtaccacgactatttaccgtgggattttcaatggcttatttgataatttgtttaaatctggcagctctagtgccgtgcgccatctaaggcatcacggcaagtctcgccacaataaagcttatcaggaaaaacgaggcacgattccaatccccaacaagattcatgatcgtccgcgagaagctgacaaccgtgtagaaattggtcactgggaaggtgataccgtgttaggcaaaagcggaaaggcttgtgtcgttacattggttgaccgaaaatctcgttacctgcttattggtaaagctgctaaaagaacttcagaagcagtcacggatactttgagcgacttaatgaagctatggactggtagatcgttaacgattaccccggatagggggtaaagagtttgccaaagttcaatgtttaactgataagtttggtacgcccttctactttcccgatcctcactctccttggcaacgaggaactaacgaaaatactaacggcttgcttcgcgaatatttgccaaaaggaactgaccttgattcaattaccgaccgccggatacaagcatatgcagaacaaatgaataatcgtccccgtaaatgtctcggatggaaaacgccttatgaaatattctttaatgtagtgttgcacttaatttgacaattcaagattttacatttagattacaagtgcatgcccccatcttcatgccggtttcgagtttggtgttgccgttgctttttcgtcatttcccactcagtctcctttaaaccttgcgcctgtctttgtcgttggtaatcttcatcacgagcatatagaacagtcatgatcgcgtcactaaaggccgtctttaagtaatagtctggactaactggcttgtaatttagcggttgataatgtccgatattttcttttctgtactggtcgtccttggcttgttgcccttttaactgcttttggattttctcgatctgactgttcttaatcgtcggatcggctttgcattcgccaaaaaagagttgtttagtgccatcatgctttaaaacccgttgtaagtgatgattttctaactgatctaagctaagctgtcccgataaataagctagtccttgttgatgttcttggggactgaacacctgtggtggatttgcttgccactgttcaattgtttcagcctgacatggctttaaaacaggatcatagtacatcacggctgtataggcttgttcctgtttaatcaatggcaatccatctaaatcgcctttgggaaaggcccttcttaaaacttcctggtattgggtttgaataacttgcttaacagccatgattgttcgtaaatctttgactgcgcgagtaatcttttgctgctcggttggtgaatacttttctagtagaccttgatcaacgtgttctagactttctaagctatcatcatgaatcatcagcgtatatttaagctcgattttgacttccttttcttgttgcattaataacttccagccaacgtatggccgtttggtaaaggtcaataattgtcggaccaataaatcatcacgaatattcattaaacgttcgtttaattcactgcctttgaaaatcgtttgttcactattagtttctttaatcaattcccgtcgttcagccgcggttgtctgttcaaaatcaagctctggataaagttttttagtcgtgcgatcaactactttatttaagagttcatctgctttttttagtgaactttcttgttggttaatcgtcaataattgcttagtgacatcttcaccaacagcgtgcttaattaaggtactgtttttccaattaaatagcatgcgccgcttatcatctaaactttccaaactaatataagttttcagttcgtggcttaactctttgaccacttttttctcgttaaacgagaagtgtttacttaggctatccaagtggcctcgattaactactttctcctgcatatttttatagccagctttggacttacgatagttcttaacttgttgattaaatgcctttctttcatgccgtttgctattgattccctcgtgttgcattggtgtgtcagctattccctgttccacaaatgatttttcactgatccgatcaggaatgtttttttgctctaaagcctgatttacacttgccgcccaattgtgccgccattcagttattttttcttttttatcccaatcgaccatcagtatctttctactcttagggtacttgctagttccggtatatgttttgttgccattatcatctaaaatatattgctttttgctcttaattccccatgttccatctgaattaaacggccgattagttaacatcacatgagcgtgcggattatctgggtggtcgcgatgaattgcgacgtcggctaccatgccctcatcaacaaaattttcttgcacatattttgtcagtaattctttctgttcagattcacttaattctaccggtaaagccacattaaactcttttgcataccgtgagtttgatttacgatctttcttttcaacttcattccacaactgctctcgatcactcgcccattcaggtgaattttttggcgtcaaaataaagctttctggcatgatcgatcgggcataaaaatagtggcgaccttccttatcatcaaatagcttttcaccacttcgataagcggcactggcaatcgcacttcgtcctttaccagcactaatattactaaaactcatgtggaatattgccatgtcagtcaccgtcttcctttgattctatgggttttgaccttgttgtcaccatcggcgacttctaatacaggattttagcacgatttaccccacaagaatttagtggggtgtaagtgcgcattgacctcgtttcactcgatcttctgattctcttaactttaacttagtgtatgccttccgcttcgctatttcaaattttatactttgaattaacattccttatgtgatatagtttcggtgattatttctaatatgattggagggatcgttatgtctcaaagtaacttagaaaaacaagaagctaaattaaaaacccttaatcaaaaaattaaggacgaaaaaaataagattgaacaacggctaggtaaacaaatcatcagtcaagccaatttagattatgctaatttgtctaacgatcagattaagcttttagccaagcaattttctgaatttttaaaggtaaagtccgtagatcattagccatacgagatggggaaattccatgtctaatcaatatgaaaaactagtcaagcagcaagcgcgtttaaaacaagaaattgagcgagaagattttaaattacggcaatctaaatactacgaaaatcggcaagcccgcaaagctcgttctcgccgattaattcaaaaaggggctttgctcgaaaaatactttcaagcggataatttatcagtagaacaaaccgaagaacttttaaaaatatttgccgactatgttaatgcgcataaaccaaataagctaaaaaacgatcaacctaataattaggtctatcgtttttattttctgcgtcattcattggatttttaatttttaaatctgagttatctttaacaaagtctttgagtttattttgggttctcttactaatctcttctttaaccatttcaagctctaattggttcttttttttagcttttttgtacatctcgttcaactcattagcactcatttttttgtctgcgcgaatctctaatccttgaatcgcattgtcatacgtccactgtttaattttattcatgtcattagtccggtaataatcagcaattaaattgttccaatgatcccactggtctaacgggacattgattaacccagcgccaccatcgatcatgattttattggcgcttagagtggctgtccgtttatttccatcccaaaagatctgttgtcgcatattatgatacaaaaccgtcaaagctttatcagtcgtagttgtctgggaattagccaatgttttttgtaaaaatatttgttcctcttgttcatcaaccaagggtggctcaaaaaactcttcgcttcctaagtcgaccccaccttgtccttgacgtagctctccaggaactaaggcgtcttccgctgccacaaccttgttgattttcttttctatggttaacgttaatggctcatttagcgtggtaatatattgccaaccacgttttaaattaacaatcgttaatacatcttctactggcaccccggccacactcataccgtccatgatggtttgcgtttgtggcaacgtcgtattgacaccctcaaagcgagaatttgtatgcactaacttagtaaagtttgaacgtgcaaatcgtttgttttctgcgggggtaaaatgatatcgatcctcatacacttgatttttagtcatgttctagccttccttctacattttttcaaatattgttcttccgtgttagatcacaaagtgtttttcgttgataatatcttcttgcctcttatccaacacgtacgtgtataaagcgtcaaagagcttccgtttgtccgggtcgggattatccgccgcttgctgccaaagttcctcaatatcaactgcccaggggtcagccaacaattgctctatcttttcgcctgctttgagtggtttattcatttgaaaagcccccttcatgttcagctacttatccagtatatgccgtttaagccacttatttgctattctaagcgcttttaaactgtctccagaatttagtcctcatgcaattaaaacactggatataagcttgtacaggccattaattccaagcatgatcgttattagccttttcgaggtgcttggcggcataatctctagcagcttgtttattccaccaaaccccaaatagattttgcatggtgccgtataggtaattctcaacgtctttgatatgtttctcattaattctaagggcgttaaagtagcgtcttaaagtcttggtcatcaagtggattgaagtcaatatttgagacaggttttaagagacattcagaaccgcgtttaccttccacagctcaaataaatcattaatcgtgattaataacttatttgaaccatggaaagcattaaatcaggcggccatttggctcgtaagtgttgcgatttcaacttgtaagggggtctggtagccctaataacaagatattttttgtacaaactagctaaatacttatattttaatgaaatttatcttcctcgtgtctaatagtttgatcggtattataaatgtcccacattgtattttcgatatcgttcgctccttgattgtgttcacccggttttccctttcgactgctaaaacctaagtcatttcctgacatccaatccacaataaataggaatccacgaaaaatcgcatagaaaaagatacctgccaaaagaatccctaaaagggcttgccacaattctaaaatggtaataataattgcagcaattatcacaaaaattatccgtcgacgtctcaagatttgtttcctatcgtcttcattcatccaatatcaccatcaattctattaagcacctaatatttgctatcttttaatgctatcccactactcatcatataaaacacaacatcaaacattaaataaatgccactacttggtacctgaattgtagctgttaagtggtactatttcaatacaactgataattgtgggctgtataaaaaatatatttttatgaattatttcaaaattatccatatctaagcaagatatagtaacgtaatttatatcggctagcaccaacgttaaattgattaggcgtaaaaattatggctatatggtagattgcaaatttaatccgaacgctgttcggacaaaaaagatcagcttcctttaaaatggtgtttaccacaaacccattttttaggagctgatcttttgtctagtataacctattctgaacgaattaaaattgaaaccttttgtgagctaggactgaccaatatccaaatggctgagcggttaaaacgatctccgtctacgatttcttatgaattatctcgttgtcaaccttatcaagctgaattagcacaggccaacgctgaatataaacgggcgcattgtggccgaaaaactaaactgaatgccaaattaaagcaaaccattctaaaccatttacgtctaagctggtcaccggaagtgattgcgcatgagcttaaactagccactaaatctatttataattggctatatcaggggaaaattgaattctccttgagtgaactacctgaacatgggctacgccaacggcgtaaccttgacaaacgttctaaatataatcaatcattagggcgttcaattgaacaacgaccaattgtgattaaccaacgtaaccgcatcggtgattttgaaatagatacagtggttggacctcgtggacatagcaaggctgctttattaacgctaattgatcgcaaatcacgttttctttgggcttaccgattaaaagatcggacagcggcgactgttaatgaagccctaactatgtttctaacaacttttaagggaccgatacacacctttactgtcgatcgtggaactgagtttagcaatctagtgtcatttgaaccacaatacggtattcatacctattactgccatgcttacacgcccgctgaacgcggcagaaatgaacgattcaatcggaacttacgttatttttaccctaaggggacttgttttgagcacattagtgctcaagatttaacaacgacgttactcgaaattaaccagcgcccccttaaagtacttaattggcaaacaccttaccaagtgatgctgactaatttgtcaaaaaattcggattaaatttgcaatctaccatgtttccgctatcattaatagtgacgaatgacaacgataatcgaattacggaggaataaacgatgcagaattatcagaatgcaccattcaaacctacccccgagtccggtttaacgaccacagcggtgacgacccagctaactaaattcggcaaaaatgaattagtggctgcgcgccccgtaccgttatggcgtaaaattgggcaacatatgagcgacgtttcatcgctagtgttattatttgcagttggtttagccacgtacttggctcttgcccagaatgggggctggacaaagaccattgtgattggcgccattttagttattaatgtctgtattggtttgtaccaagaagcttccgcagaaaagtcgttggcggcactgaagtcaatgagtttacccacagctaatgttcgacgggatgggaaggtacaaacgattgcggcaccagaaatcgttcccggtgatttagtgctactaaaagcgggtgaccaggttccagccgatgcggtcgtgttagaggccacgaacttagccgttgatgaggcagtcttgacaggtgaaagtgaagctgttgaaaaaagtatttatcaggacaccggtgagttggatgataactgtcaagtgtatgcgggaacggccgtcacagccggtactgcattgattcaggtcttaacgaccggaatggccacagagttaggtcaaattgcaggtttgttgaacaagacgaagcaacgggccacgccattacaggggcggcttaatcggctatcaagctggttaacgacatttgctgtcttaggtggtattacgatttttgcgctgagtgtttgggtgcaaaaccaaggtttggccgatagcttgatgattggggtttcattagcggtcgcggccgtgccagagactctgccgatcatcatgaccattagtctttcacacggtgttcgacggatggcagacagaaatgccatcatgcgccgagttagtgccgttgaaacgattgggagtatcgatgtaatcgcgtctgacaagaccggaaccttgacgcaaaatcgaatgacaattacaaagtattggacgccgaccacgggcattatgacgaccgaacagcccttgccatcagcgggacaaacattgatgcgttacttaggattagcgacgaatgccgagatcaaccatgttgacggtgaagaacaagctattggggacgcaacggaattagccgttattcgttggctggctcagcatgatttagatcggcccagcttggaggcgcaagccccacgaattgcggaagacccgtttgactcgactaagaagatgatgacgacggtgcataaattagcgcatggtcgacggttagttatcgtcaaaggggcttgggatcggttaccactgaagcctgaccaagctagcctagctgctggacaagtggcccatgatgaatttgggcaggcggcgctacgcgttttagctgttggctatcgcatcattcccgcggatgtccaaactactgactgggacggcctgacagctgacctccaattggcaggattgattggtttgattgatccaccacgaccagaagtgattccggccattcgagcagccaaacaggcgggtatttttccagttatgatcacgggagatcatttggttactgcgaaggctatcgctgaggaaattggcattttgacccctgagctgcaagcaattagcggtgatgagttacgccaattgagcgatgaagaattgacggctcaaatcgatcagattgcagtgtacgcccgagtgtcgccgagtgacaaaattagaatcgttcaggcttggcaaagtcttggtaagacggttgcgatgaccggtgatggtgtcaacgatgcgccggcattgaaagcggcggatgttggcattgcaatgggaattacgggtaccgaagtatctaaagaagccgctgacatggtgttaacggatgataattttgcgacgatcatggcagcagttaaggaaggtcggacagtttatcagaatatcattaaagccgttgaattcttggtaggtgtcaactttgcacaaatcttcttgatggttggtgcagtcctcttcggttggggggcgccactgttagcagaacaattgctgattattaacgtacttgctgatgggattccaggattctttattagccaagagccaggtgaaccccaagccatgcaacaaccaccagtatccaatgacgaaagtattttagctcggggccttggtcaacggttatttatccgggcagctacttttaccgtactaaccctcggaatttacgcgtttggccgctttggcttaacaaatggtcaagccccagtcgggatgacgatggtctttctagtattggcattaggatcaatgatcgacatctatgcaattaaggatcgccgaccactcagctggtcaagcatgacgcgtaatccaatgctgaaccgaggattgctgttaggaattctggtggtcttggcaattgcagttataccaccgttccgtagtttctttagcttagtgacactaccagcgttaggctggttaacggtgctagtagctacgctgattccaacattcgtgctggaattgaataagcgctagcaggcgcggcgacagtcacgattagtcgtgaatactgctgaataaggatgatcaattcaagttagttaaaatgctgcttgcaaacgttattcgtttgcaagcagcattttttcgtgtcgttaagttatgtgcctaaaatactggccggtgagcgggcttagaacgtaagtcatcacaattgtaggcagataattctttcagaccatctttacaatctaccatgttattaagttaatccggataaagttgtaaattcagagtgtaccctaaatggacaataaacgttatactaagaatataggaaaaaactgagattctatcgggcacggtaagcgattcttgaatctgttaaaaatgtccaatttgagtgtctaatctgttaccgataatgtagggtcaaattccgagaggagaagtcgtgatgaaaattgggtatgcccgagttagttcaactgatcagaatttagcgcgtcaaatcaaagcacttaagaaagctgagtgtgaaaaaatattcgaagaaaagcaatcgggaaaatcaaccgaaaatcgaccagaattacaagcagccattgcgtatgttcgacagggcgatacgctggtcattgcgtccttggatcgtttgagtcgtaactatgatgatgccagtgatatcatcaagcagatcagggacaaacaagttaagatggaagtcttagatgcgccatttctttctatgcgcaccggcgattcagatatggataaatttatgtttgacctgttaaccaaactgctagcttatatggcccaaacggaacggaagaaaattcgtgagcgccagcgtcaaggaattgaaatcgccaaagccaatgggaaatatcgggggacgcggcccgcttacgccgcagacgcacctaacccacaaaaacgatttatctaccgccgtatcgttgatcaattaagaaacaaagcaaccggtgccccaattagctatcgtgcaattgcagctgaaaccggtgtagcagtgcagacagtaattaatattaaaaatcggttggtatagctgttaaataagcgttatctgagcacacgttcgttatttttaacggacgattatttgagtgaaatctgagggattgtttgatctgcttaagggtttcatatcacgagtaggacttcagtttagagatactaatgcgattaatatttaggttacttattttgcgttcaattagcctaaaaaatgagttaacgaagcttttcgttaatagcttacggctactaatttcgttgctcacattaataaatggcttataagcatacattatgatgttttgccactttcagctatagattaaaaaaaatcaggccacaattattaagttgtgtcacttatctctatactttaaactttaggatgtttgacatagagtcccaaaatgaccgtctactttttggtaggcggtcattttggtagatgcgaagcacgaatttgctactacgccactttcttcacgaattcttttggtaacgtcaatgccagcagaaagccaatcaggcccacaccagcaaacacagcgaaggtaacagcaaaaccgccagcatgacttcgcagcgtgttttgcatgccctccaacaacactgtggcgaacatgacaccggcagaaccgaataactgacgagccgtcgttgtgaccgcagtgccgtctgccacaagctcattcggcaaggcattcgcgccagccgtcactgaaggcatcatcacaaaggcattgccggcttcagtcgccatcgccaacataattgccccaatcagtggtaaatgatgggcaaagactgctaacagaccaaagccgccagtaatcaacaacatgccaatcatggccacgatacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaaccaaccacgccaacagttaagccttttttcgacaaagcacccaaggcataaagtagaattggaaaacttgcggataaaaggaaggagacccagtccagttgcgtcggttgcaatggcatgacagacgcaatggtcaccgttgaaacggccagcacaagcagcgaaacgaccaagaagaacaagaataaagcctgccaagggaaccatgtcagtaaaacaccggaaataatcggaccgactgccaaggctgagcccatgaccaatcccgccgtgcccatcacccgaccacgctcactatgcggcgtaatcgtcagcaacacggtctggaaactcgggaaaataatcccgatcgcaatcgcttcaagcaaccggccaatcatgagcacggtaaaactcggtgcccagatacataagcctgtcccaatggcaaaaatgagttcaatcgcttggaaaagccgttggaaaggaacattatgcaacagccatggactaaccggaatcatcaaggtcatcaccaacataaagccggttgtcagccaagcaactgtatccgctcctaaaccaaaagctttcataaaagcaggataagcggtgcttaaagaagactgcgaaattgacatcgaaaaggtacctgtcagtaacgtggcgacaaaagccccgcgatgtttgatcgttggagagtgcatattaaaatcatctttttctatattagtattgtgggacgtttacattttcattcccattttttcataagactgcataccgcccatccaaatctcagatggtttgacgccacgttctttagccaaggccatcattaacgtatccatatccatcaatttatattcttgctttggcttggctggatcgaaagtttcaatctgtgccatcatgccgccatcttcgtgctcaatgatatgacagtgatacatataaatccctggcagatcaaagcgaaccagcagccgaactgtttccccaggattcacgccaacggtgtctttgaaaccatgttcatttggatacggcgcatgcccattccgcgacaagactaagaattgggttccatgcacatggaatggatgaaccattccaggcgcatcattgctattggtaacatcccagtactgggctttgccaattggctgcgtggcatcaatccgctgcatggcaaactttttaccatcgatcgcaacactttcgtccattccctgcatcacaacatggcgaactggcaaagctaggtcaaccactggcaccttcacgtcgaacaacttatctggtaaagtcgtctgattcggtttgaacgcatgaatgcgaaactttaacaatggcacattatccgtatataaggtgaccacatcgccttcatggtactgcccaaaatcaaccacaacttcggcacgctcagcacaagtcagcattagatgggtgaatttgaccggttccggtaacaatgagccatctccgccaatttgcgtaaatggcaggtcatcggaaaaatgcaaccgccattcacggcgattagcaccatccagaaaacgcaaccggaccttttgcgtggtgacatcaaaatagggattgattgtaccgttaatcattgcggttggcccagcaacaccgtcaggatcataatcagcccggtagtcccactggttgttctcgtgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttggtccaatgtgaagtcgatatgcttactttcacccggataaaccggcgcatggcatccgccatcaacataagggccactgacattagccccatgccaatgaaaagtggtcaactcaggcagggtgtttttcagtgtcacatgtgtatgttgaccacggcgatacacaatcgtctgacctaacagactggcattatagccccacgtcttggtcttcgcccctggcaacagttgtgtttccccagcctctgttgtcaccgtgtaataaacgtcggtcgctgtctctttatccggtttcaacaacggcggcacatttaagtgcttttcaggcgcatcactgacctcaagcggcacgtacccaccatcgtggagatcaaacgctggttcatcaaagaaatagtccgtataggttttcattgtgatttctcccttcaaatgcgttatcagccgcacaaacctgtacataagaaccacaatcgcaatggccaaagtgcggtccaccgcacttgttcccgcttatgctatggtttctaacagcggctgataacgctctgaatcaaattctaacactttttagggttgcccaaaaaaaaatttagaattaatataaagtagtagcgaaaaatggtataggtcctatccatacacttgaggaggattttcatgcaacaaatgtcgaaaacaatgggctggctcatgctggcgttaaatgtggtgctgctgattctaattggtactatgcacaatatggcagcaatgtggttaatgggtctgattatgactttggacgctgtgacagggttagttgccgcttatcggccccagtcaagtcagcagcacaccaaccagcactagtttatctagactgcataattaaaattaccacccagaaaacttaaaaaagacctgtccctgcactatgccctgtcaacttgacagggcatagtgcaatgtgttgcgttgtttgctttttaattttttaaataccaccaagtacctaacccacaagtaagcgcaataatcgggcctccaatcgcttgcccatagtgaagttgatttaggaattgattgattcagaaaaccaggaacctaagtagcaaatcaatcacaataaaaatacacaataattagtggctggtgaattagccctcattttcaactgaatcgacgataacttgataatcaatcttcaccgcagtcttattctttttggcggtcactgaaattggtccacctaagactgcgagtaaattctctaggtttgccgtgaccacaccagtgtctacggcgaccgcaatcgtctcggcagtcttctctttgacaagatccagtccgagattcccctttacaaacgagaatcagcgttcaatttcgccgcgccggttctctgcatcttgatcttgccggcgctgcgctggatccacatgcttgggcttacgtccaagccgcggtccactcacgcggataccaaggttggcacacatcccaatgttttcgcgggttcgatacagcgtgtccaacagcacctcgtctggatattcgccatgcacatcgtaatagtgatcaagcgttgagccaaggtcaccgctttcgttgaaggcattgaacgagaaccgttcaatatcaatgacaccatccatgatcgaaacatcgatcttcggtccaaattcaaccggcgactttgatttaccacgcatgatcggacgaatttccggctgactcaagctgacgatccggttttcaacacgatgtgtgtggttgcgatacatgtaatcttgttagtcaaacaccaaacgaatgaccccaagccgcttggcccgcgccgcagtcaaggtcgccccttggtcgatcatcccatccacgtaccgcaagtcgcgacgaatgtattggagctgggctttgatttgcttttgcgtcaactttccccaacgccgaggcttacgagaaaagaccgtccactttgcgtgagcttcacgtttgtaagtccgaggcggggagacttgaagctgtttagccatgactttaatgtcatcttctagattcgttctcacctggttaagcagatgcatatcttgaggaaacttgatgtttactggtgtgcacgtggcgtcggtgatcatcaccgacttggttggtaagtggcgttgaagtcgctcgcgaactgcatcggtgataatattgcggatcaattcagaaatcggcgcgatccgtcgacggaagtacgctagtgccgtgtgatcgaacgggactttgagttggtattgcggaatgccaatgaagtattgatcagctgggacccatataacagcctgaacggtttaccagcacggccaagtttcgacggaaaggctaattggtatgcctcagtcagtttctgccaaggcatttggattgaagtcaatatttgagacaggttttaagagacattcagaaccgcgtttaccttccacagctcaaataaatcattaatcgtgattaataacttatttgaaccatggaagaaagcattagtcaagcggccatttggctcgtaagtgttgcgatttcaacttgtagggggtctggtagcccagtgaactatgaattctcttcctattgtagaaaagcatgcacatcttcaaaaaggacagcagcggcagtttcataattctcaaagaccggcactggataaatacattccttttgagggaagcatgaaaagattccattgtgcattatcgtatggacaccccttacggttgtaagttggcggatatgtagttctgttaaccgttggttgtaatcatcgctggtgtactgtgatctaagtctgtgtggatatcagtccccagtaatggttcgatttttaaccggctttccagggtcttaagactaaatcagtatccatcttttttgggaatgatagccgataattcgtcttgagtggcagatccatgatggttgataagtaacaccagccattacgcttcgtttgaatataggtcatatcagcggtccatttttgatttaaaccagtggtcagaaatcctgcttaagcaagttggggacgctgttcaaccttggttttggaagccgaagccgctttcctttattgacggtaacggagtggatatccagttccttcatgagccggaaatccgtcgtggactgcatcgaactgcagtggtgaagttccagattcaattcatggtggatcttcataacaccgtatcgctgcttaaattccgcaaagatccgcagaatccgttgtttcaagtccgcatcttcggcccggcgtttttgaaggtttgggggatcgataacgataatactgagctctggaaacaccgaggattcggcacatcttagttacctggtggtgatggctttcttggtgaatgtaatcaaaaatattggttactttctgcgcagaagcccagggctttttttagatttcgttcccctcagacagcgaagccagccgcttttccatcgctttaaatttcgttcgcgtctggcgatttaccggattgagttttggcctggccctggatccacttatgaacggttgaatagccaatgccatattctctggccagttgggtggctgattcgccttgtttatataggttgataatgttttgtttgaattctttgtcgtaacgagttggcatgtaaaaattccttccttttgagagacgatttattcattatacgctctcttaaaagttgtctcaggaatcagcttacatccaaatgataaagaagacgaaaaatatcagtgtgacgcaactagtgacttgttggaagcaactaaagatttagaacaacttcaaattacatcaataaagtgaggtaactatgccggatatcaaatattatggacagttgctaagatgttaagtggcattaaagtgatgtatcaattacacaaaacaagtcaaatagaacctaatctcttcggcttttcggcgtcataagctttggataaattaatagcaggttaacgttataattaagaccaatgcactgtaacttaatcaattttttgtttttgtaccagatcctgggtttgtagtaaatacgattttaaaggaagctgatctttttgtccgaatagcgtttggattaattgatgccgactctaaaaagttttgtgagcgttaccttaacaccaattgtcagatgttaatattagccttcctatctatttttttgaggaaagtttaaacaagtttttataatttaggtatatgcttgtcaataaattcctttacgggaagtcgaaaatcaagatagtgcttatcaatatctttacgtgaccaattccaccatgcaattttttccagatcagtctttatttcatcggaaaatctatccttgattattcttgcaggtactccacctacaattgtgtaaggagcaacatctttagtaacgacggctcctgaaccaattactgcaccattacccacagttaaaccagcttgtataattgcaccatgtcctatccaaacatcgttaccaataattgtttttatttgggttctttttgatagaaattttttatctggattgttgaatccataagcttctccattgtataacgagatatgttgagctggtctatcataaggatggttagttggaccaattcggaccattgctgccatactgataaatttttttaaattactattttggataaagcaatactgtcctgtatatgtatagtcgcctattttactattatcaatgagattactctccccaatttctatccattgcccaaaagttgtgttttttattttcgttccttttccaattgttggactattctgtgataaactgacttgttctatatgcataaaaatcaactactttcattaaatgtttgttgttataatatgcttatattcaataaatataaagcaaaaagggggtatatatgtgtatacagttaaaataattgatcacttcgatctaggcgattctgcgggtgatatctttcaaaaatctgatactgacgtaccagacgtaatacttgttagaagttctcatgttgctgactctttaatctctgaacatttattattggttgcacgatcaggaactggtataaataacattaatattcaagccttcactgaaaatgggactgcaatttttaacactcctggtataaatgctaatgctgtcaaagaattaatcatccaaaatctgtttcgttgtattcgacccattgaggaagcatcctcaatggtagaacaacttcatggaacaatggagaaaaatcttcaggaaacagcggaagcaagaagaaagtattacattggtcacgaaatttatgggaaaacgttgggaattattggattgggaaccattgggcaacgactagcagacacatgctatcatatgggaatgaagattattggatataaccgtagtttcaagaatttaagtcatgttcaacaagtagaaaccatagaagaggttatgactctttcagattttgtagttctattattaccattaactccaaaaacgaatcaactaatcacacgtaaatatctaaaattgatgaaacaatcagcttttttgttaaattttggacgcggtgagcttgttgacaaccaggcacttattaaatcgttagataataatgaatttgctggatatataagtgattttcctaaagatgaacttcagcataataaaaaaattaccttattgccacatttaggtggcaacacaattgaatcgttaacacatagtgctaatataaccctacaaaatttattggcttttttagaaaatggcactgttcgatcatctatcaactttccaacagttgatttgccatttaatagtccacatcgtttaactttcttttttaaaacaaacaaaaatttaatagttaaaatttcatctctactaaacaagcaggggttaccaatactagaaatgatgaataacaattatgatggatacggatatttaattgtgaatacagatttttctgacttatctgttagacaaattacaagtttaattgatatattttcatctatggaaggcatgattcgagttcgcaaattagataaccataatggactcctataatagattacacaaagtataccccctaaccattacggctaagggggttttatttcgtaactttgtgaagttaaattggtataggtcaagtaacgttctgaaaccttgagttaccaccattctcattttctaaaagttagtgaaatatatccattaattcttcaggcactttaggacaacttgacacatgatgtgtaaattctgaccataataatattaatatgtattgatccttggcttcttccagcaaccctaaatcaacttcccatggaaactcggcaccgaagtattcttggcaaaacatctttaagtaattgtaagttaatcctctaatctccataactaagcactccttttctgttgacttagtgggttacacctgcttgattgagaggctggttgagcggtgaatggcaaagttgtaccctagtcacgagcaaattttaaaaataagcgtcgcactagagtgcaacttaactgctacttgaccgatcggccgtctcacgtattttagttaacctcgtagctgctgtctcttcgacaaaccgcattcccttacaattactgccctgtaagcattgaatacaatcaccgtgctcgtaagcaccagtaaaccgccctgacccttattggtggtcaccaccattcatcacccacaacacgaggtcgttgcttatgtgatatagccagttgttattgcggtcgcactggcaaacgtgtctatttggtttggactttatccatgcaggttggcttctacattgtcaaaattcgtcacgcgtgatacaatacaattaaatttgtgttcttgtattgcttcatccgattgccgtcgggtgtggcttttttttatatccaattttaagtccttgattaattggcgttaaccggggactattttctatgagtaaatagtaccatattttaaaagaatgtaaacatttatttttttattgtctacaaatctacaaatctacttgtatgcatgtatattaatctacaaatagatttgtagccattgaaattattttctttgtaagagttgcacaatcaatctattttttttgtctgatttttaaaaatctacaaatctacttgtagatttgtatttgtgtagattaatctacttgtagatttgtatttttgtctacaaatctacaattgacattgcttaaataatgggctaatgtaaacaaaagtaggagggcttactcatgacaaaaattataacgtttggaaactttaaaggtggaactggtaagacgacaaatagctgtatgatttcgtatcaattagcaaaacagggatataaagttttgctggctgatcttgacccacaagcaaatgctacagctctgtatttgaaaacaaagcaagttcaaaataatgaagttgttaaattcgacaatacgttaatgaacgcaataagcaacgatgatataagcactattgttactaagataagggataatttgtatttgcttccaagctttgctgattttacttcgtatcctatttttatggaaaaaaaatatcctaatcctgacgaccaatacaaacgtgctaaacatttttctcttttactaaacaaaataaaagatgagtatgattatataattattgatactcctcctactgtaagtctttatacagattcagctcttatggcatctgacagtgtagtaattgttttgcaaactcaagaaagatcttatgtaggcgcagaagcctttatatcatatcttcaagaattggttcaaaattataaagcaagtttttctatatcaggaatacttccggtacttttgaaaaataatagtcaagtggaccagtcaattttagaacaagctgaggaagaatttgataaagacaatttattccaaaatgtcgttaaaaatatggaacggttaaaaagatacgatattattggcataattgatcctgatcttaagacacaaaaacatgatttacacgatatgcgtgtcgatagcttatacaaaaaaattacaaaagaattcgtagaaaggattgaataacatgagcaaggatttactaaaaaagagccttaattctaatgttactcaagtgcctaaaccaaataacattttttctagggatatgtctgtttctccaaaaacgaaaaagtttaaacctacaactaaaactactactataagatgttcaattgaaaccgcagacatggtcaacgctatgtccgcagtcatgaactttaaaagtgttgatgagcttcttgaacatatcataaacagtacattagatggtttgacaaatgaagaacgaacggaatataagactgtaaaaaagatttatacaggtagacgaaataaataattgggaggaaatatgaataaaaaacgtgcaacaatcatttttgatgatgaaacgtttgatatttctaaagcaacgcaaactactaaggaaaaagaaccaagtaaactgggaagacctagaaaaaacaaaacttatggcacggttagattgcaaaaagaaaatgtaaataggattaattctattcaaaatactctaggatatgaaactcaagatgatctaatatctgcgttgttaaatgaaacagaacaaaaaatgtcatcggggcaaaagattatgtttgatatgtattttaaggcgttcactaaacggcagaaatcaaaataactaaaaaagcaggcttcccagcgattaactgagaggcctgctttcgtaacttgtccatgctttcgtttagaattgccacagaatgcgtttgagaacaaataaaaggtggtacccgtatcaactaggatacaggtaccatttttatgcaataaactattcaaaatcaaatcagtgtatactactttacctgtaaattttcaacaaaaaagcctggattgaagtcaatatttgagacaggttttaagagacattcagaaccgcgtttaccttccacagctcaaataaatcattaatcgtgattaataacttatttgaaccatggaagaacgaggagaaagaaagcaattaatcaagcggccatttggctcgtagtgttgcgatttcaactgtaagggttggtagcccagtgactatgaattctcttcctatgtagaaagcagcacatcttcaaaaaggacagcagcggcagtttataattctcaagaaccggcactggataaatacattccttttgagggaagcatgaaaagattccattggtgcatttcgtatggacaccccttacggtttgttaaggtggcggatatgtagttctgttaaccgttggttgtaatcatcgctggtgtactgtgatcctagtctgtgtggataatcggtccccagtaatggttcgatttttaaccgcgctttccagggtctttaagactaaatcagtatccatctttttgggaatgtagccgatatattgtcttgagtgcagatcctgtggttgaagtaacaccagccattacgcttcgtttgaatataggttcatacagcgggccatttttgattttaaaccagtggtcgagaaatcctgctaagcaagttgggacgctgttcaaccttggttttggaagccgaagccgctttccatttattgacggtaacggagtggatatccagtcctatgagccgggaaatccgtcgtggactgcatcgaagctgcagtggttgaagttccagattcaatacaggtggatcttcataacaccgtatcgctgcttaaattccgcaaagatccgcagaatccggtgtttcaagtccgcatttcggccggcgttttgaaggtttgggggatcgataacgataatactgagctctggaaacaccgaggattcggcacatcttagttacctggtggtgatggctttcttggtgaatgtaatcaaagatattggttacttctgcgcaaggaagcccagggctttttaggatttcgttccctcacagcgaagccagcgcttttccatcgcttgaatttcgtctggcgatttaccggattgagttttggcctggccctggatccacttatgaacggttgaatagccaatgccatattctctggccagttgggtggctgattcgccttgtttatataggttgatgatgttttgttttaattctttgtcgtaacgagttggcatgtaaaaattccttccttttgagagacgatttattcattatacgctctcttaaaagttgtctcaggaatcagcttacatccaatataatccaatcaattacgatcattaattttgatcagcaatataaatgatcgtaaactatttactgattagggaagccagaaggtaattgataccattgagagccgatatgaagaatgaaaagatcacattgaaatctcgtacaaatccactcaacatggttgcttgcgttgatgttcagctttaaacttgatatatgtgatatggcattatcacgatcatatttaagagttagtttaaaaattggttgtcattaacaatattgaaactaacttaagctgtatagtaagttatcaaccagttttttgtatctttcctttttgtatcttataatagcgtggatggttatgtgcaaatgataaaaattttttcttgtttgatagttgatttcacaaattggaggcaattttatggcaaatcaatacaattatgatgttttatatcttggaagtggtcatgggacttttgatggggcgattccccttgcacattctggtgtcaaggttggtattattgaagaagatatgattggcggtacctgtccgaattatggctgtaacgcaaaaatcacattggatgcacctgtggcattgacaagggaagtcgagcagcttcaaggcattgttgaaggacaactgtccattaattggaccaagagtgaggctcacaagcaggatgtcattaagggcttgccaggaatgattggcggcttacttaaggattccggtattgacgtgattcatgggaaagggacctttaaagataatcatacggtattagttgacgggcaaccgaagacagctgaaaaaattgtcatttcaactggattgcggccacaccgtttggatattccaggaaccgaattggctcatgatagtcgtgcatttatgagtttaaccaaattgccgaaacagatcgctattattggttccgggtacattagtatggaatttgcgactatcgccaatgccgcaggcgccaatgttacggttctcatgcatggtgatcaggtacttcgaaacttctatcacccttatgttgcccaagttgtcaaagatttggaaaaacgaggggttaagtttgtaaaaaatgctggtgtttcttcgtttgaaaaatctggtgagcaagttgaagtccactatggggatagtcgcaccttaactgttgattggattctggatgcaaccggccgaattccaaatgttgaaaaaattggtttggacaaaattggagttaaatataaccaacacgggattgaagtaaatgattatttacaaacaagtgttgataatatctatgcttcaggagacgtgattgataaagcacaacctaagttaacgccaacggccatttttgaatcgacttacttatctaagcgtttttcaggacaaatcaatgatccgattaactatccggttattccatctgttgtcttcacatcaccacgaattgctaaagcaggtctttccatagaagaaggtaaggaaaagagttatcaaattgaaactaactacctaccagatgattggtatcgtcaagttgataatgagaccataggtgataattcaatggtttttgataagcaacatcacttggtaggcgtgacagaggttagcgaacaggctgaaaatgtcattaatacattattgccggcaattgaatttaagtttggaccgacagaactgaatagactggtctacttgttcccatcaattggttctgctgcatggacgcaattgtcataaaataattactaataacatggatctattcattatttagtaaataattttaaatgttcacgttctactggaaatattggtaaaactaattatgatgtggctattaattgtggagattctgcaattaagggcaatggatttatctttcatcaacttaataggatgaaatatagcattgggccaacttttaaaagtattagttcaaatgatataaaaagggttctggtgcaaaattaacaaaatagtctttgtgatacattgggacgattgttgaacggatcattgtactaataattcgactagtgattgtgacgacgaaaaaccaaagagacttggttctctttggcttactttatgtagttgatgcatgacttcaatcccacttagcgtttttagtgcagttcgtagtgattgaaaactgcttgactttactaagacgtgtttaattaaccgatgatcttgctcaatcaaattattacgatatttagaacattggtgatttgctttcgccaataagccatctttaattacttgtttaatagcctttaaagtgccagcatattgatcagtaaccagacaatcgggacgaccataggtcgtcaataaacgtttcaaaaaatgataggcggattgataatcacgatgtttacgtaactcaaaatctagtgttaatccatgactatcaatggcgcgatagaagtaataccaacgacctttgattttaatataggtttcatcaactcgccagctttgactatgagtatcttgctgttttcgccataataatttgaatagtggcccgtaatggtgaacccagcgcatgacggttgtatgatgaataataattccacggtcacgcaaaatttcaaccacatcacgatagcttaatgagaatctaaaatagtagccaacggctaccaaaataatatctttttggaaatgtcgccctttaaaataattttccatcatcgctacctcgctttttaggctaattatactcaaaataagtttacctgaaaaattttgcaccagaaccctgttgataatataaaagcatatttatcaggtgatttgaaaaacgttatcaattaatggtaatggtctgtgaatttttttgcctgcattgaagtaaaattggctaaaggctaaaataaaacaaatagggcaaaacagagccagcaaataaagcgttaagaaaaatacggagagctagaactttatagcttctccgtatttttaaaggacacattgcgaatttctggtagtgggataaaccgatcagcatcaaccacaatatcattggcattgtagccatggatcaaggtggtgatatctgacaaatgacggttgttttggtcaaccgtttttaattgaatggtcactggttgttgacgctgatatgcgtccgccagtagttgggttatctctgctaaagattgttgcggtcttcgaacgtatatttcattcaactgctggttctgttggtttaaagcggcagtatgatcagataaatagaacccctgccatttcatcatgccccggtcatgataatcgtgttcaaaaaaatgcttaaccgtgcctaaatcaaagtcttggttattcaaggggcacccgctttcgttggatcagcttttgacttgccggccaccgttctcctgtaaagccgacaaattcgatcgttagttttatatcttgtcgtaatgcttttaacagcttttctaaatcagctaaatcatagtgtgctaatttgtgtaagggaacggattgcaagcgctcgttagcccgttgactgttaaaaaacagattataggtctgatcgtaggtatcattagtcaacattaaccaatagcgggtttggggacgccgcttaaacaatcgggttaaccgccccctaataatctctatatcgttattcatagctattacctccattatgtccgcccactagtgaagcccgcttgatagcggtgcctccctttaataaactggtcgcgtaaactagtttggtgaacccaaattgccggtgaatttcatcaatcacttggtttaaccggctacggcggatttggttgcgcggggtttcaaataaattaagttgttggccggaattggcacttagtttactgctataaacgccaatattccggacagcttgaccgtcccaattctgactgaataaccacaataattgttgcgtcaaaacttgattgtcgttagtcgggtcaatttttaaagcctggtgaaagccaccacggccatctgcttcggccgcggcataggaaaaaccaatgcttagcgatagacaaccggccagtttatggtggtgtcgaagccgcgccgccacctgttcaccaatttctttaatgacggtttcaatttcggcttggttaaaatagtctcgtggcagcacttgcgaattacccagactagctgctttaaccttggttggttccgtaacttgcgcgcgatcaattccccaggccgtagcaaataattggctaccaatgacgccaagctgctgtttgagtaaataagggttagtgtgggctagttcatacatattatgaatttgaaggcggttcagacgtttcgccatacgggggccaatcccccaaacgtccgttaattcgtcaattgtccaaatcttatctggcacagtttcgtaatggatttcaccgatcaattcatgattatgtttagcgtaaaggtctaaggctaatttagcttgcaccggattgtcaccaattcccacggtggtatacaagcctagcttttgccgaactgtcttttgaaccaagcgggccacttcgcgaatggaattgccaaacagccgccaagtatgggtcatatcaagaatgctttcatcaatcgaatacggccaaacctctttttcagtggtaaattgatgaaagatctgattgatctgcaaattacgttgaatataaaggttcatgcgcggtggcacgacccaaagcctggggtcattgggtaagtcacgtttacgggagacattggctttaagatgaaatacatgcttagcttcgggtgacgtggctaaaataagcccaccattggtgttttcagcttcactaaggaccactaaggggacttttaagggattaagcccccgggcaaccgcttcgcaactagcataaaaggacttgttatcgattaagaagaacacgccatgcggttcatcgtcaaaaaacatttagatcacttccgttagcttttacctgtattgtagcgcaaaaagcaaacatacgttccctaaaaactgctagaaagctgattaaaaatagtcgaaagttaattaaagtcatgctataatgtaaacagaaaaagggaagccccgctagaacaggacttcccatgcaagccgcttcaaaggcggtggcgaagttaataagacagcattaagctaccctgtaactggccaaagttacgcagggcggcttttttatttgttccttttgtcgatgtacgttagcaacgctaaaataaacattgcaaatagcaacatcaacgagagtgtctggaagacgctcattgactgtgaaaccttcctgaagattcttccatgttcccatgggcctcacctcgcaagggaaaagacagccaccgcccttaaaacttcctgcgtaatctattatacaggtgaattaagtattgaccaagaacaataaaaattaagtcatggagtttcataggatcctaaatttgatcaaattaagaatcagcaaaacatcttttgtagatacccttttttgagttcctggagtttttcaagcttacgctgatgaagagtgatagtgtcatcaagttgtttgaagaaggcaccgatttgtttttgttcatccttgcttggaattgcaaagtctgttgaagaaacgtttttccaatcagaacgcggcatctttgtgcctgaagtatcgtttgcaactttttgataatcatctgattgaattaggtaataatcaaaggacggaacgctaacatcagtagcttcaaaaacccagaaatcacccaaggcaacgccttcaaaatcagggaataaccaatttttcaaatacggacgaagtttcccatacaaaatattttcagattcaaacaacgtgccttttcgactatcaagttttgatgaaatatctttgtttaagcgaccttctccagagacaatatcctcaaactcaactttaggtaaaacatcagaatttgaagatttattcactcggttcacaatttcagttaacttacgctgttcccaagcgtcagcaaaccctgcaaatcttaattgtgggaacttgctgccatttttggggaacaatttctgcaaatagccctgtttaagttccttaagcttagctaacttacgctgatgaagggagatgaggtcgtctactccatctaaaacagccactattgtttcctgttctgctggacttggaaatttaattttcatatcagcaatcatttccattcgaacactatcaactgatgtttttgctgtcattgacattacacgacgataaaaattctttgaaaaatagtgataaaaatatttcgccgatactccatgattaaagttaaacatcctatatacacgttgatgcaagttatacttaccatttacataatgaaaaacttttcctgtaccaacaccatctccaactgtcaaaacagcttcttggtcataaagatattcattacttcgttcaattgtcgcagaacgaacataaaatggatatttaccatctttaactttatcttgggtattacctttgccagtagaaatatcacataattcttttgtcttacgctgttcccaagggttagtgaagcctttaaatcttaattgcggatatttagcttggttatccttcattgtgagcctccaattttgacgggtcattcacctgggtagccactaactggctagccaattcgttaaaggcttgttcattctgactgatttcctcgtccagttgctttagatcagttttaacttggcccagatcaatctcgggttccggttcaaacgtatcaacgtagcgcggaatatttaagttgtagtcattctccttgatttccgccggtgaggccacgtgggcatatttatcgacatcttgccggttttgataagtcgtcacaattttttgaatattggcggccgttagcttattttgattcttgtccttttcaaattcccgagacgcatcaataaataagacgtcatcagtggttttatgtttctttaaaatcatgatcaacgttggaatactggtggaatgaaaaatattagcgggtagcccaataatggcatcaatccggttatccagcagaagcttttggcgaattttgccttccttagcccctcgaaatagcacgccatggggtaagacgatgcccatagtcccatgttcctgcaaatgataaaagccatgtagtaggaaggcaaagtcggctttagatttaggcggtaagacgccatagtcgcggaagcggggatcagacaagcgtttgtcactattatcccagtgtgccgagtagggtgggttcataacaaccgcatcaaataagtaaggttcgtcaaccggccaatctttacttaacgtgtcaccattgcgtaaatgcatatcgtcatacgagacgccgtgcaacatcaagttcattcgggccaggttataggttgtggtgttcaattcttgaccgtggtaactcactaaacccggattttgcacgtgctgtccgacatttaatagcagcgaaccagaaccaactgctggatcatagatagtccgcacttggttatcacctgcattgcgctgataggtcacaatctgggcaataatgtcggacacctgccgcggggtataaaattcacccgccttcttaccggaatcactggcaaattgcgcgattaagtattcataggcgtcacctaggacgtcgccttgatgatggataagatcaatcgcatttaaagctaacatagtatcactaatagtttggttccgttgttgtaaagaactgcctaatttattactacttaaatccacatcggcaaacaagcccgaaaagtcttgcgctgaagataaattttgtgtcgactgttccagatcatgaagtgcttgggataaatcgtctaacgcaaaagtatgggcttgaatcttgccaatcagagtggcgtacaacgcctggggttgaattaaatagccgagcgtattttgcaaatactccactaaactgggctgcactgagacgccttccaactcaaactgaggatccatatactgagcatatttctgagtgacattttcggtttcacccgcccattcactaaaggtcgtcaaggttttctcagataggaaccgataaaaaattaaccctaataaataatttttatattcagaagcgtccattttcccgcgtaagacatcggccgcattccatagggcgctttcaagttgactagcttgcgttgttttttctgacattgtttaacctcacttatttttgtaaatagattgccaaatcgtgttcaataaactgtcgccaagcagcctgggacttaatccggtatagtggcaaaacagctggaatctttggcccagtggcagtttgagcttgtaaggccgctgttaaacttgctgactgcgttaattcttgttcatgatgccattcatcagtacccacgttgtgttcgcgcgccacccgcaagagggctgcttgatctaagccccacgtgtgggcaaaggtcgtcgttttttgaaccaattgtctctgggcgtaatcagccaccaactcccgagcattcaacgctactggcgcttgattttggtcactctgttgctgtgactgttgcatttgttgctcaatatagggcatggcttcgcgaattaactgggcctgttgcggttgcgtttccgccaatttattcaaactagcctgtactttggcactgttttgcagataatcggtcatatgcgcttgggcttgatcaggcgtcgagtaccgttgctgttcatcaatccagtcttgaattaattgcgtcaaataatcatagtccaccaagacaactgaaccaacagctaaggaaaagtctaaagcagctaattcttcggggactttctcgggctcttggttagtgaccgtcgctttaatccgcagatatttacccgtataggattctacttcgggctgagcgataccaaaggccttttcgctgttcttccaagtaaaatcgttgtacatcgatagtgagttcaattgttgattcacttggcgaaaggctttcacaaactgtaccttggcagtagttcctttcaggtcatcggccgccgtcggcgttggggcaatggcttttaaatccaccacagccttttgaaattttaagacggcctgctgataagtgggacgaatgatgacattaaaagagccttcgccactatataacttgtaagcttcacgttcattagcttccatgattgccggtacccgaaaggtcacaatttggccttcttgttttaattcccggttttggagccggttggtgcgtgagtaggcttgaataagttcttgataagctaaggtgcggtcaacaaagagcgtgtttagccgaggagcatcaaagcctgttaataaccggcggacgacaatcactaaatttatttcttgatccgtttgtaaatgagcaaagaccgcctcacgccgggcggcccgttttgcgacatcttcgttgtagagattcaaatcggctaaatcaaaattagtgtgatactgccgattataatcttttaaaatggtggccatttggtcatgtttgtgcgcactctgatcttcgttttcacttaatgaataagtaatcgcaattcggggccaatcaggatctagctgattgtgagtagtctttttcgcggctttaaaggcttgataatagcgttgcgccatttcaatggagctggtggtcaaaatagcattatagttgccatgacccaaactcgttttacgtgggcctttttgtaaaatatattgaacaacttggttaatatgttcatcggtctcaaagtcagccggagttaaatacgtttcttccaggtccttcactgacatcgcttgaatcttggctcgaattttcgcttcatcagccgtactcagcaggcggccttgcttatcacgacgcgctttgacgcgctgagtttctttttcgagggcccgggttattaacgtatctttgccaattgttgttacatgttcgacgttaaacggtaacacggcttggtcctctaaggcatctcgcaagttataaacgtgacagactttaccaaatagctcctcagtcgtaaccgctagatcacccttgagctgttttttattttcattaaagatgggggttccagtgtaaccataccagttactattgacaaacgctgcgcgaatttccttttgcattttgccaaattgcgaccggtgggcttcgtcaacaaagaagatcacccgttgctttaaagtcttactaaagcgggattgcttaccggttgccagctgggcttgcgtttttttgaccgcccgatggagtttttgaatcgaggtgaccaagaccttaccgtcattttgttgcaatttacgcattaaatcaccggtgttttgggcttcgttaatggcaatatcatcattggcagcataggcactaaagttgctagttgtctgttcgtctaaatcccgccggtcaactaaaaagatgaccttatccacaccaggatcttgcgcagctaatttagcggttttatatgaggtgagtgttttaccagaacccgtggtatgccaaacgaaaccatcctgatggtcatgaatccggtgcatcacggcttcaatcgcataaatctggtaaggccgtaagagaattaagctttgccgctcttggtcgatgaccgtatattcactgaccattttgtgggccatgggaatattaaggacttggcgcgtaaacgctaagccgttttccacggggtgattatcccgcgttcgccaattgaacaaaaaggctttattgaaacgatccggttcggcattcgcaaaatacgccgtactatctggtgtcataatcacaaacatttgcagcagtgagtaaatccccgtatatttaccttcttgcgcgtatttttcaacttgattaaaagcctggttaagttcgaccgtggctttttttagttccaattgaattaagggtaacccattaatcaatagggttacgtcaaaacggcgatcagggtcgacatcttgagtaccagctagccgtggtcgcactgcttgtcggaccacttcataactagatttaccgccagcaacgtccgctttccaaaacaactcgagcgtcaccgtgcccagcttagcatcatcacgttcaacttctactttgccaatgccattttcggcggctagtaatttagccgcttcgtagggcgtccggacctcaatcgcccgtttaacttgattaaattcggtatcagttaaagggtgtccctgcaatttagcatagttattgttatttaatttatcgcgaaaattagcccataattgatccggcgtcgcaccatataggtcttttcgttccacccattgattgcttccagtcgttaaggttttaacaacttctttttcaaatgacagttccaacataaaaacagtccttcccccacctttaaatgactcactagtttattatacgcgaacagattagcgtttaggcttcataatttggtagattgattttttatttttaggccactatggtatatattagtaaatgtttttaatttcgtaatatggtagattgtaaacaatgggggagagtactaatgagttggaatgaggttaagattcgtacaccacatctacaggaaaatgaagtggacttgaagttttataaggtagtgacgaacaaaaaaacgaaagagaaacgtatacaagatgaacgaataatttcaattttcggaagaaacggatctggaaaaacaactatctctaacgcggttcttcacaatagtgtagataacgccataacagatgaagcaccgagctcctctttttggaataccagcatcgaaaaaaacgaagaaattacgaccgctgccaagttgaatgattcagaaaagtcagaggcatacgtttataacgaacaatttgtggataaatacgttcgagttaaagataacgaaaatctagaagcgattgttatgctatctgacaatccagatttaatagattctcttaaggctcttgaaaccaaagagaccggtattatggaaaaaattgaatccgctgagcaagctctaagcaattttgaaagttctacaaatgaccataatgaaaataatatccataaaaagattgacaagcagctaaaggccgacggcgcatgggcatcaattgggagaagtattcacgcgctcgaagttaaacaacaagtgaatactacggcatttaagtcaattcgtgacattgacattactggaggcacaccggcgattgctaaacaaattatgaagctcctcgataatgacctcaaagatcttgagcagattcggcaaaaaaaagagctacctccattcgaaatgccgacagataaaaatgattttagtaacgttaagaagcttctgtcgaccattgttaccatgccaactctcaatggaatccaagaacgaattatgaaatctttatcgagcagcggaaaaaataaaattagccggattaaagatacattttcactgccagaaatcgagtactgtcctacttgttttcgtttcattacatccagcgaaaaagagaatttagttcaggtgatcaatcaggtcttaaatatgtcaaaactaaacgcagaagaggagtttacaaatcagctgaaatcgctgaaactggataaacatacccttatcaaacaagatacggatatagcatcgctatttccaaaagaagtatcagcgtataataacgcagtagaaaaatataatgaaatggtcaccaaatacctagaagccatcgcagaaaaaattaacaacccctattcaaatccggacaccattgattacgatgataaaagtctgtataaggcaattatttccgctggaagagcaatacagaagaaaactgaagagtataatgtcgtttttaaaagggagaagttccttatatgtgaagcagacttactaaacttaaatattgcgaaatataacaacagggagctgttcgagcaattcgaagcagctagtgttaaacacaagggtctgaaagacaatcttagtacagcgaaatctcccctagcagacgtcaaaaataatattgctcagattaaagcacagcttgcaggacagaaagtagcgctcgatcaaataaatgatagtttggcccatgtcttcatggcgcgcaatcgactaaagctaatagagggtgataattgctatcgtgtgcaatctcgtggtgaatttattaccacaaatcaattatcggtaggagaacgaaatgctattagcttatgctatttcttttctcggataaattcaaatgttcgggccgatcaggcctatcaacggccaatctttgttgtcttggacgatcccatctcaagtttcgattttgaaaataaaataggaatactgtcattactacgtgaagagcttgaaaagatattgtttaacaattttgaaagtaaagtgatggtcatgactcacgacgcagagatgttccagcatgttgcaaagatctacagtgatattgaagaacggagaaggtttctagacaaggcgggtcagccggttgctccaaaaatcatcagtcattcctatcagttgatttctggtagattgactgaggctgggacaaaatcctttaacgactacgcacaacagttaaaggaggtatataactacgctatgtcagacaatcaagtaaccgatgaaaacgggcaagatacgaaagtagactatgcacaggaggacctatttattggtaatacaatgcgtagggttttagaggctttctcaactttctgcttcagatgcagtattagcgcaatatttaacgatcaggatataatgaatattattccggataaacatcgtgagtttcttggaacttttatgtaccgtctcgtattcaactctgaaagtcacagcgaagagaacatcaaatcccaaccagacagcaattccgctgactttatttcgcatagtgaacttgttaaaacggcaaggctgttgatagtgttcatggatgatctgaacgctcttcacttacgtaaacttatacccgactttgatgaaaacgaagttcagacctggggacaaatagcaatttaaggcctttaatttgactaaatattctgtaaagcatgcgccgtccccacgctaggcgtgcaacgcgaaaaccgcaagcgtgagtgcctgctacccccagtactataacagggggatacaaaatacaatcagattgcccgaacaggttctggtgcaaagttgaaattaagcgtagatcaaagtgactgtgtttagtggttgtagcctatgccgctaacaattggtcgacttcttgatacgctgaaaagccgaagaggcctagcttctttcggctttctttgtgtatcgcatgcatggtttcaatgccgtataatgtcctagctgctgtccgagtgctctgataacttgcggaacgaacttgttgccgcttaataaaacggtgatcttgctcaatcagattattgcgatatttggagcactgatgcacacctttgtgcagacagccttccctagtaagctttttaattgcctttagggtcgctccgtactgatcagtcactaatcgatgtggaagaccataggtctttaaaaggcgtttgagaaaatgataggccgagttaaagtcacgcttcttgcgcagttgaaaatcaagcgtaagaccttgatcatcaatggcacggtagaggtaattccattgacctttgatcttgatataggtctcatccatacgccaacttttggaagtgcgccgatggcgcttacgccatagagcccgcataatcggtgagtaatgttgtacccaacgcatgagggttgtgtgatgcacgaaaataccacggtcacgcatcatttcaactagatctcgataactgatgttgtaacgcaagtagtagcctacggcaaaagtaatcactgattgattgaattgccgtcctttaaaataatcagtcatctgaaaacctccagtttcaattcatgatacaggatgcactctccctgagtaaactttgcaccagaacccgcaaaagaacccgacgagagttaagtctcatcgggttctcagtcgtggacgaattagaagcattgttagctgcataaccttcaacataggatcaatagctggttagatggtcatctctcacactgtttgcaccagatccgccttgccatctaacctcgaagacgttgctggtttgaggcgttacgtttttgggtatattaatagtggttcattcatgctatatttaggccagaggatatcacaatggcaaaaatgactgataaagaacgtagcctagcaaatgcaatcaacgaaggctttttagatggcatggaagcaaaaccgtctaaggagtatcaagaccaagagtacagtcacatttactatcaaaagtctgatcggatacaagaaggtaaaatggtgacgtcgacgcaaactactgatacgaaagcttttgatagccatgatagcaactacaccagcgtgtcgaattctgaatcagaggtcggggcaagagctgctgctcgcgtcatgctggagcacccttatcgctaccaagatattttggataaggctgatgaagtcattgaagagcaccctgagtttgctagtgcaccagttcgtcgcaagcagccttcaactaagtcagttcagaagccaaaacaagcaaagactgctagcaagaaaaaatccgcaaagaagacgactacagcagatcaagagccagtcgatatggcatcagaatcatatgaatcaccatataactatcagaattcagcgtatcagcaagcacaagaagatgatgacacattcagcacagcactagccgattttacgcttgctgtaatcgccgaagttggccgtcagtactacgagtcgcatcaagatgagattcatgctgctgcaaaatcaatgctcaaaaagactaaaggcaaagttgtcaacacgggtcatgcagtcaaacaattggctacaaagctgaagaggcatcaacgaaagtaaatcgcagagatatgctgtcaccaaaggttcaaggttaatctatagttgtcaaaggtttctcagaaatgggaaacctttttgaatgtctgaaagctcttgaatttctattgggttaccaggtcctagcactccaaatttagccttagatcgcaagtgtgagttttgctaagaatttaaatcaagtatatacataatatgaaataagtacgcggcgtacaatacccctagattcttacttatttcattcatggtcatgtgatccttgttatctaagtaatactgaacggcctgttccttaaattccttgtcataactgtgcttcgtcattatttgatcctccaatttacttccttaattatactaaatcagagtctctatttaacttgtacactttttattctaggcccaatcccatttattttgagttgttccatatggcaagtcaaccaggagaaaatcgatagcattatctggaatggatttcataatctcaagggtatcgccttgagtaacgttatttatcatttttgagtagttaaccattaaatcagcctttcatattaacggctttagggccaattttatttgtgggttatggttcagtatatcatgaaaccccaaatagccactagggtataccctattggccttttttgattctgtgctatactaggaattacaaatgttcattagaactgtccaaaaggaagtgctgacaatggctaaaattggttatgctcgtgtgagttccaaagagcaacatttagatcgacagctagcggccttaaaaggcgttgataaattatttacggataaattaagtggagctaacactaatcggccagaactgcaaaaaatgctggcctatattcgtgagggagatattgtcctggtcactgaattagatcgcttaggcagaaacaaccatgatttgactaagattatgaactccattcaaaataagggtgccaccctagatgtgttgaatttaccgtccatgacagggattgctgaccctaacttgcgtcaactgatgaccaacctcattattgaactgtataagtatcaggctgaaagtgaacggaagcggatcattgaacgccagcaacaaggcattgccctggctaagcaacaaggcaaatatcatggtcggaagcctcaatatgccaaagatgatccccgcttacaacatgcatttaagctttatcaggcgggcatgagtgatgtagatgtgtcccgtaataccgggattaagcgaacgacctttatcagatatcgaaagaagttcgatataaaaagatgagatttatatgcgataattacgttatactagtttagagagggtgacataatgatcattcaaacaagggaacttactaaaacttatcaatcaaaagtagtggttgaccatattgatttagcaatcaaagaaggaagcttaaccgcgctactaggacccaatggcgctggcaaaacaaccactatatcgatgctcacaaagatattaaatccaaccagtggaatgatcaagatgaaaccagacataaagattagcatggtatttcaacagagtattttagataatgatttgacagttatggaaaatttgagtattcgaaataaactttataaagaagccaaatctaatcatattgatgctttgattcagaaaatcgggttaactgaatttattaatcaaaaatacggccgactttctggtgggcaacggcgacgagttgatatagcaagagctctacttaatcaacctgatattatttttttggatgagccaactacgggtttggatatccaaacccgctcggcaatttggaaattgttgcattcattgcaaagtcaaaataatttaaccattattttgacaacacactatcttgaagaagcagacaatgcagatgaggtttatattattgatcatggcaaaataattgccagcggatccgctgatgaaattaaaacacaaaactctagcagtaaactcgtgattgtttctgaacaagctgatcaattaatggcattgataccaagtaaaataattcatacgcagattaatcataaaaccatttgtttaacggctaattctgacgaagcactctcattattattaaattttcgtagtttcattaaaacgttcacttatcaagaggggacgatggatgatgcttttttgtcattaaccggaaggaagatgcgttgatatgattactttaacaaggagaaatctactgttgtatttccgcaatcgccccggagtattcttttcattattgggagcaatgatttcatttctcttatatattgtctttctaaaaaagtcaatgataagtagctggaaaactgtccctaattctcaccaattacttgatttttggttgattggagggactttatcagtgactgccatcacaaccacccttacctcacttggacaattagtaaaagataaagaacgcaaggttattaaagatttttgtttaacagacctttctcattttgaaatcaccatgagctatatgttaagtgccgctttgattggctttattatgcaaatagttatgttcgcactgatgataggatacttttcaatcacagataacttgaccatgccatgggagtcgctaccagctgtaatttgcgttgctctttttagctctttactagcagttgtaattaatatgatgtttatccagtttattagtcgctttgattccttgaacgctataggaacaattgttggcacggcctctggctttttagtgggtacctatattccaattggtattcttcctaactttgcgcagttacttatcaaattaactccgggtgcatatgtagcagccatttatcgacaaatacttatggcagataaattaaaaaccgcttttcatggtcagcaaagccattttgaaaaaacgatggggattaagttagagtggcatcatttattaactggaatgcaatcgactgtgctccttaccatagtttttttattaggaatagcagttttactaattgttgacttaattcgaagcaaggaaaatgtgagaacggttgattgagatagcaaatatgatgaaacaagtagaccaatgttttgtgattattgattaagcattccaagtaaattgcgagggatcaataatgcctataaaaatccgattaaattggaatctgccttaattgcatcgacactcagtcacattacgatattggcctagccaataaactatgctggataaaattgattttggttaatttttattattcccgaattgtcaaaagtcaaagtcaggcgaaattttcagggagcagtagattaagtagtacaatgtagatatcgagttaaatggaggaaattcaatgtataaagcggttgttttttttgatctagatggcacactatttgataatcaaaagaatgtttctgatgacaacattgcagcaattaatcagttacgagagaacaatattctccctgtaatttcaactggccgaaatatttttgaaattcaatatgtgattgacgctaccggtatcaattcattagtcagtgcgaacggtagttatgttcaatatcaagggaaaaagctaaaggctgagcaaattagtgatgaggtgattgaagagattttagcatttgccaaaaagcagggcgatgtgatttcattctataacaatgaagaatttgccttaacatctgaaaatgacttaactaaagttaactatcggctgttaagattgacgccgcacgttgagccggacttttacaagactcatgaagtcaatttcttgaacgtttttaattatgataaagataaactgtatcaggatgaattcaagggtgaattgtcattggttagaaataatcctcgctgtttagatacgatgaagtggggggtatcgaagcaaactggcattcaagcactcttgaagaaagcgcaattaggggacattccgtcctatgctttcggagatcagctgaatgatttgcaaatgtttgctgaagtggattacccagtcgcaatgggtaatggtcacccagatgtgaaagccaaagcatcattcgtcactacttcaaatgtgaatggcggaattgtgaatgggctgaagcattacgggttaatcaaataacttacgacatgcaatcatttaagggcttcaccctgaaatcctcgttttggattttgggatgaagcccttaaatgatgggattaaagcatcaattgtcccagttttccaaatggattgaattagtccatctgttttttaatgttagccaaggtcatttcactggtatcagtaaagttcacatctgcatccttcaaaattgtcttgtcaccaattccaatggaggtttccccagcggcgttaattgattcaactccagcggcagcatcttcgactccaatgcattgttctggtttcaaattgatcagttcggcacctttgaggtaaatttctggatctggtttgcctttgctcaaagtttttggatccacaatctttggaaaataatcagtcaattgtagcttcttcaaaacagtaggagcattttttgatgcagaagctaatgataacagataaccaccatctttaatttcatccaggaattctttaatccccggaagaatattagctggagtcattttgtcaaccaacttcaagtagtttgtatttttttccgttgcaagatcaaccttctgatcgtcagtatagtggtcttgtagattacctgcttttaaaatcatttcaagagaatccatccggctgattccctttaatccgtcttcaagttctttggaccatggggcacccaccttgtcagcaacttgatgccaagcttggctgtggaaaaccgaagtatccgtaattacaccgtcgagatcgaagacaaaacctttaatatctgaaaactttgccattgtatttcactcctaatcttatttgtaagtaataacagttggcttgttcttggataatgaataacccttgtcaccaaccttgatgtgactgctcgaatcggcagtcacattgattttatgatgaccgatttcaaaattgtacgtgatgccttgatacgtttgcttaaatgataccttactccaagtggttggaaggtgcgggttgatggaaacctcgtcggtgtcaaaccgaaccccgccgtaacacttggtttcaatttcaagcgtagcacccatgacgccaaggtgaataccttcagcagtggtcccaccttggatatcatagtaatcggagaacaaggcggttgagaacaattgccaggattgatccatattgccatccatttcatccagaactgaataaacaattcgtgaaagggtggatccgtgagtcgttcgatcaaggtaaaatcttaaattggtggtaaagtagttggcgggcaacttgtaaccaagccgggtaatgacgttttgaacttcatcaaatggtaattcgtaataagccatcaaagtgtcggcttgtttggcaacttgataggaatcaggtgacttaccttcaccctttaacagtcgatcaattcgcgatatatcaccgtatttcttccggtaagaatcaaagttgagcttggaaagattgaagtaaccggaaaattgaccaatgatgccttcttcgttgatatcgagacgaagtttgtgggcaatatcactcatttgatcaagtaaactattgtctgtttgggctttttcattggcagatttgattatcttaggatcttcatgactcatcagctctgcgactttatcaaataaccaagaaaccatgatattggtataagcattattagtgagtccgtgatcatcagagtttggatattcttcgtggaattcatctggtcccatgacgtgatgaatatcgtaacgatcatcttttttatcgtagcttgccatgctgacccagaacttgcaaattgacaataacatttctaatccgtagttcttcatgaattcggtatcacctgttagatgaacataattaatgacatcgtaggcaactgacagtgaaacgtgacgttgcaagcgactgttatccggatcccattcaccactaaccgggttcaagtgaacaaattgagattgttcatccccatacatccctgactgccaaggatacattgccccttgcttgtcttccgaggcggcgtatttgcgcgcttcaccgattcgattatagcgatataacaagcactgtttagcaattgctgggtaatgaatagcataaaacggtagatcaaaggtgacatcccagaagatgtggcctcgataagcttcaccgtgcaagccacgagcgccgactgaggaatctaattgaccagaagccaaggcggcacttgtcacaagcatatggtagatgttaacccgcgtcagtttttggctggtcatatcattatcaatttggatatctgaattctgccaaacgttgctccagaacttttgactgtcggcgagggtgtcattgaacgaagaagcgttcagttccttttgggcgggttgttccaagttggcatcctgagtttggctggtaaatactgtgacacatttttcaaatacatacggtttctcaggttctacttggatatccaatttttgctggatttgtttatcttcagtttcagctaaaattaacttggtggtatcgatatctttgctagaaagcttagaattaatcacaaagttaacgtgggacgtcttggtttgaccggttaacgaaatctggttatcgtgggtaaccatgccaatgacgtcgatatggtgttgatcgaaatcctgatagcgctcaacattgccattaataacagtcccgtcaatttttgaatagagttgaatgctcccagaaaagttgattggttttaattcatacttgatggaataacgatgccaatttgtcatattggcaactttggtagcccgaacttgcaaaatgtggccagttgataattgaatatgcaaggtggttgttaaaacaccggttcgcaaatttaggcttcgataaatatcttgaatatcttcttttttaatttcaaacggttgttgatgatccaccccaaaactgatgtattgagcattggggaggtttactagatcttcgttgacaacatcccgaccgttaattttggttgtgagttgattgtagacaccagcaacgtacatcccagggtaattatcctggttggcgttcgcttcgacatacgcaccccgcaggccaaagtagccgttaccgattgtcagcatggcctcttgcccatagttacgcttgccgctgtactcaccataataatcaaggtgccacttcaaatattcctgtttttctgccactgctttttccaaaccaacatcttgaaccttatgcaggttaacgaccggaatattcatcatgttggcaattgctaggccaatatcgatcttttgatgattaataccgatgatcgtgtcagagaattcatagttcaatgaattctcaataattgctgcatcaattggcaacccagtgagggcagccttaatgttctcaagattatcgccaattgaaaatttggggttgtaggtgatcataaacttcctaaaagggggcttattggaattctctgaataattgatttccatgaccccatcacgagcccttatcgcaaacgttctcataacaaaacctcttctcaagtatttccatttgtgaaaatcatctataagttaattctagttcaaatatccggtaatcgcaattaattgggggtttgaaagcaatttgagcaagccggctgttttcatttttgctgattttcgagtagatctttgatttctgaaagcaggacttccttgcgatcaacactggcggttttgggctgttttttaactatccgattaatgattttggattgaagtcaatatttgagacaggttttaagagacattcagaaccgcgtttaccttccacagctcaaataaatcattaatcgtgattaataacttatttgaaccatggctaaattcctttcatgattgttttcgcaaacatcattttacagaaatttggccatgggccattctttatttaattagtgttgcacttaaagtgtaaattcaagtgtcaaaaaaatataacactttctataacaaaggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatggacgctgttcaattgatcgccccaaagattgattatatttggatcgttggtcaacattacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagataaaagatcagctcctaaaagatgggtttgtggtaaacaccattttaaaggaagctgatcttttttgtccgaacagcgttcggattaattttacaatctaccattatcaattgaattactataccgataaactctctgaaaaaaatttatacaaagcatgtctcgtaagggaaactgtcttgataatgcgccaattgaaagcttctttcatcttcttaaaacagaatgtcttaatggatttccacagtgtaaagatattggagaattcaaggaaatcacaaagaattacgtcgattggtttaacaatcgacgaatatcacagaaaacaaaaggcatgaatccctgcgaatacagggaacatgccttagcagtttaaaaatattcaattttgtctaacttttgtgttgcactttagttttgacccagtccttttttatttacaatatttaaagcatcatattctaatactcaaacttttcattttaaagttgacttactccccaaaaattacttgcaatactaaaggagtctttacaagaaaaaactttacagacactctaattctgcttaaatgcttcagttacactttgcataactattattataaagctattctactttttcaagaggtaagacttgctgtagttgcgataatgtaggcttcattttaagaatattacgcaagtgattaaggtttaccttagaattccaagaaaggattccttgaataattccactgtcgtcaaaataataaactatacttttttccgccgcacccggcagtttctcactgtacatctgcattttagaactgagatggccaattgcatcccacgaaatatcaaaaacccagctataaaacgacggtgtgtaatcatacacgacctcttcaccagccatggctctgcctgcaatcaaccctgatttaactgcatggttaacatgtgcagaactttgacgccccaatattttatcaggatatgaaataatatctccagcagcccaaatatcaggagcagaagtatgcaggtgttcatcaacaatgattccgaatttatcagaagatagtccagcattttcacccaaactgtgatcggtgtttgctcctatacctaagacaagcccatcgccttctaaaatctgcccatcactaaagtaaagtttcactgtttgtccatcaacttcatatttttgcgcgtgtttattgactaggatattaattccctcatcaaggtatttttgctgatactgactgctcagataatccggaaaacgctcatcataaattttttgcccactaattatcaaagacacttttgtttcgttttgaattaaaccagctgcaatttcactgccgacgtaaccactaccgacaactataatatgcttttgtttcccactaagagccttgatttttctgtagtctgcttttgaccttagagcaactaccaaatcactttctggtcctgggatacgttgtgcttggcttccagttgctagaagcagcttatcataacggaagtgttctccgtttgtagtcactacagaatgcgccgtggggtcgaggactgtaacttttttactcagaaatattttgacgttatttttttcagccgttttaagatctgtatctttttccttaaattcttcatctacccataattttttactcaaagccgggcgagcataaggcgcatcattatctgccgaaataattgcaattgtccccttgctatccgttttacggatacctgttgcggccttatccgctgccatgccgccaccaatcaaaagatagttaaaatggttattttcttgagtcatatactgtatccttctttccaatgctttttaaattaaatttagtttataatcgtttttataaaaaacattacaacattgattataaaataagtattacgtaaacttaaaaaagttgctcataacttctttaagggctgctttttcaagttcagatacactgtacttaattaagtttgcactactcaagtcaaagcagcttattgtgtattcatccaatgcgtaatactatatattgtagaaaaataggaagtagaagaagtttagttagtcctaattaagtttttaaggagatagcaaaatggcaactgaaaagtgttcaacaaagcctttacaaattttattggattgaagtcaatatttgagacaggttttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtgaactatgaattctctttctattgtagaaagcatgcacatattcaaaaaggacggcagcggcagtttcataatcttcaaagaccggcactggataaacacattcctttttgagggaagcgtgaaaggattccattggcgcattatcgtacggacaacccttacggctgtatgagtggcggatatgtagctcagttaaacgttgattgtaatcatcgctggtatactgtgatccttaatccgtatggataatcaggtccccagtaatggttcgatttttaaccgcgctttccagggtctttaagactaaattagtatccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagtggttgaagttccagattcaattcatggtggatcttcataacaccgtatcgctgcttaaattccgcaaagattcgcagaatccgttgtttcaagtccgcatcttcggcccggcgttttgaaggtttgggggatcgataacgataatactgagctctggaaacaccgaggattcggcacatcttggttacctggtggtgatggctttcttggtgaatgtaatcaaagatattggttacttctgcgcaaggaagccccgggctttttttaggatttcgttctcctcagacagcgaagccagtcgcttttccatcgctttgattttgtctggcgatttaccggattgagttttggcctggccctggatccacttatgaacggttgaatagccaatgccatattctctggccagttgggcagctgattcgccttgcttatataggttgataatgttttgtttgaattctttgtcgtaacgagttggcatgtaaaaattccttccttttgagagacgatttattcattataccctctcttaaaagttgtctcaggaatcagcttacatccaccccgcgggactgcaatcaggagtcattactccaactgtttttgttcattatagaaattacggtaagctaaatagcacgcaatgattgaccccaaactagtcgctgataagagcatgaacgtaaccataatttgatacttaatggcccgtactggatcgacccctgcaaagatcaaaccggacatcatccctggcagactgactagacccacagtctttgccgaatcaatggttggtgacatccccgtacgaatcgcctcacgcacgatggcaatcgaagcatcaagtagaccagcccctaacgccaaccgttcaagcacaccttgccgctggtcatgaaactgactattgaggctgcgataagccagcccaattgcgaccattgaattcgacgcaatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattaaagataatgaagcccatcatcgccagcgttagccacaaattgttgactcggaaaatatactttagcaagtaacccacgataaatagttgtacaacagcccgcacgacaccaatgacgatgtccctatccaagccaagtttctgccacaaactaattcctaacgcgacgagcactaacattgccgccaaaaatagcgacgtattattaactgctaaattcatgcgtgtacctccaatctgccagcaaccactttcgctaattgatctgccgcagcaatctctgtcgcgtcatgagtaatcatgatcgttgtcacgtgatcctgctcatttaactgtcgtaaccaggcgtgcacgatttgcttattattttcatccaaaccagctgtcacctcatctaataacaacacttttggtaagaataagatgttgcgaatcagcgcgacccgctgccgttcaccaccggaaagctcgataatcggctgatgcagggttcgttcggacagcccaacattatttaacgccgttaccactcgttgcgtatccatgacttgcttacgaatttggtacgggaaagctaagttatctgccaccgtctcaccaaataacgtcggttgttggaaacaatatgagacttgccgccgatacatgattgggtcataactttcaatcggctgcccatcaaaaatcaaggtcccacttgttttagaaatcatggccgcaatgatccgtaataacgtacttttcccaccaccggatggtcccgtcaatgtaatatgagccccagctggaatctgccaatcaacatcatgtaaaatatgttgatcagcgatttgataattaactttttctaaactaatcaatgaattcatatgcccacccccgattactaatttataatcattattcgcaccaatcccgatcgcacaatgatcggcgccgacaacagccggatgaaaaagtgctcagaagtcaataaattggacttatctgtttgatgtattaatacacgaacctgtgtagccattggcaaagccatatgaatcatacctgagtcaaagtgttccgtataactacggaggagttctaattgaacttttaatttatcattattttccttgatcgatcgtttttgtctagacatacgttttctcctatctagggagtattatatcattttataaaaaaacaacccccgttatctaactattagataatgggggttgtttataaatatagaccctgaatggaagggcattttagtgagtgcctagtcacatatctagctcataaccaaagctctggtattttccttagaagtcaataaattaattggactgttttactgcggcactatatggcgtttttttattaatgaacgtagttattcaaacttgtaactaattttttaatttcgtcacgaaccttacggaattcttgtagttgttcttctaaagttcctgtggcttgcgctgggtcagataaaggccagtgtaaactcttggtttgagggggaagcataggacatttatccttggcatcaccacataaagtaataactaaatctgaagtgttcaaataatttagatcaattaatttagagtagtgactactaatatctactccatcttcagccataactttaacagcatttagatttaacccatgagtttcaatccctgcactctcgatttgaaactcatttgccggcaatattttttttgcatatccttcagccatttgactgcgacaagaatttcctgtacataaaaaataaatttttttcattctaaaccacctataattttaatttgtataacaccataaacttaaatgcgatgcttccatcaacataggtgtataagtatcaaggttcttgattcaaaagacagttcggcaaaaactaggcttgtataccaccgtggggattggcccccgcatggctaaacgtttaaaccggcttcaaattcacaatatgtatgagctagtccacgctaacccatatttactcaaacagcagcttggtgtcattggtagccaattatttgctacggcctggggaattgatcgcgcacaagtcacgacaccaactaaggttaaagcagctagcctgggcaattcgcaagtgctgccacgggactattttaaccaagccgagattgaaacgatcattaaaaaaattggtgaacaggtggcggctcgtctccggcaccaccataaactagcggggtgtctatcgctaagcgttggcttttcttatgccgcggccgaagcagatggtcgcgttggctttaaccaggctttaaaaattgaaccgactaatgacaatcaagctttgacgcaacaattattgtggttattccgtcagaattgggacggtcaagctgtccggaatattggcgtttatagtagtaaactaagtgccaactccggccaacaacttaatttatttgaaaccccgcgcaaccaaattcgccgtagccggttaaaccaagtgattgatgaaattcaccggcaatttgggttcaccaaactagtttacgcgaccagtttattaaagggggggtaccgctatcaagcggacttcactagtgggcggacataatggaggcaatagctatgaatagcgatatcgagattattaaggggcggttaaaccgattgtttaagcggcgtccccaaacccgctattggttaatgttgactaatgacacctacgatcagacctataatctgttttttaacagtcaacgggctaacgagcgcttgcaatccgttcccttgcataaattagcacactatgatttagctgatttaacgaaagcgggtgtcacttgaataaccaagacttatatttagacacggttgaacattttttgaacgtgattatcacgacagaggtatgatgaaatggcagggcttctatttatccgattatactaccgctttaaaccaacagaaccagcagtggaataaaatatacgttccacgaccgcaacagttcttagcagcaattatcgaggtattggcggacgcataccagcgtcaacaatcagtaatcattcaactaaaaacaattgaccaaaacaaccgtcattttccagagatcatcaccttgatccatggctgcaatgccaatgatattgtggttgatgctgatcgttttattccgctacaagaaattcgcaatgtggcacatcaaaagacggaaaagctataaaaattagctatccgtcttttcttaacgctttatttttatttgctaagctttgtcttgcacaagtgagtcgataccctaatacctatcacttcatatacagaatgtgactaatcaatactaattttcttaattgaaaggccatcacctaatgacttcaattaagtattccaggttttaatatctagataattgggttgcacaactgtgtctaaacaaaatgaacagtgtccaacctcttaaaagaagcttgatgaattaaaacaataaataatcatttttattaccataaaaattgaattttaaaagctgacttatttattcacaacatttaccggtttaccagccaaataagcttttaaattattaacagcaatgtccattaaccgctcccgaatttcagttggtgcccaagcaatatgcggtgtaagataagcattcttagcagttagcaatggattgtcagcattaattggttcctgagaggcaacgtcgccccccaacgcatacaatttaccgctatttaatgcatttgcaacgtcctgttcatttagcataccgccacgcgctgtgttgataataatcgtgccatctttcattttagcaattgtctcctgattaataagatcggttgtttccggtgtttgtggcgtgtggagactaatcacatctgactgttttaacaattcgttcaaagaaacctgctttagccaatcggcttgaacctcttttttgtgatgattataaaaaatcacgttcatgccgaagacatgtgcaatttgggcaactgcttgaccaatatgaccaaatcctataattcccaaagttttatcggctaaagaaattaacggcttcttccaaaatgtaaagtccgtgctggcactccattcaccatctctaacagttcgtgcatgtagtccaacttgattggtaatttccaacaacaaggcaaacgtgtgctgagcaacggcatccgttccgtaacttggaatgttggtcaccactacgttattatccgttgcggctgataaatcaaccacgttaaatccggttgccaaaacgccaatatatttcaatttaggtaccgcatcaattacctgtttattcagagatgtcttatttgtgagcacaatttcagaatttccaatacgttcgatttttttagcattatcatcagccgtccggtcgtaattggtaaaatcacctagtgctttaaacccattccagcttaaatcaccaggattaagtccgtaaccatctaaatcaacaatcttcataagttcgtcctccaagtattagttgccattagtttatcacttatcatccttcttcgactttcttttaagcttattgaggccacgctagcaagctagttcacgtcccgactccaggtgtgttgcactttagttgacaaagagacgcaaacggccactagaatataacctagtggccgattaatacacgtacatattcactttttagtgctatttaaaatatcgcgatgataaattttcttttggattaagtactgatcttgattttgagtaataaataacggagaactttcttctatgacattactaaattccaaaccataccatgaaacgggtgaagctgtaattttctgcaaataaatacgccctcctattaattttctatctaatgggctcaactgatcattgacaatcaaatctgctggttgttcttttataatgacaaacttaaaatcaccgacttttcgttgccgatctgttgaatacgtgggtacttgtgattctaaaatgccttgttccactagatggtttacaatttgatgtaaatagacactaacggactgagatttcctaaatcctaaatacaattgaacgttaacaacattatgcgtttcaagtaaatcaactgtataattactttcataaggtgcattagtttcattgactgtaacaaaccaataaactttagctcttttaggttgtctgtcgagaatagaatacatggtactacgcttaatttggtaattgcctttaattttagtcatatacactaggttggtcgtgaacaacggtactgcattgtctgcgcttaatttagagagttgctcacgatagtcaagaagtgaaacatattcgctctctttctcataatattctcttcgtttatttccaaagtaccaaagccacataatataaagaattaccaacataattgttagcgtaacataaccgccatgaataaacttaaccaaacttgaaattagaaagattaactcaataaagccaaaaaacaaggcaattacaagcgccattcccttatccagatgtttctttaagaattcatgcaaaagtacagtagtcataagcatggtaatagtgattgctaaaccgtacgcagcctccattttttgggagctgccaaagaaccagaccacactgattgttattacgcatagtatccagttgacagttgcaatataaatttgattttttatattacttggatgtctaataaccattctaggcaaaaatttcaaaccaattgcttcatcaactaaagtgtaagatcctgttatcaacgcctgggaagcaatgattgcagcgaatgtggctaacaaaataccaaccaatcgccaatttcctggaagcatttcataaaatgggtttaagtttgataaattccgataagcattgtcatctgcgtgcctaattatccaagcaccttggcctaagtaatttaaaaatagtgtaatgtatactaacggccatgttgcatagatattctgcttgccaacgtgacccatgtcagaatataaagcctctgctcctgtggttgctaaaaaaatacttccaagtataaatattccaactttgttaaccggactgaagagaattctaattgcataataaggcgaaatagatttcaatatcattgggtaattgattagattaatgattccaaaaacagccaaaaatccaaaccacaaaaccattaccggcccaaaagattttccaattataccagttccaaaacgttgaatcataaataatacgagtagaacaatcgttgtgataatcaagacgttatgttgagaattactaaacacaaggggtccaaactcctgtttctttagtccttcaattgctgaagtcacggttactgcaggcgttaatgttccatcagccaaaatagctgctccaccaatcaaggatggaaagattaaccattttgcgttttttcgaactaacgcatataaagcgaaaataccgccttcatgcttattatcggcttgcattgcaatgacaacatatttcaacgttgtaataatcattaatgtccaaaatatcaaagaaactgatccaatgacataatctggagaaatatttcccattttaccagcatcaccaatcaatgcattcataacatacaatggtgaagtaccaatatcaccatatacaattcctaaagtaacaagtgcccctgcaacagaaacacgttccagttgcttattcatacttgcttgcctccaacgtcatttattgaaatatagcattgcaaaatgctaaacctaaacactaataaaagcaactatgccatattgatcgaagccataaattatggatcttctattctttattgtcttcttgaaccatctgatagccaactccaatgtgtgttttaatatactgactttgagtattaacttcaatcttctttcgtaaggttgcaacgtaaactcggtacaccagtcgatggcaaggtgagtcgaccatcgttaatgtggaagcaaattcaacgtgatatcaacaatggtgtgaaaccgttttaaattgtgttaatatataaaacgtattggaattaacaaccttactaacattagcctcagtccttaattggattggggctttttttgtttgagaaactatttttaatgtcttttattactactgaaccgggtctccgggtgcatgaatagtaccatcataattaacaccccacgacaaaccatcaccttcgtcgaatccatatccattactaccctcactaactgttaacgaactaacatccattgaccggttctggtgcaaaatttaaaacaaacgcatattaagtgcttttttgactattggcagtttacaccatcaatagttgtttcaattcagtgattactgaaaacccgaagagactaacatttcttcgggtttctttttgaattgcatggacaacttcaacacccgctaaagttctggtagctgttcggatggtttgaaaaccagctgagcgaacccgatgtcgcttaatgaaccgatgatcttgttcaattaaattatttcgatatttagaacattggtgatttcctttcgccaataagccatccttaatcatttgcctaattgctttcaaagtcccaccatactgatcagtgaccaaacaactaggacgaccataggtcgttaataggcgtttcaaaaaatgataagctgactgataatcacgatgtttacgtaactcaaagtctagcgttaatccatgactatcaatggcacgatagaaataacaccaacgacctttgattctgatataggtctcatcaactcgccaactctgactatgtgagcatcgctgtttccgccacaataacttgaatagcggaccataatggtgaacccagcgcataacagtcgtatgatgaactgtaattccacgatcacgtaagatttcgacaatgtcacggtagctcaatgaaaacctaaaatagtagccaacggctaccaaaataatgtctttttggaaatgtcgacctttaaaatagtttttcaccatagctacctctttttaagctaattataatttaaactgaaaatttttgcaccagaaccatcggacgcaaattgagcgcgactttagtctctctaagcgttgttattctctaggaaaactaaaagccaagctgaaaaacactaatctaatgcaggtcgggctgtccattctctgtgttaatttagaccggctccagcgcgttgttttggtatgcctatttttcgaaaaacaggctctcaccagtgatttgaccgcctgaaaggacataatattcattagattcgtataaaatactaccaagcttaaccataagcccaccaatccaggaaccgtaacacctgaaaaaccaacggccgtcactccagccgttccaaatgagtcgtctccatcgacccccgaaccaagcgtcagtggtaatctgtcagcacctgccaatccagcgacaaattcgactaacacgaccgccacagcggttccggcaactaatcccttaccagcatcggcagctacagcttttacaggctcagcaccgatgaataagtcgttgccacaaactaacgaacactcggcaagttggtcagtagctatcggtctcgccttattgattggattactcggtagcgcttttgtcctgacacgccgaactaagcatcggcattcataattagcttgtcacaccgtcaaaaaaatgagctgctcacgtcgcgttgaactgacgatcaacggtgtgagtagctcattttttataatttcaacttgctgctagtaacactgcgcgatactttgttagtcggtctcacgatctagttgctccagcgccgtttttaattgtgcttgcgcactcgcatccagtgagggatacgctaatggcaattccgacaggcgttgattgatgatttccgaaacacagagccgcgaataccacttactatccgacggaatgacgtaccacggtgtcgctttagtagccgtcttggtgatagcatcatcataagcacgctgataatcatcccaatactgccgttcctgaatatcggcagctgagaatttccagttgtgacttggaatttcaatacggcgaataaaacgttgcttctgttccgcctttgacatgtgtaagaagaacttgagcactaagtagccgttgtgttgcaagtaatcttcaaagtaccgaagatcgttaaaacgacgttcaaaaaaagcatcatccacttgtttcttatcgttaatctcaccgacgtgctcattcacaataatttccggatggactcgactaacaagtacgtcttcataatacgaccgattgaagatcccaatcatgccgcgtttggggacccgatcatgaattcgccataaataatcatgcgcaatttctttagtagttggttgcttgaacgatgtgacttcacagccttgggggttgaccccattcatgatatggcgaatcatactgtccttacccgccgcatccatcgcctgaaaaatgactaaaacaccaaatcggtcttgtgcatataacttaccttgcagttcagtcagttgcttaatattcttggcgatttgcgccttgatgaccttttcgtcttcaaattctggatcaaccgccgttgctaatttagttaatcctaatttttgctttccagtatatcggtagtgcttttcaaaattcacgttctagcttcccctcaatttatcgataatcgactaatgtcgctagcggttgatgatctgctggcttgccagcaacggccgctttgccaattgaaacgagcaatagtggccgataccgctgggcgtcaagttccaaaatagacgtgaatccggcagcatcaaacccggtcatcggattcgtatcaaagccatgatctttagccactaacataaattgcatcgcaatcaggccagcatctagggcgccaatggtctcgtcaccagtatcaaattgttgcccctgactggcctgaaacgctggcgattggtgttgattttcacgatccagcacaaataagacgacggcactggccgtagttaactgactggtattaccagtcgcggcacacaaccgttgtcacaaggctgcatcctcaatcaccaacgcccgaatcggttgttgattcaacgcggttggtgccaaaaatgcggtctgtaacatcgcggtcatttcttcacgcccaattttagtttggccgtcatattgccgaaccgaatggcccgcattcatgattgcttctaatggactattcgtcgtcatcagcttcaccttccttaattgtcagtatagaacagccttcaacatttcgccagtatgacggttattcaggagactctagctaattataatgatcccccaaatcagttcgttagcgctcgacagcggagagtgctaaatactggcattttttttcgaactgattaatatagaagatgaaaggtaaaggaaagaaaagaaagattcaacagtggtttaacagcctttaccaatcattaaatttagaaaacaaggagattggttgttatggcaaatgacttaatgaatcgatttgatgttgccccattttttgatcggatggcacgttatttctttagccctagtcgttttgataacgactatgctgactttggtaatctaaaaactgatattaacgaaactgataaagactatacgttaaaagttgatgtcccgggaattgataaggaaaatattcacttagcatatcaaaatgatacgctatcgttaaacattaaccaagaaaagtcgtcagaacaaaaagatgaaaatggtcgagtgattgctagtgaacgtagccatggcgtcatgtccagaagctacacattaccgggtgtcgatcgtgatcacatcagtgcatcagttaatgatggtgtcctaaatgtgacccttccaaaggtaactgagagtgatgaacacgatggtcacattgaaattgagtaattagcaaaaaaattatttcttaacgtctttgggggaatgaggatcaactcattgcaccactttgaaacgcttaaaatccaataacttttaacagaggagattggtattatggcaaatgaaatgatgaatcgtttcgcaatggatctgttctttgatcgtttagcacgtcgcttctttagtccaactgaatgggaaaacgacacaatcagtaacggtgaccttaagaccgatattaaggaaaccgacaaggattacatgctgaaggttaatgttccaggaattgataagaagaacattcacttggcttacaaccacggtgatctggaaattaacgttgaccaagcccaagcttctgaaaagaaggatgaccaaggtcggttaattgccagtgaacgcacacacggtgtcatgtccagaacctatgaattacctggggttgaccgcgatcacatctcagctaaaatcgacaatggtgttttgaacatcattttgccaaagtctgctgaaagtactgaaaatggtaaccagatcgagattcaataatttgtcataataaatgggttacgcataccatttaaaataagcgcaccaactcatcaaagctggcacgcttatttttttctaaattaaatgggcctcttccaaaagctccttaatccaagttttttcaaccttcttcaagcctaattttcgaatcggctttggtaatggtaggtcaatttcttcgagttttttcttgtcgttcatataatataccgatttcagcaactcacgaatatcataaactgagccaaatacctctggaacccctcgttcaatatttaagagcgtatagacagattccatagctgttctaaccgaatattccgttgtaaaaaccgtatctcgagatggtgattcagcaaaattcccaataaaggctaaattaaccgatccaaccggcaccacttttggtcgatcacccttagctctgggcataaaataactggtaataaacggcatatagactggtactacattgatatactcctgacttgaaagttgatcgatcttgctctccggaacgcctagatgataaagaaactcttcagcaatttcttttcctgaacaattttcaattggttttcgaatgtaattcccatcgacatctgaatacaatccatagatccaaacggtggtttgatttggcttttgttctttaaaatgaggttgccgatgaaccgcaaaactcatcatccaattagaatcagtgactgtaataatcccgcccgaattgattttgtgggcatgcagatcccgtttggttaatcgttcaatgtaagggtccaactcgtcgttttcaatcgttgccgttgcggacacaaaccaactcttcttcggcaagttctgatagaagactttaggatgaccaaaatcatcagattgagctgccaaattttcccacagcatccatgaaccacccggttgatcagtaatcggcgccggtttatcatgactaccataggttgaactttccgtaattgatccattggtgacaaataccaaatcatttggcgttaacgtcacggtttgtttttgaccactaacggtgagtaacaatttcctggcaactttctggtttccttctaaatcaaccaaaacattatcaaccgttgtctcaaattggacatcgacatggtgatcggttaaataagccattaacggtttaaccatcgattcgtactgattgtatttattgaatttcagtgccgtgaaatccggcaagccatcaatgtgatgaatgaatctcatcacataacgtctcatttcaacagctgaatgccacttttcaaaggcaaacatggttgaccagtacacccaaaagttactctcaaaaaacgcatcagagaaaaattcttgaatggtttcggtacccaatttttcttccggcgtcaataccaacttgattagttcttttgaggtcttaccaagcgtgtactgaccatcgtctggaacctcattaccacgattatagattaaacggcaattagaagaattcggatcatctttatccagccaataatattcgtccaagtacgaagcacctttaatttcaagagacgggatggaccgatacaaatcccacaaacattcgaaatgatcttccatttctcgtccaccacgggttacaaagccaacattgggccgatctgtgccatccaaagaaccgccagctaccggtaattcttcatagatatggattttttcaccggccatctgcccatcacgaattagaaaagctgcagcagctaaaccagccagccccgagccgacaatataagctgacttcttctcgatgtctttaggttttcggggcgttgcaaacgcctcataatttcctttactataatacacgagaaagacctcctcattttaaaacagagaatcaatcaacttgaactacgcgataaatgaatttatcgttacatttgttattattgtattcttaacaggccaactatttcaagctttaagcatctctgttttgattgcgccatcataaattgtcctgattcaatctattacaaaagcgtcaaccaatttggttaacacaacttattaaatgtaaaccacattcttagtgtctcctgaataaccattttttagcattaggtcgccttttagacggctttttgattataatggatgcagtagttttgttggaattttagaaaaaagttggttctgaaaacttatttttttggtcaatttaagtttaggtcttcatggcctttttgtttaattatgatgttgcacttagattgtaaatccgggaaataaaaatctgttaggatcatcatccatgactcctaacagattttgtttatggcatattattttttacagctggccccaagtagccgaactgatcgatgggaagaggtaaaccagtcgaccgagttcagccgcgccaaacttaaactccatcgccggcagcaacgtattgatcacgttgtccgcctgctcactgacttcggtgacgccaaccaagtgatgatccttatcaaaaatcagggtgtcatcaccttgggtttcgttatcaacctgccgataccaatcatccggcaagtggttggtttgaacggtcagcccctgcttctcagcgtcctcaaccgatacgccagccttggcgattcttggtgacgtgaagactaccgatggaataaccggatactgaatagcatcgctggtctgacctgagaagagcttgcagagataggttgattcaaacacggccgttggggttaacttaggctgagtcttatcgataacatcccctgaagcgtagatgttctcaacgctggtttgcaaatgatcattcacaatcacaccatgggcattatacttaacgccaaccttttccaatccaatatcttcaacgttgggaatccggccggtggcgtccaaaatccaatcaacggttaacttatcgttatcgccatactcaacgtcaaattgatcgccattgcgaacgaatgccgaaacgttagcgttcttaatgaacttaactccacggtcttccagatccgcgataacctgctcaacgtacggttgatagaaactgcgtaaagccttgtcactgtgcatcaaaaccgtgacgttagccccggcagcgttggcaatcgtcgcaaattccatactgatgtatcctgaaccaatgatcgcaatgttctttggtaattcagtgaggtccatgaactcacgactgtcgtgagccaattcggttcccggaatatcgagacggtgtggccgtagtccggttgaaaccacgatcttgtcggcagttttttcttggccgtcaacaacaatggtatgggcatcttggaagcttcccttaccgtggaaaacgtcgatgccaacactgtcaagaaggccaccaatcatccctggcaagcccttaatcacgtcgtttttgtgggccacattctttgcccaattaatggtcagcttgccatcgaccaccccggcgagtcgttcaacttctcggcttaatgcaaccggagcatctagcgtaattttagcgttacagccatagtttggacaagtaccgccaatcatatccgcttcaacaacgccgaccttcgcgccggattgaacgagcggaatcgcgccatcaaatgttccgtgaccgctacccaaatataaaacatcataatcatattgatttgccatataggatacctccaattcacaatcgacagtccattacattgtacacaatctactactatcttcattatagcggaggaggagagtggattcaaaataaccgtttacaaattttgtcagccggacatttgaaagtaaaccgtgatccacaaaaaggtcggcgcaacgattagctgccccgaccccgcaatttgaaataagccatttaaatgattaaaccagcacgctcttcttcacgtcgttggccagttcaaagttatcggtaatgattccggccacatgatccgctaacagcttccgttcagtactgggatcgtcaattgtccagatccgttccttaatattacgcagcggctgataatggttaagatgaagcccagcaaggtgggcgtcaatcatgagttcccgtggatgaagtaatgggtgattggccaacaaataatattgttcatttggacttaccttgtaagcatccttcagggtctgtaaggaaaatgacaagtttgtggtatattttggttcttaattaccccagttcaagcagtgagcaagcctctttctaggtggtaactttattattgcaatctagggagtccaatttatcagcaaactcttttaagtagtagtgtttagccattgcttctgaatagctcattttaattcctccttgtttatctctacaataatagtataacgattccccctaaattatgattattgctagttattcctacttttcagttttacgtctcttgtttctagtgtgctaacctgtaagtcaaattcacgttgttcattcgtagacagctgttcatagaatgattgaatagcagtatcaacggatagtcgctgattctcggcatatcctatcattgccattgcttgaagcttgtttctagtatggttgctaatcttcaaattagtatcaaacgtgactgaactgactgctttactatcactagccgttttgtcaaaatctgatgctttagcctgcttagctggcttaggaatagcatttgctttgtttctgttagaccgaataagagagttagccatgttcaattacctcaattcgttgtagtagttcatcagttacatctttataaactgcaaatacacgtttatcaaactttgatttaaatgtaattcctgtaatcccgtaccgctttaaacgctgcattgagtgaattctagttttaaataagttctcttcaccaaattccgagattgcattagctaccgttgcttcatcaactggtgctcccgcttgcagtaagacagctaggattccaactaactcaagtcttggtgcttgatactcatcaatgacttcttcttgaatgtatttgataaaggcctcagcaccttcaaaactatgttcatgtgtctgcataacaataagacaatagtccgaagcatacagtgcgctgtcggttattaaactaattgtcggcggtatgtcaatgattacatagtcatatttagcttttagaggcgttaaaagcctatcaaattctttcaccctatcattataattatggagcttttccatgtatctcggatataacgagaagtggttctggtgcaaaatttaaaacaaaagtatattaactgtttttcttaaccattggaagtttacaccatcaatagttgtttcaattcagtgattactgaaaacccgaagagactaacatttcttcgggtttctttttgaattgcatggacaacttcaacacccgctaaagttctggtagctgttcggatggtttgaaaaccagctgagcgaacccgatgtcgcttaatgaaccgatgatcttgttcaattaaattatttcgatatttagaacattggtgatttcctttcgccaataagccatccttaatcatttgcctaattgctttcaaagtcccaccatactgatcagtgaccaaacaactaggacgaccataggtcgttaataggcgtttcaaaaaatgataagctgactgataatcacgatgtttacgtaactcaaagtctagcgttaatccatgactatcaatggcacgatagaaataacaccaacgacctttgattctgatataggtctcatcaactcgccaactctgactatgtgagcatcgctgtttccgccacaataacttgaatagcggaccataatggtgaacccagcgcataacagtcgtatgatgaactgtaattccacgatcacgtaagatttcgacaatgtcacggtagctcaatgaaaacctaaaatagtagccaacggctaccaaaataatgtctttttggaaatgtcgacctttaaaatagtttttcaccatagctacctctttttaagctaattataatttaaactgaaaatttttgcaccagaacccttttttatttgtaattaagataaagcgtttacaattgtgtggattaggactactatgtagttgcatcatatagcattttcctaatttaggttaactccagaattctctccagagatggagagttttttatttataattaaataaagcgtttacaatttttaaataaagtattattatcaaggtaatccttttagttaatactcgtttggtagatgtaaccttgcaagaactatccagaaatgggtagctcttttatttgctctcaaacgtattctgcggcaattttaaatcaaaagacgtacaagtatacgaaaacaggcctctcagttaatcgctgggaagcctgtttttttagtttacattacttattatttttgtattttaaagcgtctccgttttccaatgtacttatctgcatttgcaatgttttttgttcatcatcagtcaaaccctcaaaataagcatcttgtaactttttcaaagctctttgctgtgtgggagtgtcacccaaaattaccattgccttcatgaagttttttagatgattatcaattcttaaagtagtgtcaaaagtcactttgtctactttttttgatatgcttgatttttggttgttgtcttcattaatagaatttaaagaaacttttttagctggattaggtgtagattttcttgggattaatttacttgaatttggattatgaagtagttccgccatcatgatcagtcctttctattatttcatcagctacagagttatataagctaattatttttttatcaaattgatcttttaaaaataccccccgaatagagtatcttttaattctctccatatttctaatcaatgtatggagcatgttttcctgaccaaattcttcttcagcggctcttaatgtgctgtggtctactggtgccccattttttaacaagactggcaatattcctagtaaattcaagcgaggagcttcatattcgtctattacttgttcttgaatatatttcaaaaaagattcggcaccttgtaagctatgctcttgtgtctgaagtattatcataacccaatcagatgcatataaagcactatctgatataagagatatcgttggcggcaaatcaaatattataaaatcatattccgattccaatggttcgagtagcttgttaaaatatgtgaccctatctaaataactatctttaaattttttctccattactcttggatataaagaaaaatcagcacttgaaggaatgaagtcaatattatcatctagggttaataatgatttagacaaatcttcttcttgaattgaagacagtaatgtctgattgaattttaaatcatcacggcctaaattggcagctgttttgaaataaatatctgttgcattggcttgaggatcaaaatctattaataatgtttttttgccttttctagcaagtgctaagcctgcaagtgtagcatttgttgttttaccagtaccacctttaaaatttccaaaagtaataatttcacccaattaaatcatctccaagtttttatatgcaaatatacaaggatacattgatacaatgattataatatacaaagactcaaatatacaaggatacaaggatattttatttctggattgcttatatgtaggccttaaataggcgtatgcaaatatacaaggatattaggatacaaggattctaatatacaaagatataaatatacaaggatataaatatacaaggatacattttaaataaagctggattatcagtgcaacaagtggtactgtatactcataaacaaaaaagcaccccacgaattgtgagatgcaatcaaaattgaatataaaaaaagccacccccgacggcaatcgggcgcaactcaaacagtttataacgattaactgtattgtagcatgtgtggcgaattttgacaatgtagaagccaacctgcatggataaagtccaaactaaatagacacgtttgccagtgcgaccgcaataacaactggctatatcacataagcaacgacctcgtgttgtgggtgatgaatggtgatgaccaccaataagggtcagggcggtttactggtgcttacgagcacggtgactagtcacaatgctattagggcagtaattaatagggtgactagtttgtcgaagagacagcagctacgaggttaactagaatacgtgagacggccgatcggtcaagtagcagttaagttgtactctagtgcgacgcttatttttaaaatttgctcgtgactagggtacaactttgccattcaccgctcaaccaacctctcaatcaagcaggggtgacccactaagtcaataaaaaaaggagtgcttagttatggaatttagaggattaacttacaattatttaaaattgttttgccaagaatacttcggtgccgagtttccatgggaagttgatttagggttgctggaagaagctaaggatcaatacatattaatattattatggtcagaatttacacatcatgtgtcaagttgtcctggagtacccaaagaattaatggatatatttcactaagtttggtaaaatcagaatcctgttaaatcaaggtttcagaacgttacttgacctataccaattttacttcacaaagttgtaaaataaaaagcccacaaccatatggattgagtgctttactttgtgtaatgccaattatgtgaagtagaaattggtatactaaaaaaggctcccggtttaacactggaggccttttttctaggttacatattttgaggatgaatgtttttatcttcgtagcttttacttgggtgctgtaacatgatgaatactgcttagtttttggtgccgtaccccgcaacagatgcgtcgcttcgttggtattatcttaaatgctaagtaccgagttgagaaggatcatcaagatattggggttctaatcccgcttgacgacgaagaacttaaacctttgatgactaaagccttgagacgctactttaacgttcttagaagcaatgagaaacatatcaagaacgttgaaaactacttgtatggcaccatgcaaaacctatttggcatttggtggaatcaacaagcggctagagaatatgcggctaaacaccccgaagaagaaaagtcggccgacaacgataacagttggttgtactactagtcctaaaagactacaaaatcctttctaagcggttttaagacttactaacctaatttatacttaagttagatttaaatggcttaagcagaagaataggggcttttaaatgagcgccagagctaaccagctcaaaagttcagcctttagatcaacgccaagctcaagtgatttgaggccagggctttatctattgataaggtactcaaaaggtagtataatggtagtagtaaaaaaggagatgagacaatcatggcagttaaggaaaagaaacgggtccaagtcaagattgataaagatttggccgatgataccgaagcagttttaagcgaattgggcttaaatccaaccacggccattaacatgttttacaagcggattgttgctaatggtgctttaccttttaatgcgtctttaagcgaagaagaaagagctaatttacgctttttaaaggcgaccgaagggacaccagtcaccgagttcaaagacgctaaagaggtcgctgattggctcaacgatccagatgaggactaatgacttagtcagcctatacgttagttttgtagaaactaacggtggcaagtctcgaccagttttaattcgtcgggtatcagaacagacgatcgaggcttttaaaattactagtcagtatgaaaagaagtcggcttatatcaagcaacaatattatccgattcaagattggcaatccgctgggttgaagaaaccttcctgggtcgatcttggtaatatttatcgctttcccaaagccggtttaaactttaaagaaatcggtcatttaagtaagctagatcaaaataaaatttcagattttacgcttgacctaaaatcaaaaagaagaggtaagggtcaaaagataattcaacagcgatcaagtaaaaggaagcacaaagaaagtaaagcagagcttacacaaagaattcaaaaacagttaaaagactttgctaaacacaatcctgaaaataaaaacgatcggcctagttattaggttgatcgttttttaatttatccggtttatgggcgttaacatagtcagcaaatgtttttaaaagttcttcggtttcttcgaccgataggttatcagcttgaaagtatttttcgagcaaagcccctttttgaattaatcggcgagaacgggctttacgggcttgtcgattttcataatacttagattggcgtaacttaaaatcttcccgctcaattttttgttttaaacgcgcttgctgctcgactagtttttcatattgattagacatggaattttcctatctcgtatggctaatgatctacggactttacctttaaaaattcagaaaattgcttggctaaaagcttaatctgatcgttagacaaattagcataatctaaattggcttgactgatgatttgtttgcctagccgttgttcaatcttatttttttcgtccttaattttttgattaatggcttttaatttagcttcttgtttttctaagttactttgagacataacgatccctccaatcatattagaaataatcaccgaaactatatcatataggaaacgttaagtcaaagtataaaatttgaaatagcgaagagaaagtcatacactataagttaatttacaggaaccagaagactgagtgaaacgaggtcaatgcgcacttacaccccactaaattcttgtggggtaaatcgtgataaaatcctgtattagaagtcgccgatggcgacaacaaaatcaaacccataaacccaaagaaaggtggtgaccgacatggcaatttttcacatgagctttagtaatattagtgctggaaaaggacgaagtgcgattgccagtgccgcttatcgaagtggtgaaaagctatttgatgatcaagaaggtcgccactatttttatgcccgatcgatcatgccagaaagctttattttgacgcctaaaaatgcaccagcatgggccagtgatcgagaaaaattatggaacgaagtagaaagaaaagatcggcgagcaaattctcggtatgcgaaagagtttaacgtggcttttccagttgaactaagcgaagatgaacagaaagaattattgacaaaatacgtgcaagaaaattttgttgatcaaggcatggtagctgatgtagcgattcatcgcgaccaccaagataatccgcacgcacatgtgatgttaactaaccgaccatttaacccagacggaacatggggaatcaagagtaaaaagcaatatattttagatgagaatggcaataaaatgtataccggaactagcaagtaccctaagagtagaaagatactgatggtcgattgggataaaaaagaaaaaataactgaatggcggcacaattgggcggcaagtgtaaatcaggctttagagcaaaaaaacattcctgatcggatcagtgaaaaatcatttgtggaacagggaatagctgacacaccaatgcaacacgagggaatcaatagcaaacggcatgaaagaaaggcatttaatcaacaagttaagaactatcgtaagtccaaagctggctataaaaatatgcaggagaaagtagttaatcgaggccacttggatagcctaagtaaacacttctcgtttaacgagaaaaaagtggtcaaagagttaagccacgaactgaaaacttatattagtttggaaagtttagatgataagcggcgcatgctatttaattggaaaaacagtaccttaattaagcacgctgttggtgaagatgtcactaagcaattattgacgattaaccaacaagaaagttcactaaaaaaagcagatgaactcttaaataaagtagttgatcgcacgactaaaaaactttatccagagcttgattttgaacagacaaccgcggctgaacgacgggaattgattaaagaaactaatagtgaacaaacgattttcaaaggcagtgaattaaacgaacgtttaatgaatattcgtgatgatttattggtccgacaattattgacctttaccaaacggccatacgttggctggaagttattaatgcaacaagaaaaggaagtcaaaatcgagcttaaatatacgctgatgattcatgacgataacttagaaagtctagaacacgtcgatcaagggttactagagaaatattcaccaaccgaacagcaaaagattactcgagcagtcaaagatttgcgaacaataatggcagttaaacaagtcattcaaacccaataccaggaagttttaagaagagcctttcctaatggcaattttaatgaactcccaatgattaaacaggaacaggcctatacagccgtgatgtactatgatccagctttaaagccgtgcaaggttgaaacaatcgcacagtggcaggaaaaaccaccgagggttttcactacccaggaacatcaacaaggactagcttatttatcgggacagcttagcttagatcagctagagaatcatcacttacaacgggttttaaagcatgacggcactaaacaactctttttgggtgaatgcaaagccgatccgatgattaagaacagtcagattgagaaaatccaaaagcagttaaaagcgcaacaagccaaggacgaccagtatagaaaagcaaatatggggcattatcaaccgttaaattataagccagttagtccaaactactacttaaagacggcctttagtgacgcaatcatgactgttctatatgctcatgatgaagattaccaacgacaaagacaggcgcaaggtttaaaagagactgagtgggaaatggcgaaaaagcaacggcaacatcaaactcgtaatcggcatgaggatggtggcatgcacttgtaatcggaataaaaaatgcaccgttaaacctggttaaaagcggctgaacaaggtagaacagaattagaacagaaacttaatcacaaggagtgaacgaacatgaccactgttatcttagctgaaaaacctagtcaagcccgttcatacgtccaagcctttcaaaagagcacaaaaaaacagggttactatacggttagcgaccctgttttgcccgaaaatacgcttgtgacgtatggtctcggacatttagttgaactagccacaccggataaatatgatcagaaatatcagcaatgggccttatctaatttaccgattttccccgataaatacaagtttgtggtgtcagctagtaaaaaagatcaattcaaggtcgtcaaagacctgttaaagaaggccgataccattattgttgccaccgatagcggtcgggaaggctctaatattgcgtggtcaatcatgatccaagcccagattgacgttaaaaagaagaccattaagcggctatggctgaatagtttggaaaaagacgccattattaccggctttaaaaatcttggtgattggcacaaagactatttggcttataaagaagcccaaacccgtcaaattagtgattggttgatcggtatgaatggtagtcccttatatactttgttattaagacaaaaggttctggtgcaaagttgaaattaagcgtagatcaaagtgactgtgtttagtggttgtagcctatgccgctaacaattggtcgacttcttgatacgctgaaaagccgaagaggcctggcttctttcggctttctttgtgtatcgcatgcatggtttcaatgccgtataatgtcctagctgctgtccgagtgctctgataacttgcggaacgaacttgttgccgcttaataaaacggtgatcttgctcaatcagattattgcgatatttggagcactgatgcacacctttgtgcagacagccttccctagtaagctttttaattgcctttagggtcgctccgtactgatcagtcactaatcgatgtggaagaccataggtctttaaaaggcgtttgagaaaatgataggccgagttaaagtcacgcttcttgcgcagttgaaaatcaagcgtaagaccttgatcatcaatggcacggtagaggtaattccattgacctttgatcttgatataggtctcatccatacgccaacttttagagtaatcaggttgattcagttgttagagtactctgggtctgtactagaatttcggacagaaacataagagaattgatttatccgaaaggagtcctcaaaatgacctattcacgcaatcgctacgaccaagattttaagaaaaatgcggtacgtttgagttttaactcttccaaaccagttaaaatcattgcctccgaacttggtgttcctgaaagtgccctgtatcgttggcggaagctatataccgaagatggaaagcaaacgccgtttgcttctttagaagctgagaaccgttccttaaaacgtgaaaatgccgaattagcattggagcgtgatatgttaaaaaaagccgccgcctactttgccagtctccagaagtaacccccagcgataagtatgcttttatgttgagggaaacctctgtttctgtggtaaggtgggcgcgtttgttagacgtatcaacgagtggttattatgcttggcggagagctttgccaaagcgaaacgccaaagaaaggcaatatcgtcaacgaatcaaacacttttttgatcaaggacagggcacttacgggcccaaacgcatctgcggtttattgcgtaaaaatggtaataaagcttcctatcaccgagttgcccgtctgatggctgatggcggtctgtattcaacgctacgttgtcgtcatccgaagagtttgaccgatagccgacttgctcgtcaaggtgattatcccaatctagtgaaacaccaatcttttaagccgtttgaagccttatcaagtgacattacacagacgacaacatcagaaggaaaagcttacatttgccaaataagggatttgaccagcaacctagtgttagctcatcaaatatccaatcatatggacacggatttagtcttagcgacacttaaacaagcccaccaaaggtgggctttgccagaaacgtgtatttttcatagtgaccgtggtagccaatacacggccaaagcagtgacaaagttggtcaaccaatatcattggcaacgtagcttctcagcattgggaataccgggtgataacgcttggagcgaaagcttctttgccatcatgaagaaagagctcatttatcagatacaatttaaagatatcaatgatctgagagcgcaagtcttcgcttacatcgagaccttttacaaccgcgtaagggtacaagcacgcttagactatcttgcaccagtagcatggctttccttgtatgaccaagcttcacaaaaagtcgcttagcaaactgtccgaaaaagtgatgacttccctctagatagtatggtatgatatgcaaagtcccttttaacaagaaaggacaggcttttttgtcttgagggtggtaactttaaatatgtaatctcatctgtaataattagaattggaatgcttagaaaaagggggtggcagtgatgaaaaagaactggcaactaatgatggtgcttgctgtaagtgccattgcgctagtctttgctttcgttttaaagcaaccactgatcgcgcaagggctgatcacggtgatggggtcaatcattgctttaattatgttctggggatggtgaagaaattcgttctggtaacttcggcgttgacttgcttgccattacggcggttgttgccaccttggcggttggccagtattgggctgcgatgatcgtgttattgatgctgactggtggcgatgcgttgaaagctacgcagcaacaaaagcaagcagtgaattaaagcaattactcgaaaatgcaccgacaaccgcgcatcgtatggttgatggacacgttgaagatgttgacgttgaggcgtccaagttggcgaaacgattttggttaagccgcaggaagtcgtgccagtgatggtacggttttggcaggtgagagtttggtggatgaagccagtttgacgggtgaatctaaacggttgccaaaaacgcaggtagtgacattatgtctgggaccgtcaatggtgacgctgccctaactgttaaggtcacgcaacgggctgaagatagtcagtatcaagggattattaaactggttaaggaatctgaagcgcggccagcacaatttgttcggatggctgatcgttatgcggtaccatttacgttgattgcttatgtgattgcgggtcttggctggttcttctctggcgacccagttcgctttgcacaggtattggttgtggctcgccttgtccgtgattctggccgcgccaattgcgatggtctccggcatgagtcgtaatagccgcaacgggatcattgtcaagtcagggactacgctagaaaagttaagtgaagctaaaaactttgcctttgataaaaccggcaccgtgacacgcgtgattttaaaagttgcgacgattttgccacaagccggtttctcacagagatcagctttgaagctagccgcaagtgcggaaggtcaatcgactcatattttggcgcgttactggcagatgctgtgccgacagctgatcggctgccagcgacagatgggtcggaaaccactagctttggcgttaatgacggtggatggccgcaaagtcaaggtcggtaaagccgagtttgctgggacgaaggctacggttgatacgactgccggtgtatgtgaatgttgatggccagtacgcaggtgcgatcacattttccgatcagattcgtccagaagcaaaagaaacgagacgaaactgcacgaattaaatgatgctaagctgattatgatttctggcgaccagcagtcaatcgctgataaagtggcggcacaggtcggcattgaccaagtctatgcggaacaattgccacaacagaagattgagagttttggataacgtccctaaggatggccggccagttgtgatggttggtgatggtgtcaatgatgcaccttcatggcgattgctgatgtcggcattgcaatgggtgcacatggggcaaccgcggcaagcgaatcggctgatgccgtggttgcgcgacgatttggcgaaagttgctgcggccactttaattgctaaggaaaccatggccattgccaagcaagcggtcctcatcggcattgcgatttgtacaggttgatgttaatcgccagcttcggtgtcattccaacaattattggcgcaatgctgcaagaagttgtcgataccgtgacaattctctatgctctgcgagcgcgaaatggtttgcatcggcaggcacttgtgtatcctgttcgagaaaataaaagagcataatcaggatctggtgcaacagtctgagagatgaccatctaaccagctattgacctatgttgaaggttatgcagctaacaatgcttctaattcgtccacgactgagaacccgatgagacttaactctcgtcgggttttttgcgtattgcgtgaacaatttccacaccgctcaacgttgcactagcggttcgaatgctttgaaagcttgctgagcggacacgatgacgtttaatgaatcggtggtcctgttcaatcaaattattgcgatatttggagcactgatgcacacctttgtgcagacagccttccctagtaagctttttaattgcctttagggtcgctccgtactgatcagtcactaatcgatgtggaagaccataggtctttaaaaggcgtttgagaaaatgataggccgagttaaagtcacgcttcttgcgcagttgaaaatcaagcgtaagaccttgatcatcaatggcacggtagaggtaattccattgacctttgatcttgatataggtctcatccatacgccaacttttggaagtgcgccgatggcgcttacgccatagagcccgcataatcggtgagtaatgttgtacccaacgcatgagggttgtgtgatgcacgaaaataccacggtcgcgcatcatttcaactagatctcgataactgatgttgtaacgcaagtagtagcctacggcaaaagtaatcactgattgattgaattgccgtcctttaaaatgatcagtcatctgaaaacctccagtttcaattcatgatacaggatgcactctccctgagtaaactttgcaccagaaccagacaaaacggggtacgcggggtatactcaattggtcgcgtgcagacgccaaccttgtatatggtctatcaaagggaccaggcaatcaaaaactttaagccggaaccctattttgaactaaatgctgaaattcttgctaatcagcaaaaattcttcgcaaaattagacccctatcagcggtttaaagacgaaacagggctaatgacattcatgcaagctaaacgcgttcagaaaggctcacaggggggtttaatcaaggacgtccaaaaacaagacaaaaaacgagctagtccccaactattctcgctatctagtctccaaagtgccatgaataaacgttatcacgccagcgccagccaaaccttagcggccattcaaagtttatatgaagccaagttgctgagttatccccgcaccgattgtgcttatatcactgatgaagaatttgagtatttagtggctaatctgacgaagtatctggggttagtctctaaacaagtcgctttaaccaataccaccccaaataagcgctatgttaatggaaaaaaggttgaagaacactacgccattatcatgactaaagtcgtgccgacgaaagagaaactagccagcttgcctaaattacagcaacaagtctatgacttggttttaagaacgacgttagcgatgtttgctgatccgtacgagtacgaggaaactaccattattacccaagttggtgacgccaattttaaagcaaccggtaaggtcccaactaagcaaggttggcaagctttatttgatgatcacaaagccgatcagcaagaagcagcaactttaccgctcgttcaccaaggcgaccaagttcaagcaaatctgcaaacgccgcaaaaagaaacaacacctccggtaccctttaccgaaggtaccctgattacggccatgaagaccgccggcaaaacgcttgatgatgaagaagcccaagcgattcttaaagatgtgcaaggcattgggacaagtgcaacccgggccaatgtgctggaagtgttaaagaaacgtggctatttagttactgaaaagaacaatctccacgtcagtgaagccggaattactttatgtaaagcggttgaactcgaacccttgctaactagtccagaaatgacggctaaatgggagcaagcgttacagcaaatcagtaccgaagaacgcaccccggataattttttgagccaaattaagaagtttgtggcgaagttgattgctgatgttccgacacaattaaccggcagtgcagccattaagcaacaaattaatcaccaacagcaagcgcaaaaagccgccgaagtcttcttagaaacaccacaagcaaccgtgttaaataaacagaagttttacattgtgaaacccaagcaaggtgaagattttaccttacctaagaaatggagtagcaagacgctcgggaagaccgcaattaaagcgttggtcaccaagggggaaacgagcaaattaaagggtttcaagagcaaaaaaggaaagttgtttgacgccaagttaaagcttgacggccacaaattaagttttgattttgattagaacctgcctaccgccctgcacgttgtttcggttggtgaactcgtcatttaggtttacttttcaaaaaccaaaaagtgaacctaaccaacgagtgtaattgtaaaagaaggaggatatatcatgaaaaatgaactggaagcattagcaagcgaattacctattttgacggataaaagcagttataagtacctatcagaagttgcgggtaatggcaaatatattcaagttgcgtggcaaaaaaagaatgctgaatatttagcactttacggcacacaatctatcaagttaccccaaattgataattctgtagagtttgtagacgccgaggagggttaatcatgccaagtaaagttgaaactgaaaaatggaaaaggcagcttgtcgaaaatgccgaaaaagaaattttaaaactaactgatagtgaaaaatttaaaatttatcttgataccgtagcaaagtttcaccggtatagccaacgtaatattgaccttatctattctcaaaatccaagtgccagccaagttgcaggctttaaaaaatggcagaatgattttaaacgatcagtaaataaaggagaaaaagggatcaggattgcggcccctattattaaaaaactaactccagaggatcagaaaaggcttgatacgaccgaagaaaaagccatagttggttatcgctatattccagtatttgacatatcacagacaagcggcgaaccagtcctaagtgctaaagattttgtcaaagaaaatttagcggatcataaaaacgttactaacctatacaacgaactcaaaaattatttgaataacaatactgatattaaagtcagtgaaaagagattgtcagaacttggtggcgctaaaggctattttcaacctagcactagtgaaatcgttattggtggcgatgagcccgacaatgctttgaaactaaagactttatatcacgaatatgcacatagccagctacacgggttaaaatcagcctttaaagatcggccacgagcctatcaggaaacccaagccgaagcgattgcatatgtcgccatgcaaaacattggggttgatacgggcaattactccctcgggtatgtagctacctgggccaaagataaagccgtgatccatagtgctttaagtgaaatccagcaagttagcaacaaagtgattgagcttagtgacgggttaaccaaacaattaggcttacaagaagcacaaaaagagcctgagcatgatttaaaaaagctatcagcccaggatcttaataagtcctatcaaggcttgcaactgcaagttaagcaatcaactaatccacaacaaaaatcagaattaaaaaatcaattaaccgatgtgcaccaggaaattagtgatcgaacgcaaaagcagctacaagcgtttgctaaacagaatccgaaaatcaaacaacctgatcctgaatctgatcaaagtctgaaacgttagccagtttttaaaggacatgctataataaagacagaaaaaggaagccccgctggaacaggacttcccatacaagccgctttaaaggcggtggcctagattacaaaactacattgtcgccctgtaaccgaccaaagttacgcagggcggcttttttatttgttccttttgtcgatgtatgttagcaacgccaaaataaacattgcaaacagcaacatcaacgagagtgtctggaagacgctcattgactgtgaaacctttctgaagattattccatgttcccatgggcctcacctcgcaagggaaaagacagccaccgcccttaaaacttcttgcttggtctattatacagaaaacttgtataggaagaaatatttcttgtaaccagtgtgtattttttgctttagaatgattgaaatttgtttgattaaaaagcaatagctatgtagttgcttggacattaaagtaggagtgatatttatgattgtaaaagaaacaccaagaaacattgaagagttgaaaaagaaagcaaataataaaaacagttggcgtgaacgtttgtctgctgtaaatgttttaaaagaatatgattgcaagcagtctaaagatatacttgctagacttgctataaatgacccagtgtttaaagtgaaagaaacggcgtttcgtgctgctcaagcattaggcgtaaccagtcatggaaatcctatttatttaggtaaaggaaagaagggaaatctggttaaggggattaataaaaaacttgaaaaggttagaaattcattgccagatgattattcgttcgaagattttaagagtgaatttcaaaaaaaatatccaagcgcatatgatgtttatgagggtactaaaaaaaattttgatggttggcttaaaaaatcagaagcaaatttaccccatagaaaataaagagagtaagacagattaaacgcataatgtatataagttttgaagtttaggaggacaagatggctattttaaaacgcactattatttttgaagacgatttagttaacggtacagctaccttaaatttaagttctggtgaagttaaatcaataatatttaagaataaaaccattgaatttttttaaacttcaacgttgataaagctgcgtttgatgaaaaaaagggatttaaagataatcctgaaatcagtaaagaaatttctgataaactactacagattgacactaagattataaattatctcgttggtttttttaatttggttaatttggattcaaacaaaataacgaagaaactccaaataaattttaatgatggcacttggacagattgtcccttaaacttgaaaatcattttcccagatagaactatgagcatgtccttatctgatgaggataacttaaaacgattaggaagttgtatcattcacaatcaaaacataccattatcgttattgattttgcagcacagcaaatctattatagatttaagaataaggtatgtatctttggctatggcagcagaaattggtgttaaagaagcttttagtagtcagagcactgaacttagactactaattgagaacttaccgagtccatcaattgttaaattaacaagtgataaagtctttaatcccatttttggttggaaaatacctaaagaattgagagcagcacttgggaagggaatggagtgccgaaataaattaattcatactaatggggactctattaatcttgatttagaaaaagttattgactatcaagaaaaggtacaattattaattgcgcttttattgcaaatatttggtgaaattatttttttaaggttcagttagtgtccacttaaggttgggttaatccatagcagttaaactgacaacagttagaaagcaaataatataaaaagttaaaaagaaggttcaattatgaaaaaaattcttgcagttctggtcacaggtttaatcgcggtcgcgatggttttagatgcttactggttgttacaaatgaataaaggatcatcgactgatgctagtgcgaccaccacgagtcaagcaacgacgactgacagcacaagtgacaccaccagtgttagttcgagttcatcgacgatttcgacgagtagttcgagcggcaagtataaggatggcacttataagggctcatctgtgagcacccagtggggtaacgtccaggttaaagtgaccatttctggcgggaaaatcaccgacgtgacgatggttcatagtacaagtgaagatggtgaaggccgcagtcaggcaattgacaaccaggctgaacccgtttacatctctgaaacaaagaaagcccaatccgctgatatccaagctatctctggggcaaccgtgacatatgaaggttacacccaatcactacaatctgcactagataaagcagtataataaggtagaggtataggcatatggaaatgcattctaagcgtatcaaagggcataccatgttgagttttgtgtatcacacaatgggcacggtttttactagccaaattgttttggatgagacagccgagaagccggcgttgctcactaaaatagaacactttcaaaatctgttagaagtatatttagagcaaatcaatacccgtttttcaccgtatttagctgattctgaggtcagtcgctataatcgtggtgagatcacggccctgacgatgtcgccagatctttatttcgtctttgcctcaagtttagcagctaagttagcaacgcatgatgcttttgatgccaactacaatggtgaatttgaaccctctggttttgtgaagggctggtcgattgaagttggcttttcaaaattccttgtgcccctattccaatttcccagtgtacaagcggtgaacttgatcggtgggggtgatatgcagatggagacccgggagcaatcggactgggtatttgacatcggcattgttgatccgaccgatcgttatagcattattaagacggtccagctaaaaaccggggcgattgccacatcgggcatttctgaacgggggcaccatattaagggagctgtcgacgatatcctacaaacaacggtgattggccaagcgctccaggaagttgatgtgtgggcgacggccttaatggtgaatcctgacctagcactacctgacaatttaagtgggtttatttttacaagacaagagggcgaaacacatgctaaaatctcataaatattggctcggacttttctggatggcagctatttttgtcttgccactaccgttaatccagaccctatcacaggggatgcaaaacacaatcaatatgtcaaatctattcgcttcacaaattgggatcatcgcgtacgtctggatgctttttgccattgctatttccatcaaaccgaagtggattgacaaattgatcggtttgccagagatgtattttgtccatggtatcctgggtgtcagtgcgattgtcttggcttttacacacaaaatgatgttgcaatcctcagggttaattaaacagactggtgatatcgctttaatcatctttattgggattgcggcctactcaattttcttcatgtcgggttggttaacatcaagaagtaaagtgctccgaaagatcaagacaaccattgaaaagattttgagctatgaagtctcggtatggctccatcgtttaaatattgtggccacgttgttagtgtttgcacacgttattttaataccctacattgtgacaatcacgccattcatgacattgttctttgtctactcaggtgtgaccgcggtgatgtatctgtattatcactttggtaagccgctcctcgcgagacatgggcaactcatcgccaataaaaagttggcccattctgtaactgagttggtcatccgtcttaataaaaatgcgcagattcatccgggtgattttgtctatatttcatttccagaagttgatggttttaaagagatgcacccattttcaattttgcgctatgaccaggcgcagcgagaattggtttttgccatccgtaattggggtgattttaccgcaaagttagacaaaataccagtgggtgccaaggtcaagattgatggctcttatgggcgattgtcagaatcgattaaggaaaatgaaggcaagcatttagtctttatcggctcaggggtgggatcggtcccactgatttcactcaccaggtcgctgatcgataagcacaaggtgtcctttatccgtgtggcgtcgaaacaagaagatttaatctatgagagtgatttgcaggatttagcggtgaaaaaccctaatctagattatgcatcgcaagtgggacgcttaaaagaaaatcaagtcaaaacgattgttgctaaaaatcgcaattccttctatattgtgggtggttcaacgccaatgatggtcggcacgatgaagttgctccaagatgcaggtgttcgtaaagctgacatctatggtgagaagtttaatttctaatcatagtataactacataaaaggccctcaaggttggcaatgccaatcctgagggctttttacgtagttaatcattttaatcacagatgtttgaccattagcaaatcgatttggggtgcatcaccaagatgaacggtgcggctacctgcgaattcaaaaccgtagtgttgataaaatgtgatggctgtttgattgtattcccaaactcctaaccaaacttgttttttacctaagagggtagccttagtctttgcaaggttatataagatctcaccgaggccttggttttgaaaagcgtggcgaatgtatatacgttcaatttctagagcgtccttgaaagtattttccgattgtgcatctgccgtgttcaatttcagatatcccactgcaccgtggtcatcatcaaatataaaatggtagattgcaagaattaaccgaacactgcaaactgctgaaaaacctttcgtggtgattgccagttgagtgttttcattggtctcgcattgagccaatgattaatttgatctaattctttggcgctaactgtttcaattttgcgttctttcggtataaaacgacggacgtatcgatttaatatctcattactcccacgttcttctggtgaatatgggtacgcaaaatagactggaatgcctagtttttgctcgatttcgttatattttgcaaattctcgcccacaatcaacagtgattgacttggcatttttgatcccttgaaaaaaacgaattaagactggcgtcactgcctgactattgcgcccagtgacctgtctcacgatatgttgccggcttagtctttcagtaattgtcaccagcacatcgccacgtcttttacccgattgcatggtgtcaacttcaaaatgtccaaaggtttgtcgtgctttcacactttcaggtctcgtttcaatcgaacgaccatgcacaaatacttgtcgtctaccatcagattgacgcttttgacggatacctttgtcaggtaaatcagctaatgacagtttgagtcgtccagcattgagccaattataaatcgttttgaaaggtaaccctaaaacatgcgcagcggtttctggtgaccacttcaatataccaatgtggtgattcaaaaagacagcgatagctggtgttagcgtgtcatgacgaccacgtagatgacgttttttcaatgccaacgcatgagcaatctcagctttatagggtgtaacttgatgaatttcaatcgaaacggttgaaggagagcgtttaataaagcgcgcaatggcacgaacagaataattcaattcgagtaaagtttgaatgacagtgcgttcttgagatgataaactagtcatgagtcgcagttcctttatggttgttttagacaattaccattaaaggcgctgcggcttttttattcaagtgttcggtttaattttacaatctaccatataaaaatgcattgggtcataatgaaacaactagacagttttacgagaaccttatggactttgtaagaatcgatcctggagaggccactaatcaaagtaaaataaatcttacagaagcacaaaaagaagctatttcaaaaagtaaaaaaaatgcagcactgaaaataatagtcagtgaactgtaatagagcaaagaaagttaaatggattttcaaaatacaaacggccattagggtataccctattggccttttttgattctgtgctatactaggaattacaaatgttcattagaactgtccaaaaggaagtgctgacaatggctaaaattggttatgctcgtgtgagttccaaagacgcaacctttaggatcgacagctatgcgcgttaaaaggcgttataatatatttacggattgaaattcaagtggagctaaagtactgggcaaatcggccgccagaactgcaaaaagtgctggcctatattcagtgagggagaattgtccctgtcactgaattaatcgcttaggcaaacggaacaccaagtcgatttgactaagattatgaacggtccattttcaaaatagtgtgtgccaccctagattagttgatttaccgtccctgacatggattgctgaaccctagaacgttgcgtcaactgatgacctggaccgcattattgaacgtaagagtatcagtgccgcttgaaagtgaacggaagcggagtcattgaacgcccagcacaggcatgccctggcgagcaacaatcaaatcttcactggtcgaagcctcatatgccaagattgatcgcccttacaagcattggcgatttagcgggtttctcagaagcggcggcatagagctggtgaatagagggggccccgtaatacggcgggagggaggttaagcgaacgaccctttatcaatatcgaaaaagttcatataaaagatgagatttatatccgataagtcgttatactagttttagagatggtgacctaatgacattcaagttcaaacaaggggagacgtactaaaatggaggctgtatcaagatcaaatagtgtgttgacctatttgactttagcaatcacagaaggaagcttaaccgcgctactcggcctcaatggcgctgggggcaagaacagagccaaactatatatcgatgctcacaaagatttaatccaccatgaatgatccgaatgagaaccctacatagaagattagccatgtatcgggttcaacagagtattgttatcgagatggatgtggacaggttatgagaaactttgagtattctcaaataaaactttagataagacgccaatctatcatttgatgcttgatttcgaaaatcgggtaactgaactattgattaatcaaattacggccgactttcctgtgggccacagacggcgaccgagggtttgatatagcaagacgctactaggatcaacctgatattatttttttgtgtagccaactacgggttttggatatcaaaccctgcgcgcctgatttggggaatattgtttgcattcttgcaagatcaaaatattaaccattattttgaactaacaacacagtcttgaagaagcagacaagcagatgaggttatatatgtattgcatcggcaaaatacaattgggtccgcgggtctagtccgctgataattgaaaaccaaaacgctagagaactcgtgattggtttctgaacaatctgatcaataatggcttgatggatccaaggaaaatatttcatacgcagattggacatcaaaatcaccatttgtttacggctacttgggctgacagaagcactctcatttatgattaattgtgtaaggggtatgtttcgtcattaaaacgttcaccttatcaagagggacgatggtgagctttttttgtccataccggaaggaagatgctttgatatgggattacatactgttagacaagagaaacactgttattcggtatccgcaacggcccgagtaatctctttctattgtggagcaatgattttcatttctcttatatttctttctaaaaacgtcaatggagaagtgagcttggaaaactgtcccctattcacaccacttacttgattttgttgggaggggacgtttatcattgactgccggatcaagcaacgccccctcctaacctcacttggagacatgtagaaggagataaagaactcaaggttattaaatatttttgttaaacaactttttcttcattttgaaatcaccatgactgaaatgtcctgtaagtgcacgctttggattggctttattatgcaaatagtttgtctcactggatgaataggatacttttcaatcacagataacttgaccatatgccatgggagtccgctctaccagctgtaatttgctttgctctttttagcttcttttactagcagtttgtaattaatatgatttttatcccgtttagtagtcgctttgattccttgaacgctataggaaaaattgattggcacgcctctggcttgtttttagtgggtacctatattccttggtattcttcctactttggcttcagttacttatcaaattaactacgtccggttgtaacaatatgtacagccatttatcgacaaatacttatggcagataaattaaaaccctcttttcatggtcagtcaaagccattttgaaacaaacgatggggattaagttgagtgcatcatttttaactggaagtgcaatcgacatgtgggctccttaccatagtatcggggg

SEQ ID NO: 430 - DNA, 86567 bp, Unknown
  Metagenome-assembled genome
cattgattattttttattgttactagcgaattgacttcgcaatttgttaattggcttcgattaaaatcgaagcaccctacacaatttgtttgtcgaaaattttattcagttttcaaaggtctacctgcaaaacaacatttaaattttaaaaggatttaaatgatccagtttgatgaatcgttgttgtcctgcgcttcaagcaacgaaattaattatatatcatcgaatcttttaagtcaagaaaaactttttcggaagagattggtatatgttgttcgtatcgaagcaacgaataatatattaccagctattttagagaaggtcaacagtttttccaaattaatttcaacttttcttgaaaaaactaagaaagcagtaaagtaaagtcacataaccacctaaaacagcctgctatatgtatactaacacttgaatacggaaaaggagccaggaatcattggaaaaaatcgtaatcattaatgccaaacgaacacctatcggaaaattaaacggtgcgttaaaagataaaagcgccgttgaacttgctaccgaagtctccaaagcattaattaaaactgcaaagataccaattgaagatattaatcaggttatatttggcaatgcaattcaagctggcaatggtcaaaacattgcccgacagatcgaactaaacagtggcctttcagctaagacaacagcttttacaatcaaccaagtgtgcggatcgggtttaaaagcaatccgccaagctcaaatcgaacttttaataggaggacacaaaaccattttagcgggtggtaccgaaagtatgtccaacgtgccatttttgaacatgaatcaacggcagccaaccaaattcggttcgttcaccgtttacgatggtttggaacgtgatggattaactgacgcattctccaatcgtccaatgggaataacagcagaaaacgtcgctaaaatctatcacgtcagcagaaaacaacaagatcaatttgcacttgattcacatcttaaagcccaagatgccattaatcaccattattttgacgaagagcttgtgccgattcaaacgactaataagaagaaaagcaccctcgttagtcaagatgaatccgttcgctttgatacaagcctcgaaaaactgtcaacacttcccccttcttttgaaacaaacggcacggtaactgcgggaaacgctgcagggttaaacgatggtgcttcagcgctgctgctaaccaccgaatcacatgccaaacagttgaatctgactccattggcagaaatcattgattacgccgagcagggaattgatcctaatattatgggatatgccccttatcacgcaattaagaaactactcactaatcaaaaaatgcaggttaccgatattgatctctttgaaatcaacgaagctttcgcatcacaatgtattgccgtttcaagagacctatctattcctgaatacaaactaaatattagtggcggtgccattgcacttggacatccgctaggtgattcgggagcacgcattgtgacgaccctgatcaataatttaaaccgtacaggtcaaacatacgggatcgcctccttatgcatgggcggcggcatgggttcagcaatgctaattaaaaagtattaatcagaagccgcagctttacacaaaagacgacgccgacttaaaaaatttaagtcacgccgtctttttaattttgtcattcttttcctattacaacctaacacgttcactttccggcaattctttaaagaaagaactctgatatagccaataaagcactttctttgtacttttagaccgcaagtcgtatgccgaatccagtgatcgaaagaccggatcagctttcataaggtggctaaacgcgctcagactgtctgcctgcgttaagttggtataattggccatccctctaccaatcagcccggagaagtgtgctacgtggacgacagcaatgtattctacgtgttctgttaatgttgtcggcttaacagggatcgtatctgccagtgatgttaagtcaaaggataaatgttgtcgggcaaacaaaagtgcccgatttctggcaaatgagtagtttagtaatagaggcaaaagcaatttttttaacattccggtaaagagttgatcaaaggttccgtaatcaatttcaattttttgatgaaaatcattaataatcggcttgtgtaatggtccgaggacataggaaaaaatctgttggaagttttgattgtcagcatttctcgtatgggcaacatcacttaaatcaagaattgccatcttttcagcacttttgacaatcgttgccggtatccccatttttaaaagaataattgtctcgttcatttcaagacttgatgcaatagctgtccggtcggttgacgtcatcagagctggtatgccaagcaaatcatagttatctacagtcaactgttccctgcagatcgcatacaacactactgataccatcaaatcaattaaacctgtaacatctcgcttaataaactgcctgactgcatccttcaagtggttatcagcaagcgagcggacaattatcggcggcaaatcatgctggtcactgaaatcagggccatcgtcgctactatactgaaataaagttcgcccactgatttgatattgggtcaaaaaaccggaatcgtactcattaatcatgcccttaacaatatggctatcagaagttgctgttaatttcttatagggagagacgttccttaaataacgattaatgtgggaaaaccaggtgtctgccatctgggaagcctctttaattgagaatcctgcaagtcgatccataatggtcggcaaaaaaccaccttcaccagaaattgcctggacaaaatggatcactgcggtttgatagcccaatgtgaattgtcgttcatcccggctttctccaaggtaggccgcataatttctccccgtagcctgattcacaatttccggcgtctcctccccggttgcccatgctatcatgaaagaaaattgattaaaattaattgtcattaaatctttaacagctgccaaatagcccaattgacttgactttgccattttaaattcggcaagtgataaacctgcgttcaatgggtgattcaaggaactgtgtgcgccccttatgatacgttcggaatagatcgtactttttgcgtatgtattttcgccaagcagtttagacacaacggagccaaacaatctgaaagtcctttttaccccggcaagctgatcagatttatgagacttgattgaagcatcatctttaaccattttttcctccttgcaaattcaatttattctaacacaaagtgttccctcaaaaaacaatctttaaaattgcaaagccccctcttaattagttatgataaacataagaaatacgaaaggatgtgtcaaaatgggcaaattaaaaaacgaatctgataaagtagttggcaaaacaaaagaaggacttggtgaagcaagcggcgacgacaagatgaagttaaaaggtaagctccaaaatgcatccggtaaagcaaaggaaaagcttgaagacgccaaagacaaagtcgctgaaaaagcaaacgaattcttggataagcatgagaagaacaataaagaagacaactaattctagttgtgaaggttgaaagacggcatcgattgcagctttcaaccttttttcttttctcacccgtttcttcttgcaattaaaaaatcgatgctctataatgctctttcgtgctaagcaaatctaatcattcagattagaaataacaaagaggatgtgagcattgatgtctgcaacatatttacgtcaagcaacgaatcaagaccttccagaaatcagaaaaattattacggatgctaaagcctttctaaagaaacagggaatcgaccaatggcaggacggttacccaaccgatgaagatttggaaaccgatgttaaattcggcattacctacgttctaattatcgacggaaaaattgcagcaaccgcagcccttcaccaaggcctcgatgtgagctacttacaaatccacgacggtgaatggttaaacggcgttcacggcagatacaccgcaattcatcggattgccatgtcggcagattttcgtggacagcatttatcagaaaaaatgattaccggtttaattaccatttcaagtgtcctaggctataaagacgttcgaatcgatacacatcccgataacaagggcatgcaacatgttatcacgacaaatgggttcactaaacggggaacgatttacatggaagaaaaggatcatgaagcatccccacgttacgcctatcaactaatcattgaataatcgaagccgtttcttttctctgtgtttgccttgatgtacaataattttattgaggtgatctaatggcactttcagatgcagatgttaaaacagctttaattacaatgtatgttattggcattatttgtttgggaatcactttcttcttactcgataaggtcaacggacaattcttcaccaagttttcaacaggattaattgtcattgttttaataatgggtgttattcttgtgaacttgtttagtttaagttgattctaaagttaaaaaccgagccggcaatttgccgactcggttttttgattggtatttgggactgctttactagtcggtttgttccgcacacttgttctaggactgtttctcaaagcagtattctacacataagggattcatttcaaaaatccaaacccgggattcccgaaataaacgccttatgctccgaatactaaccgctttgttccgcacactatatttttttaaacgcctgatccaaatccgcgattaaatcatccgcgtcttccaaaccaactgataaacggatcaattcatctttgatacccattgccaaacgatccggctttggaatctcaaaatgcgacataaatgccggtacttctactaaactttcagcagcgcctaaactaaccgccagaataattaattggaggctgttaacaaatttagcagcgtccagcccatccttcaattcaaacgacaagacaccgccggcaccccttgcttcatccttaataatagcgtaatcaatactattcttatcaacggttggataataaaccctgccgactttatcgcttcgctccaaatacttaataatctttttagcatttacaatatggcgatccattcgtaagttaagggtttgaatcccacgtcgaagcaagtttgcttcctgcggtgccaaaatagcgccaatactattttgaagggtataaactttatcacttagctccttagtcctcgtaacaataataccggcagtcatatcagaatgaccgcccagatatttagttgccgaatgaaggaccaaatcagcccccaaatccagtggtttttgaagatacggcgttagaaaggtattatccacgataaccattgcatcatgttcatgggcaacctttgaaatctgcttcacactggaaacttttaataatggatttgtgaccgtttcaaaataaaccgccttggtttccggcgtgaacgcctcttcaagtgcctgaatattttgcgtatccacttcagaaaacttaataccgcgtggcttcaagaaatcattcaccaatcgaaaggttccaccataaatattatcgccaataatgatgtggtcccctggcttaaacaacgaaagtgccgcgtgaatggccgccatcccgcttgaaaaagcaaatccccgatcaccattttcaagttccgcacacacgttttcaacattatcccgagttggatttccagagcgctcatagtcccaacgtacatctgagcccaatttgggataacgataagttgaagaattataaattggcacattaacagcaccagtatggttatcgtccggcttgccgccacggactaataatgtattaaatttagtcaaaaaaagcacctctacatattgaattatcttattaagttgatttattcaggttcacttggtttactccgaacgttaaccgctttgctccgcacactcttttaggactgctccaaaagactgatccctgccatacaaggaactaaatcccaccttccaaattcgggaatgttgaatttagtttcttgtactctgggaccaacgcgtctttttccgcacactcttttaggactgctccgtcagccacaagcctgcatacaaaacaatcgtcataaaattccagaaacgagaatttcctgccgcttgctttgtactccggcttgtcccaagctgactccgcacactcttttaggactgctccgccaagcagtaccgcaccatataagggatcaacttgaaaaatccaaattcgggatttcccaaattgacgccttatattccgggcactaaccacttaacttcgcacactaatctataacgactttcgttcccatcggcactgtccggttaatccactttgcgtcaggaattgaaagtcggatacaaccgtgtgagtttgcctttttacccaaatgctgagcttccgattttatatactgtccctccgcattggtcggtacagtatgaaacaggtaaatcccgtgatctttccatgatgtccaataatgagcaccttcacgtgaatcaccattatagaagaaattgcctcgttcctgctggatgtgataggttcccttcggggtagaatgatgaattccagttgatgcatacatcgtatataggactcggtgttttggactcatgacataaacgcgttgctttttcagcgaaacttgcaaaaaccgtccattattagtcgtaatcttaggatacggcttgttttgagacggctttttccaattaatcacttttacgcttctattcttttccgagtcggtccgatgatgactatcagcgtgatcactgccacaaccggtaagcaagagggccaaaactattgcggtaatgatttgtaaatattttcgcatcatatctcactctcaataacagtctgaattcattatatcatcatccattttttcggttatgaagtcgctctttaatttactcatgcttaataattagccaacctgaacagcctggtttgcggaaagtaaatacagatatttgtgcgtaatcggccgccccagaatctttgaaagcgctagtccgtaaagttccagctgaccccgataccgatcgataatatccgaaattgtcgtttttggtgttatatgatccgtcttataatcaaacaaataaacagcttcgtcagtgacaacataaccatcaataatgccatgaattaaaatcgtctgctcatcattatcttgaaagtctttaaatacatccctggctttcatcaataatgaaaatggtgcctcacgatgtgtgctttccggatttgccaacacatattcgccaacttcgctttgataaaagcgtaacacttcgtcaacattgatttgtgaggcaactgcagaagaaataacctgttgtttcaccaaattggcaatcaaagcctcaatatgttcaaccgttggaaccgtcgttaaatcaatctgttgaagtaccaaatgcgtggccgtaccgatttctgtcggggcaggctttccgccaccctcagaaataaactggggtacttcaaaatcagttttcaaataacgaccggtctttgcaagtttattaacatccagtgttgaatagcccgacaactgcgtattatccggatcatcaaacagtcgcttgatctctgaaaccgattggtacgccgttgttttggttgccgcagtatgagggtacttaaaggtcatcacttgggaaatggctgcctttgttggttgagcgactgtaagctttttctgtgccaactgatcgataaagtcatttggtgatgtctgattggctttctgcctccctgaggccttcgttattctctcatcgtcgtaaaaatcaagattaaacaacgtcggatcgcctgccaacacattggaatgaatactgtccccaaaccggtctaagacattgggatgcctggaaatggccggtccaatccagcccaaataacttttagccgcattgcgaaccgccgccggaagtaccaactcattggcgtcggtcaacccctgccaaccttgaatcaactgttgattgtcgccgcttttttcacccttaacctttgcgaccagatacaaacgttgctcggctcgggtcattgcgacatacaattttcgcatttcttcggacaagccggcattttttgtcatatccagaattgcctgcttctgaagtggtgacctaaattccctggtctgattattcaggtagtcaatcccaatgccccaatgatcatttaggacgtatttgccgattgtatcctgcatattgaactgcttgccaacatcattcaaaaacacaattggaaattgaagccctttgcttccgtgaatcgtcatcacgtgaaccgtattttcagacgtagtcgggttggcattagctaaatcgttatctctttcctgcatcctctgaatgaattttacaaattgaaagaggcccttaaagccattcttttcgtaatcagctgcacgatcatacaacgcatgcaaattggtttgacgctgaagacctgcaggcatcccgccgacataatccaaatagccggtctgatcataaatatcccaaatcagtgagaccaggccatcctgctgcgcaacatctttgaaacggcgcagttgtttcataaaccggtcaactttttgataaatccgggttgcgtaatcattaggctccaagcggtcaaatccacgatagaaatccaataccgcctgataataattaccggtattgcgattgattcgtaaaaaggccaattgattctcatcaagaccaacaattggtgaacgaaggacggccaccagagcaatatcttgaaacgggttatcaataatagataataacgacatcataatttgaatttcagttgttttaaaataactttttgcaccggtaatttcggcaggaatgccatactgggtaaaaatatccgaaagtgtcaattcattattatgggttggcgaaataatcgcgatgtcaccaaaagtaaccggacgcatttcttccaattttttatcataaatcagctgtttgtcatcaactaaagtccgaatcttttgagcgataatctctgcctgaccactgtcactgtcttcaatctgatcaccggcccccaagtcttcattcgaagttgcagcaactgatgatttagttcgatagatgatcaatgatgcgtcggccttcatgtcatccggataataagtcgcaccaaattggagctttgatttgccggtatacgcaatatcacccacttgatgatccattgtttgttcaaaaaccaaatttgtaaaatcatcaatattctttgccgatcgaaagttctctgacagactaatcaattcattgtcattatcctgttcgatatactgtgcctgcttcttaataaacattgtcggatcggctagcctgaaccggtaaattgactgcttaacatcgcctaccataaatcgattgccccgatcgcttcgagcaatcttgtttaaaatggcatcctgaagacggttgttatcctgatactcatcggtcataatctcatagtattgatcctgaagcctttggcgaacctgtttggcctgctcactgacatcatttaaaatatcgtaagccgcatgttcaatatcaatgaactgcatcaaatgacgccgagccttggcctgcttatatgcagccctgaaggttcgcacaacggtcactaatttttcaatacgtgctttggcggcattcattaagtcaacgttgtcctgttcattccaagcaaagtagccggtcaccaatttttgccactgctttttcatctggtcatttgttcccttaaccagtttgtgaacctgcttttgatattcatcggcatcctttgtcaattttgcttttgtcatcgactcaaaatcaaaaccggtgatcaactgccgaaggccatcccagtcagcagcttcgataacgcctttttggagctgggtaaccgactccagctgcttcgtaaataaggcttcatccttctccaattcagcctgttgcgccattttgataattgcctggtgagaaataaccagccgtttgaccgcatcagaaacttcccgtgaaattaatgccgtgtacaactcactgtgaataagcccctgatcgccgatctcataaaatgacgcagcgtcatttagccacttatcagggtcctcattaacattagcaaactcgtccatctgaaaaataacgtttgttaatccctcatcacttctgtcatttgaaaagttttcggttaaatcggcaaacgtatgatcttcatcttgaccatacaatgcttcacggacgttatcccagacttgttccttcaataattggatttcagtattatcggagagtacccgaaaattgggatcgattcctaaaatatagtagtaacgtgacaccaacttttgacaataagcatccatggtcgtgatatcggcaactgcaaccttacgaatttgcgtcaataaatgttttttactttcaggatcggtcgcctttgaaaattcggactgaagcgaccctctcaatcgttcacgcatttcctttgcagcggcatttgtaaatgtcacaaccagtaattgatcaatgttgatgccttgatttttcaccatatcaatgatccgatccaccaacaccctagttttacctgatccggctgatgcagagaccagaacattgccgtcgggacgatctttaatagccctttgttgatccggtgtatattgcattatttttctcctctcagctttgaaataatgtcctttttatcatagtggggcactaatcgataattattttcaggcaacagtggatcaaaattcataatcgattgatacgacgtaaattgtaagggcgtaacgttatcaattttaacaggggcaagtgacgtatccccgtcaaagatccgttcggaagcatcgataatcaatttttcggtccgatccaaaaacgcgtttaaatcattttcggtaattgtcgaagaattcttgccaacattgccattcgctaatttattaaacggatagacaagtgaatgaccatggtccttggctaaatcggtatccaaatgatcgaccaaatcgacatcgtccaccaaaatccctttatatttatgctgggtcaataatgatttttccaagcctttcttaaaatcatccggcttaaaagtcgcgttgtaaatatgcatgtaaagcgcaccggccaataacgcatcacttgagtcgggattcaaggtggatagattatagcgcaagacgtccaaatacgtcagtaactgcattgacgtgccaatgtatgcctgattgaaatcgaattttttatcagcagatttataatcaacaatcccgaagtagcgcttatcgttgactttcatcgaatcaatcctatcgattcttccccggacattgacctttttttgatttggcagctcaaaactaaggccctttaagccctttgaagacggttgaccaaaaatcaactcggtattttgtggccgcatcggcgttatccgttgctgatcacgcatagtgcggatcatttgctgaatggttgcctgaagctgtagcgtgatgtaatgcatccgattggaactgtttaaaataatatattggaaattatcaggatcattcaccatggcttcaacattttcagccaccaagtcatcaacgtcacggtcacttagtcctgccagatcgattttctgctcatgaaccatcgaaatgattcgatccaacgcttcatgaaaaaattgacccgtagaagccggtgatagttcgaattgttcccgttcctgtaagcgcagcccatatttcagaaaatattcatacgggttttcataaaatgattccaactgtgaaatcgaaatattcaacgcactcccgtacagcttttcagcaatttcccgacttaacggtaccggcacatttttgtaatcaatactgccaagtaatcggttggttaagggggctgcatccgggtcctgctttaactgattaaaaataaacgcccaggtatcattcagctgtcctttattcttataagtatcctgaataacctgaatcaagtgatgaagcgttgcccgtttagacccgatatacacattgacggccctttgattgtccggaacggcagcataattcacaactttcaaattaaaatgagccgcaattcttgatacatagggggataaattaatccccgattcatcattcacatgattggtgtaggaaaaaatcaaacgggaagacggactggtaaaagctaaataattcaggtatggttcggctgccatctgctcatctgccggatcatttaaatactggctgtcacttaaattgtcctgaatttgtgaaacatcgtcatcaccaaaaaggctttcattaacaattctttccggcattgtttcatcgtttgaaccaatcatcatcgttactttacgattattcatctgaaccataccgctttcggaaatttgaacctgatccagtgttgacggaatctgagaataggttgccccttcaaagcccgcgtaaatcagggcccagaaatcttgagcaacaaatggcttatcacctaatattcggacgttttcatccagtaatgagcaaaaagtccgccaaacctgttcgatttcatcggaacggttgatgtcttggcgatcaacagccgcattccgccaatcctgcaaacgattcacaacaccgttttcaaccaggaatcggtacaaaatcccagctgcatcggcattggtcttggctttataaaaacggttgtaaaaattgggcaatgcattttttaccaaatgccgaatgacattaatctgctgcgtgatccgcttgtctttgtcggtcaaaaccgtaccgtcatcatcgtcagccacccagacatactgccaatcgtcatcctggatccactttttaccctcaaatccgtttttcaacactaaattttccgtcaatgaaacggcctgccgataatcgtcaatcttcattgccgttccatcggtagcttgcggcaaaacaagttcggactttaaaaaacgcatgacatcatcgtatcgataattgcgtggtcggtctggatcatacatatcgaacagggcccctaatagttcaaccaaggggtgatcaaccatcgatttttgaatatctctgaaataagggatttgctgcatcgtaaaaatcgagtccaaaattgtttcataactgtccaaatgtcgggtcaaaatcaagaaatccgaataccgatacttaccggttgacaccatctggcgaattctggttgccatctgatccaattctgagtattgattgtccgcttgataaacctggattgacttcgatactgtgatgggattgtcatcaattgcgcccaacccactcgactgaatccaaaacttctctaatttcagcaaatcagcactgattcgtggctgatcggcagtgataatgggaagatacggaatttggttatctgcagcaaatttataaaatcgtaaaaataatttggctgattgatagaacaggttgggttggtcaggcagcgccgtccgataaggtttatccaaaatcaacgacatggtcatactggcaccgccttgagtcagtgtctcaaccaaacggcattcctgtgcggtaaacttcgaaaaatcggaaatataaaaatgataatgtgacagatcctgcctctgcaaataatcgcttaacaggtttaacacattgtgattatcaaaatactggtcatcaattcttttttcatattccgcataaataattgaaaagtcatgcagtttatcccgcagatcatttgaaagccttgattcctgattttcgttcattttcattaggtcttccggtaagatgtttccagcttgcatgactgaaatttgatgggcaatttggtcaatgaagccgggtagtccggcttcttgactaaatagaatcaagtcatcctgatgctctgtcataatttgatacaagagcatgttgatccctgcaggactgatccgttgtttttgatactgagacgtcgttcgcaaaaaataccatgccaaccttgtaaacgataggacctgaacgctgctttgagccgtcacatcatcgtttgccccggccaaccgctttaggatgccaacttctgattcaaatttaatatgattgggtaccaaatagaagaactgatcatcgggatgagcagatttttgcttttttaaaatgtcaatcatcttttcctgatgatcatacccgtttgttcccagtacaaattgtaaagtcacggcttgtcctccttcaaaatttacatcaattttagcatatcttcctacgaaacagttattcgttaaaaattaaacatttagttattaaacacaagcgcttttcgttgaacattgtgaaaaataggctattattataagtggatgtaacgatgcatccattatttgacctaaatgaaagctttatgcttgcattgatcttgtttacgaggactttccgaccgctacgatttaatatcggaagcaagaatttacgatctacccccaatatatctttcaagttcaaaaaggtcggttcgtcctctctcctaataacgcctggatccaaccaggcggtacatactattagttacattcccttgaaagtgaaatgaaagcccattatctactttcatttcactttcaattaataaaagaagttgaggctgcagcaaatgtacaatgtacatgagttgcagcctcttttaatttgattatacaagcaccgaccccactcatttaatcgttaattattcccgcttgcttcagcgcttcgaaccttattttccgacatcactttattcgtatagaactccaggtcatcaacgactttttcactttgttgcccctgtgtctgagccgtatgcaaattttgttgcgcaacggcccaataaacgagattgtcagtaatcggcaaaatgtctcgaatcacgtgaaagtcaaatttgtctgaattggttgttttcatatttaaataattattccaatcagtgaccatcttaacgctggtattctcctgctttgaaatcgccacaatgataacaaaatgtgaactgcggtttgccgtataaagttgttctttcagttgtttgatttgttccgggtccagtttaattgccatatataggatcacactcctaacattccttcaaatttttcaaaaattagtttaatcattaccagaatccattataccgacggaatggttaatgagcttttgattgacgaaagcgtcaaaaatcaaatcagcaacatttttagccgaaacactgcctaccgacattttgttgccttcattaaagagttgataatccgaacgttttccatccatcagtgaactcattctaattatagaatacggaatttcggattcgtcaacaatctttatggcatatctttgttgttttataaattcttggcgattttttacctctggaaataccatcggtgactttaactcatcatcaatgccggcataggaaagcatgacaaaatgctgaattttcggagcagcctgatcaattgcatcaaataattcttcaaagtccaaatcaacgtcttccggccccaatgcggaaagaagccaatcaacgcctcttaaagccgttacgtaatctccggccgattgaatattcccctgaaaaatccgataagagatttcatcactttcatcaagcaacggtaacagctcggagacaaccggactatgttgatttaaaattaataattttttcacgttttttacttcctagtcgaaattatttatgattaacttaatatgtaacataatatagaaggaaaatcaaaggaggattttgcaatatggcaaaaaacgtcacaattggtcaatctaaagtcaccactacgccattgggtttgggaacaaacgctgtcggcggtcataacctttttccgaatctcgatgaacaaaccggaatggccaccgttaaagcggcacttgacagtggcatcacaatgcttgacactgcctatgcttatgggctcggacgttcagaagaactcatcggtcaagtgatcaaaaactacgatcgttcaaagctcaccattgcgaccaagggtgcccaacttgttaaagatggtcaatcaacaatcagtaatgccccggatgatttaaagcgtttcgttgaatcaagcctgaagcgcctccaaacagactatctggatatattctacatccattttccggatgaaaacaccgctaaagacaaagcagttgctgccttacaggaattaaaagatcagggactgattcgggctatcggtgtttccaacttttcaccggcacaacttaaagaagccaataaaaatcaccaggtagacgtcattgaaaatcagtatagtttgatccaccgtgatccggaaaatcatctattcccttatctacatcaggaacatatttcatttgtccccttctttccgctggcatccggcctgctaacaggtaaatacgatgaaacaccaagaaagtttccagaagatgaccttagaagccaggatccaaacttttccggcagccgatttaaagccattgttgaatctgttaacagcctgcagccgattgcggataatcacgatgccacgattgcccaaatcgttttggcatggtatatcaaaaatccagcagtcagtgtcgtgattccgggtgcaaaatcaccagaacaggtccaaagcaatgtcaaagcactgagtatcgtgttatctgacgaagaattcaatacgattgataatgcgtttaagtcatttgaataagagtgcggaacaaagcggttagtattcgaagcataaggcgtttatttcggaaatctcgggtttggatttttgaaataaatcccttatgtgcagaatactgctttgtggaacagtcctaatccagtgtgcggaacaaagcggttagtattcgaagcataaggcgtttatttcggaaatctcgggtttggatttttgaaataaatcccttatgtgcagaatactgctttgaggagcagtcctaatccagtgtgcggaaaaagacgttttgattccagagtacaaggagctaaattcaacattttcgaatttggaaggttggatttagtttcttgtatggcaggaatcagtcttttggagcagtcctaatccagtgtgcggaacaaagcggttagtattcgaagcataaggcgtttatttcggaaatcccggtcttggatttttgaaataaatcccttatgtgcagaatactgctttgaggagcagtcctagtccagtgtgcggagctaaccgggataaaccggagtgtaagttgacaggcagtgaattcctacttttggaatttgatggctgttagcttacatgcaggtttatggttagcggagcagtcctaatccgtgtgcggaacaccactcacttccccgaatcacgcgttacctgatcattaatactgaattgaggatcaacctgcaacgtgctgattcgttcttctccccattgatacatctgatttaaaatcggcataagtgaacgcccaaggtcggttattgaataaactactttggattgtgttccggggatcactgttctggtaatcaactggtcttcttccatttcacgaagctggtcaatacttgaatacatttttaataatacgaggacgtgatgaattgccccgtttttacgtctaataaacgataattacctgccaataaattcccttgtttttatgaatctatgtatacactagcactcttaatatgctataatatttattgaaaaagtacaaacaaattaatgtatgaccaaatatcgttgcatgatgcgaattaccattacacgtggggaaccagactttaacttgtcccattgaggaatttgcaaatgctctgatttacaaggcccgccgatgaacacggttttggaattgttcatataaagattggccaagatgattaggtccagctattagtaagcgtgcctaaacggcatgactgcctttcggttattttgtcagtgtccagggttaccgactttaattgacaaccaaaggatcgtcactggtggttaccgcgtgatgatgttaaaagcattggcaccagagaaagaacaataaagagaggaggcatcccagtgaccacagtggttaaaggggttaaactgcgcttataccctaaccaaacacaaattgatcaattatggcaactatttggtaacgatcggtttgtttggaatcaaatgttagcgatggctaataaacgttatgaaaataacccgaaaagtcattttgttggcgaatacgatatgaattacctgcttaaaccgcttaagcaggagtacccatttctaaaagccagtgattccaccagcttatttgtggttaaccataacctcgcgctggcttttaagaacctattccaacagcgtggtggtcatccgcagttcaagtcccgccatagtgctaaacaagcctataccgggcaatcgacctgcgtcgtggaagctaagcggcgattaagattgcctaaactcgggagtattcggaccagcaagaccaaccaattagccgacgctaaaattaagcgctacacgattagtcatgatgccacggggcgctactatctttccctgcaggttgaaaccgaagttcacgatttgcccaagactcaccaaatggttggcttggacatgggcgttgccgatttagcaattgactccaacggggttaagtacgggactttcaatgcccagtggttcgaaaagcaagcgactttatggcaagcaaaatttagtcggcgcaagcgtcaggccaccgttgcgatgcgccaatggaatcatcaccatcaattatccaaaatggcactcaacgattatcaaaattggcaacgggctaaaataaccaaagcgcgttatcaagcaaaaatcgccaaccagcgcaaggactatctccataaactgacgacggacttagttagaaactatgatgtgattgtgattgaggatttgaaaaccaagaatctgatgcgcaatcaccacctagccaagtcaattgctaatgccagttggtatcaattccgaaccatgctggaatataagtgtgcctggtacggtaagcaattagtggtagtgagcgccaaaaatacttcccgaatctgttcagcgtgcggtcagaatgacggtgctaagcccttaactattcgggaatggacgtgttctaaatgccgggctcatcacgaccgcgatattaatgcggcagttaatatccttaattgcggactaaaagctattggttaggaactagccatggtaaaagagcgaagttctgtaagttaggtcttcggcataccgatgtaacagcctaaatactactttgtgttcccagaagctcggtcattcatgaccgagtagttcacccaaaccggtttaaccaaaggccgaaccatgactgcctacacaacggttcgtccggatttgtattatgcaggtgccgttgttaaagaccaacccgttgtcgtcgatcagaatttagttaccagcagaaccccggacgatttggatgcctttaatggttcaatgttggagacactgaaaagaaacgcctaattttttgaaaatcactaactgaaaaacggtttgtttttgattactatttaaaacttaatcatgagactggtcattttcctaaatcatctattggattagcttagataatggccagtctttttatgtagttttaaaagaaaacgctttataaagtaaataatcttcaccttttatgatatttaattcggttattgaagataatcagctataatgataatataaaatacgttgtttttatttcatatccgaacgataaggggagctattattttatgctaaattcaattgcaaagtttttcgatttcgaaggtcgaaacacgaacttccgaaaagaaacaattgccggcattacgacttttgtttcaatggtgtacattctgttcgttaatcctaacgtgctgggtgttaccgggatggataaaggggccattttcaccgcaactgccctcgcttcggcatttggctgtttcttgatgggattacttgccaactatccgatcgcaatttccgccagtctgggaattaacgctttcttcgcctattcagttgtcattggcatgaaggtttcctggcagaccgcattggcaggggtcttcgttgcatcagttatttttattattttaaccgccttgaaattacgggagaaaatcatcgattcaatcccggcggatttcaaagcagctatcggtggcggtattgggctattcattgcttttatcggtatgaatgacggtggcttgattcaatcaagcaaagacacgctggttagtttggggtctcttcacgttggtacgacatggctcacaatctttggcctgttggtttccgttattcttatgagtatgaaggttccgggtgccatttttatcggaatggttttaaatgccatcttgggaatggtaactggattaatcccgcttccacatcaatgggtagcgggcattccaagcctggcaccaacttttggtgttgcactttcgcatatcggtgatatcaactcacttcaattggtagtggttgttctcacgttcttgctggtaactttctttgatacggccggtaccttggtcggattagcagaacaagccgggttcatcaaaaataatcgtattccaagaattggccgggctttaatcgccgattcttcaacaatggcagttggttcaattttgggaacttctccaatgggcgccttcgttgaatcctcagccggaattgcggttggtggccgaactggttttacagccgttgtcgtgggtattttatttgttctcggaaccttcttctcaccattactgacggtcattaccagccaggtaactgcacccgccttgattatcgttggtgtcttaatggcacaatcattgaaaaatgttcattgggaaaaattcgaaattgccgcaccggctttcatcactttggtcggtatgccttttacttacagtatcgccgatggcattgcccttggctttattacctacccgattacaatgattgccgcaaaacgtggtaaagaagtcagtgccatgatgtatggtttggcagtcgtcttcgttattttcctttggattttaaacagctaatccatccagtctccgttccaaagaatcggcagccaagttgaaatatagaaagaaaagctgtaaagttaatgggttacaaataactaaataatttacaaggaaggaatttgttatgaattctaagactaatgttctcggcatcgacagtgtattggacttaaccaaagctgccgttgtcgctgcactctacatcgcgttaacgatggtctttgcagccgtaagttatgggcccattcaattccgtttttcagaaggattgaataacctcgtcccattcaataagcgctatattgtcgcaatcacgctggcatgctttatcactaatatcatgtctccaaacggtgcaatcgatatggtggttgggactgcagaaacattaatcaacttagtgacaatttatctggttaccaagcatatgcaatcagttgtttctaagttgattgcatcggttctgattgggacattctatatgttcattattggttttgaaattgccattattggtcacagtgctttttggccaacattctggagtacctacctcactgccggcattggtgaatttgttaccatggcgatcggggcaattgtgatctatctgattaatttgagatacaatttaagcgattagctattagtaggcagttggggaaaaatcgaaaaaacatttttaaagggcttgtaatatcagtgtatgctgaagttacaagctttttttgatttaatagggaggattagaatgaatatgaaagtaaccgaaagacttatcagtgaatccataaggtttgtatgtattttagttttggggactacgttatggattacgaaacaggcaggcgttgttttttggggagttggtttgatcgttagcctggtcgccgttttcttttctcccggatatattctaaacaagattgtttttaattatttcaaaaaacagcactatcagaagaaggacaaatgaattcaatttttaacactattttcacaataaataggacaaagacaacattaaaaagttatttttttattctgcatcaagtcagctaaatatgctatgctaataacagctaggggagcaatttgctgagacctttatcggaaccctttgaacctgagagttagcactcgcgtaggaaagccgttattaacgtgaacactaaattcaattcaaagaaactgcagtcttaataacttctctagcgatggttcaaaatcaattgctgggaagttattttagattggagagaataataaatatggcaagtatcaaagaacagctcttaactacaatcgatcaatatcagggggatttgttgaaacagctcgaccggattgtggcctttaacaccgtttcacctcctgcccgcaacacagctaagctgcaacagtttattcacgatgaactggaagaatacgggtttgatgcaaagcaacaggatttttatgatggcgatcaattattgtccgccaccaaaagcggaacccattccgataatcatcacagcttgatcctgaatggtcacgtagatgtcgccgcattggaaaatcgtgacgaatggcagacagatccctttaagctcgtcaagcgtggtgacactttaatcggtcgtggcgtaagtgatatgaaaggtgctgtggcagcttatctatttatttttcaactgcttaaaaagcttaatatcgagttacccggtgatctgaaatttcagtcggtcgtcggtgaggaattgggggaagccggtactaaaacactgctcaaacaaggcgaaaaagctgactttgcgattgtcggcgatacatccggtacccattttcaaggacaaggcggtgtgattaccggctggatcaccttaaaaagtccccatacctatcacgacggtaaccgaatttcaatggttcaaaccggcggtggcctcaaagctgccagcatggttgaaaaaatggtggtcgtcatttccgcactccaaacgcttgaacgctactggggcattaccaaaagttaccccggctttaaacccggaaccgacacaatcaatcccgcctatatcaagggcggtattcatccggccttcgttgcagatgaatgccgcttatggatcactgttcacttctatccaaacgaaactgttgaaggcatcgaaaaagaagtcgaagacgaagtgattgcggccgccaaggcggatccttggttacgcgacaatctgcctacctttaactggggcggtgactcaatgttagtggacaaaggagaggtctttccatcccttgaattagacaaaaacagtgcagccatgaaattactgaatacgtcctatcaatcttcatttggtcaaaaaccggttatcggtatgtcaacttccgtttcggatggcggttggtttggctattatcacatccccgccgttatttatggaccgggcgaattggttcaagcccatagtgataacgaaagtgccagttttgatcagttattaaactatacaaaatcaattgccggttttgtggtagattggtgtcaatcagaaaaataacgatttaaagaaggcttttattttggaattaaaaaatcttgaccactttgtcctgaccgtcaaaaacatcaatgcaagttgtgatttttaccacaatatattgggcatgcgcgtcataacctttaatcatggtcgcaaagcattgcgcttcgccaacatgaagatcaatcttcacgaggttggtcatgagtttgaaccaaaagcgcttcatccaactcccggatccgctgatctgtgcctgattacgacaactccactatcaaaagtggttgatgaattgcacgccaaacatattcaaatcgagctgggacctattgctaaaagtggcgcattgggcccgattaagtcggtttacttcagggatcctgatcgtaacctggttgaggtttcaacttattaatcccaacgaacctccgaaattcttccatttcaatgttcaatcgaatataatatatatgtgaaataaatcacgcattttataggaggcttttcttatgacacaagtatttgcaagtcccagcacctatatccaaggtccaggagaattatttaacagtgcccaatatatcaaaaaatatggtcaaaaagtgctgctgctttcagatcaaaccgttttaaaaattgttggtaaccaattcattgactatttaaagaaaaatgattttgatgtcaacctcgcaacatttgaaggcgaagcatccgaatccgaaattaaccgggtaactgaactcggcaaacaaagccaagaccaaatcattatcggtttgggtggtggtaaaaccgccgattctgcaaaagccattgcggacaacctcgatatcgccgcaatgattgcccctacaattgcgtcaaccgatgcaccttgttcacgactttcggttatttatactgacgatggtcaatttgatcactatcgattctataaaaagaatccggaaattgttttactagacaccaagatcatcgccggtgcgccggttcacttactgatttcaggaattgcggatgctttggcaaccaacgttgaagcaattgatgttcgcagagccaacgccgacaatatgttgggtgcaaagcagacgattgttgccggttcgattggccaggcctgtgaagataatttatttgagtatgccgaattggccgttgccgcaaaccgggctcatgttgcaaccgaagcgctaaaccacattgttgaagccaacacccttttaagcggtcttggctttgaaagtggcggattagctgctgcccacgccattcataacggttttaccgcgctatcaggggaaattcatcacctgacacatggtgaaaaggttgcatatggcactttggttgaattaatcttgaacggcagtgatcaaaaacgtttcgaaaagttcttgaaattcgatttaaagcttggcctgccaacaactcttgcccgactccatttggccgatgcctctgatgaagacttaatgaaagtcgctactcaggcatgtgatgaaaatgacaccatgaaatatatgccaactgatatcacaccggaagatgtttttgccgctatcaaagcagttgacgaatatagtcgtgatttccaaggcagatcagttatggaactagactaatcctgctttaaaacaactaaaaaacgacttggtcagtgaggcttctctctaaaagtgcctcaataccaagtcgttttttatgttgatcgatcatccgtcgatccagacaacagatcattacatttttttatggttagcttcatcaaccgcatgcatccctaaatagacaatcgctaaaacagctgccacaccaatgacaataatgatccaccaattcacgctgtacattggcggtgttgagataagagcggcagaaaggttaactgccaatatcacaacacatagccagaaaatataggatttataaaagttcttattaaacctcattttctcaccctcttagaaacgcaaaacaaaagattttcctccacctaaatcatatcatcttgagagatattctgttagtaattgacgttttatttgaaagaatcatatttataatcgctttagggtagacaatgaccaccatttaaaggacaactatattaaggattaacgaattaaaattaaaatattttcattttcttatttacttttcatttttaatctggtaagattctatcaacctaaaaaagcgaggaataaacttatgaaaaccaattctactttcaatttagccattattgccgtccgtgtcgtcattatttaatctgcgggcgcaattttgcatgcccgcaagaagcgggcagagttggtttttaagccaagaactgtcaattcggttcttggcctttttttatccttaaaggagctgatagatccaattaattgaacaatcataaaatattgacaaaaaacgctattgacaacgttgcttgatattaatcatccaggcctgcttggttgagactacccaatatctagtagcccacaaatgaaagagagttgacctcaaatggaaaataccacaccaacatatgattcagccgttaaatccgaaaccttgcaacgagacccggtgaaaaccgttattttggcctcaatgattggtaccgctattgaattcttcgatttttatgcttatggcactgccgcagctacatactttcccaacgttttcttcccatcactaacgccgacaattgcaatgattttaagccttctaacatttggtgttgccttcgttgcccggccgctgggttccctgcttttcggtcattttggggataaattaggtcgtaaacgggcattggttgtttcattactgctcatgggtgtttcaaccgtcatcatcggcctattacccggttacaaaacactcggaatttctgccattctattactctgtctagcaagatttatccaaggaatcggccttggcggcgaatggtccggtgccgttttggttgctacagaaaatgccccaaagggaaaacgagcgctttatggtgcctttcctgaattaggtgcaccaatcggctttttcctcagtaatggactcttcttcctacttgaatcattcctgacaccggctcaaatgaacacctttggctggcggatcccgttcctggcctcagctgttcttgttattgtcggtctctgggtacgtcggaaaatgcaggaaaccccactattccgtctggcacaacagcaaaataacgttcaaaaggccccactagttgaggttttccgcaaaaactggcgccaagttatccagggaaccctgacaatgggtgttgcctatacatttttcttcctgctttcaacttggtcattaagttatgccacaacctcgcttggatttaacaataaagaatggctgttgcttctcatggctgctattatcgtttttgcacttatgatcgtttattcatcagtactggccgataaatttggccgtaagaaagtcctcattacaggaacgatttcaattattacctttgcttttgtcttcccgttcttcttccaaggacaacacaacttgcttgggagcctgttcttcctcttcgtcggtttctttacgatggggattgtgtatgggccaatcggcgcgctgcttcccgaacttttcccaaccagtacccgctattccggagccggaattgcttataatatgtccgcaattgtcggtgccgctttcgcaccaaccattgcgtcattcctagttgacgaatggggcattcatgccgttggaatctacttggcagtgatggcaaccatttcactgattgcactgatcaccacaaaagaaacaaaatcggttgattacactaaataaccttgatagtcaacgaggtcgggctttgatgtccgacctttttttgattgcttctatatatgtatattactatgtaggcaatagcgacagatcattttcagaaaccttggacaataaaaaggaacgccccttcatcctctagatgacggcacgctcttttgagatggtatccttctgaaaggtattagaccaatcattgaccaatgttagctggtcgggtattgtgtttcgttaaatatctctgttgtcaagaagcaaactacgcggatctaggctcgatgacctagcgccttatttatatttctgcatttatccctcgtttgccaaacaggtgattagtccattcacctttcaccattattatatgctaattcgtcaggtacttacaaataattcgtcttatattcaaagaaccatttttgcttttcaactttaaagaattggcgatagcagtcgactaaacgtttgcttgaatttaagccatagtggttgtttgtcaaacatctccggtgtctgcaattcactgacagaaatgtcatttaaataaatatcacgcatttgagtggcgaatttctcatcataaataaaagaattaatttcaaagtttagtttaaaactccgataatccaaattagcagaacccaccgaagcgatttcgtcatcaatcaccatcgttttggcatgcataaacccattcccataataataaatcttaacgccttgttctgccaattgtcgggcgtaatattgcgtggcccggtaaacaaacgggtgatccggcatacttggaatcattatgcgcacatcaactcccgacattgccgcaatccgcagagcatctaaaacactatcatcagggattaaatacggtgattgaatccaacaatacttagttgccattgtaattaatttaatataacccatcttgatctgttgcaaatccgaatccggtccgcttgagacaatctgcatattcacattacccttagtcgtggtaaccggaaaatatttagcttgaacctcatcttcatcaatctgtccacgtggactggtcgcattccaatccaaaatgaaccgggcttgaaggccaaacacgcccgatccgatgattcgaatatgggtatcacgccaattgccaaactttttcttacggcccaaatattgatccccaatgttaaagccgcctgtgtatccaatgatgccatcaatcacaacaatctttctatggtcacgaaagttaatacggaagtccaataagactgatcgggtattcaagaacggataagcatggccgccggcttctgtcagcggtttaaaaaaccgtcgggtagttcccatcgaaccccaggaatcataaatcacccgaacttcaacaccctgcttggccttttgaatgagcaaatccctgatttcattaccgattttatcgttgtaaaacgtataaaattcgatatgaatacttttctttgcactttcaatatcttcaatgatacgatgaaacagctcattaccatttgtaaaaatgtggactttgttttgccgagccaagaaagcggaatccgtcgtcataaacatgtcaaccgcgtttcgatttcggcggacaacatcatctgcaggtgtcttatcatcgtgtcccagctggcttctctgttcgtttagccgctcatccagttgcatctgaacgtgcttatgtaatttaaataaccgatttttaggtaactttcgacccaagaaagcatacgcaataaaaccaaccagtggtaggaaaaccaacaccagcagccatgcccatattgccgcaatatcccgtttttctctaaaaaccgttaagacggcaaaaatcgcgttaataacgacaattgcattaaaaatagaagatgcatcaatagtcatattttcctcctgatgcagaaattagtttagtattagaataaaacagaaatagattttaaacaaatctcccactttaattctacttaatcagaaacctcacattagttagtatactagaaagaagctaaatgttatgaatatttttaatttttttccagcagcccttcacggatttcactcggttcgcttcatccactttatttttaacgaacagccgatgattggcattgcgttgattgttgcgttggtactgtatatgatttataagataatgaatcgctaatttatgcaaaataattgatttgatctctgatccaaaagagaccaggcgtcatagtcaggaggaaacacagtaatttaccaactaaatatgatagattacttgatggaattatggaaaaaattacccaacaaaaaattattcaaaccgcagaacatcttataatggaaaccgaaaaacccgaagtgacgctttcacagattgctaccgttttgggaatcacccatgccgctttatacaaacattttaaaaataagcaagatttatgggaggctgttgccaaggattggttcgataaaaatattcttggcaacattagggtaaataaacaagcctacaccaattcaaaagaactcttacacgattggctctggcaatttgctaccgcaaaaaagcaggcatataatcacgatcccaaaatgttcgcattaaatacgcactatattgataatcagccactggcacttcatgatgtcctttgggactcctatagtatcatcgacaactttatggactatcacgatccgaacttggagagggctgaagcaatcctatctgcatttgccgtttttaatttagccacttttagtgaaacatggaatctgccaaattatcaacaacgctttgagcagatctggcagttaatcgagcctggtatataaaaaggggctggaacaaagctagcaaaagctttgtccagtccttttcatattaatgactatttaatgacgacctgccaaagcgccgccgtcaactaccaactctgtgcctgtcgtataggccgcttcatcagaagctaaataagtcactgccttggcaatatcctttggttcaccaatagtgggtatcggatctttggaatgactaagagccgttctgacatcatctgtaacaatgtcggttgcgactaacccaggatgaaccgaattaactcgaatctccttgcccatcttgatagcctccactgcagcagctttggttagcaaccgtgtaccgccttttgaagcagcataactaccggttccaatcatcgatgcaataataccaagtactgaagaaacattcactatcgcaccactttccatcctgttcaacgctgcccgaacccctaggaagttcccggtcaggttgatattaataactttttgccagtctgccaaacttgtctgggcaattaattgtccagagcctccaataccagcattattaaccaaaatatcccagtgaccgaattgattgatcgttgttgtcacaacgttatcccattctgcttcttggctaacatcctgtttaatgtaccggacctgttcttcgctgcccaactctttggcaacttgagtacctaatgtttcacgacgaccagtaataacaaccttggccccttcggctaagaagtcctttgcaattgctttcccaattccggaaatgccgcctgtcacaatagcgactttattttctaaacgtttaaccatttttattgaacctcttaaccttattttttgtttaaattaaattgtttaaccgctaattatctaaaaacgctactgcggattcaacaaaagcttcatgattctgaaaaataccgccatgaccggcggccggataaataatcaactgactatttggaatccggctatttaactcatatgaattcacagtgggtaccatccggtcctcatcaccgtttacaattagtgtaggctgtttaatttgggataaatcagccggcaaagccaatccccatgcagtaattgcttttaattgcgttcgataagctttcaaactgatccctttatcccgattttcttgtcgttcctttagtcgcagaagaaacgcctttgcctttttcttaccattatctgtgcgggtaaagaataaataggttttgacatctttcaaagtcaaaagcgctcgaatcgaatcgcgatcggaaagcttggtcacattttcaatgccttcgccaccacgtggaccggttccagctaaaatcaattttcggactaacgatggttcaattgcaattaattcctgagcaatcatacctcccattgaaaaggaaagcacatcaatttcttttagtcccaacgcgtgaataaaggttaaactatcccgggccatttgttcaattgaattggggacttgtcccctggagaatccaacaccttgattatcaaaggcgattacccaatgattttgagcaacaccatccacaacccgcggatcccaattatccaaagttccagccaggtggacaaagaaaacaactggaacgcccttcttctcacccaattcacggtaagcatatgtttcaccgttacttgcttggattgttaagtttagcgcctttgtgtactgataatttaccatctaacgtcatcctcattctcttatttgacaaagcagccaccatcaaaaacaatcagcttaaagttggataatctgtgtagccaaccgcaccatttaccccatcttctcctgcacgacttcatgtcatcggagccataacaaggcagttttttaatcgaagattgcctcaatcaactggttctcatagtttcgccatgaataaaagtccgccattttaatgttttagccatttgattgaatgatttgcgtcatccggtccagtgaatcacgtccttcaggtgtaggaaaaattgaaaaaacatgattcatggcgtgatatttaaaagtcgtcacttgccaatctttttcatcagccatttgctgaaatttcatagcatcggcattcaaaatatcatggtcgccggtaaagacatatatcggtggtaatttagccgaattcccatagatcggactgacaagagagtccttcggattaaggtcaccagcgtagtattggcctaacaacgttaaattgggcagatcaagcatggggtccagtggctgaatttcagtcattttaggattgctattggtaatatccagccaaggagacaacaagaaggcttggtggggcaacggcaggtgattatcccgtaatcgttgaagaagtgccaaaatcaaccctgcgccagccgaatctcccatgactgttattcttgtaatatcaatttgtttatcgttaagcaaactcaaatagcttttaagaaccatttcataagcatcatttgcttcatatgccggtgctttgggataaatcggcataatgacccttgatcccaattgtttagccaaccgatgaatggcgttaaaatgggccattgtgggttgcccccagtaaccaccaccatgtacataaaagatcacctgatcttcactattttcaatagccggtttcatttccaaaacgtctttttggtctcggaaataatgaacatgatagagactggcaacggacttagggagttgataacccctttgacttttttcaagggctttttgataatcctgatccgtcttgatttccggtacagccggaatatatgacaacagcttttcaagtaatagacttcgaaggctgcgctgttctttaacggcttgatactttccaaggccaagtccggcagataaaccggttaggccgactttggttgcttttttgattttagtgccctccttgtgagacttaaatgttattgttaatcgattattttgaccaaaaaattatgcagcttaaaacataatgacaactttccctttaggacggccgcttgtgaccaacttaagggcatcgttaatatcttcaatatgaaattcagttggatcaactgccggcacaatattattttcttcaataattttagtaaggtcttttaactgactgccactgctgcgaacgaaaataaaatggtattcaacgtccttttcagccgcttttttatcaaatttggccccagccacgccaaatagtttttgcttcatccatgggaagttacggtcaactgcaaatcgtttgttaggacccgttctcaaggatagtaaccggccacccggtttaataattgacagttcatggtcaaattcatctggtcccaatgtatcaatcacgtaatcaacgtcttttaagcgttcccaataattttcagtttgataatcaaaatactgatccgcaccactggctaaagtacgttcttttgcctctgcgttgccgctgacaatcacagttaagcccatgtccttggcaattggaactgccatttgaccaaacgatcccgaaccgcccggaataaaaacagtttgtccgggtttagcttcaagttcttcatgaagcccttgataggccgttaagccagtaaggggtgcagccgcaccggttacgaagtccagattcgttggtaataagccaattgcattagcgtctaccgcaacgtattcggcaaatgcaccaatctttttaagcggtaatcttgtatagatggcattcccgacagaaaatgtctcaacgttttgaccaactttttctataacaccggttaattcattccccatcgtcagtggaaaagcataatcctgaatgagtttgacactaccggtcccaatcagattctccaaagggttaactgccgctactttaactttaaccaaaacttcgtccttactaatttctggagtcggaatatcattaatatcaagttgatagtcttttgcgtatttttttaattgagctgctttcataagatacctccgtgtttaattcagtaacattaatagctatttgtaattaatacatgaagcttaccaagtttagttacaattgtcaataattgtaactaaaaatcatctatgctatatttattccagttaatgataagggaggaatgatacgactttttacgtatcagtaatacaatgaaaaaaatcacgcaacaaaaaattattgaaacagctgtcttattaattgggcaaacccaaaacactgaagtcaccctctcacaaattgcggacaaattaggtattactcacgcagcgttatacaagcatttcaaaaataaacaagatttatgggaagcggttgccaaatgttggtttaataatcagattctcggcaaaattaatctaaagcccgaagattatgctagcctatccgaatttttatatgcctggttatgggcctttgcgaatgccaaaaagaaagcctataacgaagatcaaagaatgtttgacttaaacacccaatacgtcgataatcatccctttgttcttcgaaatgtcctgacagaagcttacaaaacaatcgatcaattcatgaattatcatgatccaaattacgaacgggcagaagccattctctcaaccttttcagtctttaatctacctatgtttagtcaaacttgggacttaccaaattaccaagagcgctttgaaacgatatgggatttaataaaaagtggcatctaagattgcttatgattgattatatttatggcaaaaatatgaaacaaaattagttgcaatacttcagagagcagctgcttatagcgcaaaaaacatcccatcacaacttttatgtgacgagatgttttttgtattaaatgttctaaatcaaacaattatttggtaacctttacgaactgcttattaccagtaacgtagtgtccattcgttaattgatatcgagtagctgttcctttacgaaccaatttcttgaccttaaccaccttgctcttctttaaatgtttaacagcgctcttcttagttaacttggaagatttgtattcccaggttccctttggattaatcacgcgaagtgttttgatcttagcttgattatatagtttagtgacataaccagccttggttgtgatgtagctgccatcactcaattgatatctcaaagcgccgttcgaagatttagtagttgcgacaaccgtaaatactggtgctttggtaattgattttttagcatagtgtttaatccggttagctttgctgaagttcacgttgttatatcgataaagggctttgactgcagcaactttaaatggtttaacttgcttaataacgcttgttgaaggtgcagttgttgtagttgatgaagatgttgaacttacagttgagctgcttgagcttgaaacacttgaagaactggcagctggtacacttgatgatgaagattgaacacttgaactcgaactacttgtaggtgttgttggcgtcactggtgttgttggtgttgttgcaccgctatccgaagaatttattgccttatcaccaacatcaattgtttcaacagttattgcttgctcacctcggacaaccaataacatgccatttgcaagtggcattatttcacgattatacgcttgaccaacttttggtttgtaagtcgtatctgcagcgccaatacctttttgcaaagtttctgcattattgaaaatgtatactttaccatcactaccattattattgaaagcaattcgaccgtcattcaacgtcgtgatatatggtgcgccaccccaggcaatcgtagttcctgcgctggttgagttccaactttctggatcactagagatctttagtccaacacttgcgccacctttttgttcataagtcattgcccatttaccattgccgataggtgtcacaacgggcattccgggccgagtatcatcatttccatctgtgtcctttaagccattggggtcgacatccatcacaagtgggctccaagttgtaccgtccgtagttgtttgatgaacaatcgcctgagcctttggctttaatcctgaactatcccgctcatctgagtagtaacaaacaagcttattgttgtgtaccatcaaataaggttcccagatcggatcgtcgttgataaagtttgctccgccacttgcaattgtactttcatacttccaagttttccctacatcagtacttttggttaattgcaattgagtaccacttaaatcattaggcgttgcatccccagcgataacaatggttcctttgggcatatcgccaatttgctgtgggagctcatataattgcgggcagttggccatcccccaccctacttctttagtttggtgaacatttgatacccaattccaatgcgccccattatcatcactttcataaatcggaaataccggtgtctgacctgcttcaggtacttgttcaaatgtcagcagtaatttcccgttatctgcagaattagcttggtgttccagctggatgactcttggtgaacgggcaccataatcccgattatttaataaatgcccacttgctggcactgttgttttgtacactgtagttggttggaccggtgttggcctgtccgcagcatgtgcgctaactgtgctgcccattaggacaataccaaatgcaaacacaatttttgcaatagaagctaattgtctatgtttaaacataatttcaataatcctttccatataaagcggtttcattgcgattatgtataaagccagggcaatggggtgcactactctggctttatgcatttttacatgtgcagctgaagggtgcttcagtcagaaaactgcacaagttcttgcacattttttagatagcctttttggtttccttgatcatcagaacaaggacggcaccaactaaggcgatgattgaaagaattggtaggattggcatatattgcttgccaaccatgtcgaacaggattgcgcccaagacaggcgctaagatttgagcaccagtattggcaaagttcaagataccaaggtctttagcagcagtttcaggatcaggcaaaacttccaggttcaaggcctgatcaactgagaagaagattcctgaaccggttccggcaataattccgtaccagatcattgctgagggatcacggaagaaaaatggtaggattgttccaacagcggttaacaatgccgcaaaggcaaccggccactttcgagtacccagtttatcggaaactgcccctgaagttgatgaaaaaacaatagcagtaatcatcgtagcggttcccatccaagacacatatttaccggctgcagtacttccaagacccatgccacttgttaggatgaaaacttggtaagttgcaaaggcagtaacggtaatattaatcatcatcttaccgaataaggcaagatagaaattgcgaacatggtgaattgggaagataaaggctttaacgaagccactcaaatccagcttttctttttccattcccaagcttgatttttcgtgcataatgatggccgcaattggaccggaaatgagcatcatgattgctaatgcgtaataaccggtgttaactaagccaggattggcactacttaagaaacgaccaccaataacagggccaccatattggccgataacgtaaccaatggcataaattgatgaaatcgtcccacgatgttgcggtgcaaccatatcagccataacagcgattaatggtgccacaatcatgttgataaaggtttgaatcaagcaccacaatacaataaagattggtaattgtgacttatcattgatcattcccaaaccaaccataacggcagcagttaaaactgagccacagacaatccatggtgttcggcgaccccaacgtgttcgggttcgatctgataaagctccaatgataatggttgtgattgttgatgtaacagctcccaacgttccaagcaaagccaagaagttgttaacttgactaccgggaccgccgaaaatattagctaatttagctgggtttaaaactgaatttaatcccataaatggtgctaaccaaagcaaggccccaagtccggtagcgattccgataaatattggtacttttggttgttgcgcgtctgtcacactggccgaccaagtgccgtcagcgttcaggctttcattctttttagacaatgtcaaaccccttttcttaattctcagctttaaagacttgaaggccccaaggtttcaatgtaaaggtgtctccttgtttctcactaagatcgttcatgattgattgaccattttttgaacaataagtaaccgtttgttcttgatttgaatagttaaagtaaaaatcaaggaccgcgttatctttggtaatcagctgcttattgataattggaaattcctgctcttgacgagacgtccaaaggccaatcttctttagaatatatttatataaatccgtaatagattgctgattcaagtacgatccggcgtaaaaggcattccccttaccatattggttttccgtaatagctgcgtacttgccccaatatgggtgattataggttgccaatgccttaccggttgtggtcgttaataattccatccaatatttaaccggttgttgatcaattccgcttaattcttccgtgccactgatcgtgacatccttttccggcttatcggtaccataattacgattaggctctacaaacaattcatattcggcacccaccgctttagaaatcaaagccggttgaacttcagtccgggcttttacatcctgattggtgtaacctgaacggaatgaatagagaatattgccaccatttttaacaaaaacattcaattgttcaagttgctcgtcggtcgctgaatataacattggaacaactaaaaagtcgtagttgtcatttgagagccgtggatcaccgagttgtaaaatgtcagcttcaacgttcaagcgatacaacgggtcataataggaacgcaaaacatcattgtattgatgttcaccggtcttatcaaaaattgtgttcttatacgggaaccagtcaaccgcgctcaaagcctggttgctgacaacgaatgctactcgatttttcttcttggtatccaagaagtttgaaccgacttctttaagtttcttcccaatcgtcttggcttcgttgtataccggatttggtctaaagtcgtgtccaagtaagcctttccaatatgtttcataactattatgaacagaatgccagtgccaataaccaatcatgttggcaccagaagcaatgtgtgagaatgcttggagtgttaattgaccgggatatggtacccagtgtctgaatgcctgggcttcggtttccataacaatgtaattcttatcttttgttgaacgggcaacatccccacaaaaggcaatttcagtgcctgtcaagttatcctgagttggatgataaacatcaactgctgtaacatcaaacggctttgaaacctcaaagtgatttgagtcggcgttcaagccaaacgattgctttcgccattcgaagtcaaagttgttcgtgacgaattggtcatcacgcttatattcattcacaatatcaacttgccaagttaagaaatcggttacaagagtccgtttgaattcttcaaaggctgtgcctaaactgccgttaattgtcgaattgattggtgggaagtcttcccaagcattaattcgattactccaataatctaatccataagcatgatttaacttatcaagatcgccgttgaattttttcttgagccatttttcaaatgccaggtaaacattttcactactggtatcaaagtgctttgtttcattatcaacttgaaaaccaatgacagcagggttatgaaccgttctttccaccatcttacgaataatccgctctgagaaatttctaaacgtcgggttggtaatatcgatgatttggcgagaaccatactgatgtttacctgtcctatcagttaacaacacttctggataagctttggccatccacgttggaattgcataagttggtgttccgataatgacgttaatgccagctttttgcatagcgttaacaaccttatccaatttagagaaatcaaagattccctcttgaggttcgtacgtactccaagtactttcacctatccgaacaacattaatattggcatctttcatcatcttgatgtcttcatcaagtcgatcatatggcaggtactcatagtagtatgcagcaccgtacaaaaagtttttgaaatccatttaaaaatcctcctaacatctcactaatacagccttgacttggaaagcgctttctttatcacagacaagtatgccttactatcacgccaatgtatattggaatatcggctttatatttatccaaatatgacctataatgaaaataatcacaaataattggtttgcaaacagggtattggaggtaactcatggactttctaaaacatgcaaaaagactaccagtacttgattggaatttaaccttttttggtgctcacgaacaaaaagttggtcccgagtgggttgtaccaatcgagaagcactatgcctttgaatgtatttttgttcttgaaggccacgaatacgtcaagattcaagataagacatatacgctctccgccggtgactttttcttaattccacctgaattccctcaccaggtatgggctggacaaatattgaaatacttctgtttccatttcgatctggatgatcccaatttaaaggttcaactcattcaaggaatcagttattatcatccttgcaattcggaattatgtaaaaaaattacgccacatttaactaaactggactcattaattaaagacggttcttttgatttcaacaccaaaatgattattcaaatcgagctttcaaaaatgttgcagtccttctatcaatctgcaatgaaacacactcatgacgcctcatcaacccacgtcgagtattcaagaattatggccgattatatgaaaagccgattaacaaatcaggtcctcagttatattaagaacggctatgcaccggttgaaaaaccggttgaagttgatgacgcaattagaaaagtcggtctaagcaatggctatggctttagaatcttcaagcaaacttatggtatctcaccaagagaatacctctccaagcttaaagttaacgaagctaaaaagttgcttatgaaacccagctattcggtcgcagatatcggattggcacttggatatagcggattagccaattttagtcgccagttcaaaagatggaccggcctttcacccaatcagtttcgagttaatgcctcccaaaaacaataattggtatacgtattagacatcatataaggataaaaaatagttcgattttgcattaatcactactaacgcttgcagactttaagcacctctcgaaaagagatgcttaaagtctgtattttcatttgagcatatttattattttctttgattaagctcttgtgaaatatcgtcaataaaatgtaaccgttttaccacaaggccctctatatcaacatcagtacgccatataaatattcgaaatttgtgaaaaatcacttgcataatatgtcgaagcgacctatgatagataagtcgcttcgacatattaggaggaaaattttgtacgaattattaattttaggtgtcctgacgtcacgggatatgtccggttataaattacggatcatactggaaagcagtttggtccccaggcgggagatctcaaacggcgtgatgtatcctctactgcgaaaattagccaataaaggatttattgaattcattgaggatgatcataatctcagaaataaaaaaatggctcatatcacttccgcgggaattgaacgttttcgccagctaatgaacgacaccgtctcacgtgatgccaagcgggaatcaatttttcgctttaagtttcgcgccatggccggcgtcgattcaacgacgcaggaacaaattttagatgacttcgaggccgctgaacacagtgatcttaaggtctatcaggaagtccatcatcatttacacgccaaactcgacgatccaaccgccaatcatccctatatcatttgggcgattcgttctttggaccttagtctatcgatttgccgagcaaagattaaatggattaaaaattgtcgtcagaaaatcaatgaagataggaagcgtttaaatggacaaacaaagtaaatcaaagcaatggatcgcactacttgcgatgggtctcggtgtcttcatggggctgttggacgtaacggttgtcaacgtagcgctcccaacaatggcacgtggcttcaacacaacttttacaaatctccaatgggtgttaaacgcctataccctggtttatgccgttactttaatgatcatgtcaaaattaggcgatatgtatggtcgaaaaaaggttttcttaggatcactgatcctgttcgtgattgcttcggcaattaacggaatggcacccagcctgtttatcctggacataggtcgaggtattcaagcaatcggtggtgccggaatgatgtcactttcaatggcactggttgcgtccaacttcgaaggtaagcaacgtggcttggcccttgggatccttggttcaatcattggtgtttcatcagcgtccggtcctttaatcggtggctatctggttgaacacttcggttggccggccatcttttacgtcaacgttccctttggaatcattgcggtcattctgaccatcttctacgttgctgaaacaccgagttacgggaaaaatcataaaatcgatttagtcggaatgatcctttccgcaatcggattatttgcaattatttatgggttgattgtcaaagaaagtcatccccactggtcatggcttgattttcgggtaagcggcctcctcatcggcggtgtaattgtcatggtcatttttgttttggtcgagttacgggttgaagatcccatgatggatatcaaaatgtttaagcggcctcatttcctcggtacaattgccgtggcttttgctttaggtgccggaatttacgcttacaacgcatttttaactgctttaatgcaaaattatatcggttattcagccgttcaaaccggagtcagacaactgacaatcagtgcctggtcacttattctgggtccggttgccgggattctcagtgcgcgatattcgaagaaatggatgattgtggtcagtttactgataggtggtctcggcttcttctcgatggcaaaggcaatcagccccaccgttagtttcgttgaactctggccgggaatggtcctgatgggactggcaaatgggatggtcaatccattgctaaatacagccggaatggaaggcgctttgccaaatgaaatgggaatggtttccggattattgaatgtctttcgtcaatttggaacaactgttggtgttgttggtctgggactcattcaagatgcccaatttgaaaattatttaaacgccaaccttcaccacatttcaatgccgacccaggcactcaatggtattaaagaagctttaattaatgccggtccattctccggccacagcattgccttttcatcccgaatcgagaaagcaccatttgcccatgcattacaacaggttgtcattaaagcctatgataatggtatggccgccgtagccattacgtcaggggttattgttgtccttggtgctatcggcgccgcattcctcatgagaaatcggatggcaactcaggatatcgaattgaaacagcctaaataggaaatcattctttatggaatttgggttttaaacccattctaatttttactgatttaaaaggtccatcgatcgtcgcgtcgacccagcaacagacaatcgctttgtccactgcttggcagggcaacttgcttgctcttggttgtgtttccgcttacaataaccacgttatcaacagttatgaggaggcggagatttatgaaagcatttgggtatgatcatcatggtgctccggacgtatttcaaacttatgacatcccgacaccatctcctgcagcagatcaattgttaattcggacaatcgcaatcggccttaacaaccgtgaaagagcagaacgggctggtggttatggtagtattggttcaccggttattccgggacgtgatgtcgtcggcgaagttaccatcgttggtgggcgcgtttctggcttctcaaaaggagatttagtcctaacccacaccgaacacggctatgcagagtttgtccttgcagacctggacgccactgttaaagtaccggatggcattacaccaaccagagccgccggtatgattacccctggtttaacaggttataaagccgttaagttttttggaaacgttaaggccggtcaaaccgtcattgtaaaaggcgcttccggcggtgttggctcgatttccgttcagattgcagctgatctcggtgcaaatgtgatcggaattgcatccagtcacaatgaagattttgtaaagtcaattggagccagtcaatttgttgcctatgatcaaagcgatccagcaacggtattagctgatcagggagacgttgtcattaacagtgccatgaatggtgccggaacggatgacgatatcgcaatggttaaaccaaacggcactattgccagcgttgcgcatgaatcaccaacgacagataagcccttaaaatttgtccacattcatccaacaaatgacatgacggatcgggaagctttacaagccatcgttgatttgatgagggatggtaaattaaccgtcaacattggctatacgttgccattttcacgtgacggattcgtcaagggccatcaactattggaagaaaaacatgacggtcgcgtcatcattgtgaatgaataatagttttttatttaaaaggcacctcatagtggttattattaatgaaaaataaccgctatgaggtgccttttgtctgttttattaagttgctactgattgtttaaaggttgccatcaaatggtgaaaaattggtttttgataattaccgcttttgtgatgcggataacaaaaaaagctcaattgactgctaggcttaattcgtcatgataaaataatagtgtggctatccccctagccacatttccccgcgtgcagtttgcatgcaatagttgctccccgcgtttttttatcgtggggagtttttaactctacaaaggctaaaacgtcatgagccctttattttaatgaatctcagtgcactaatcactgtttttccgtcaaaacagcctcaatgctcccagaagatgttgaaaagccattgatgtttttactttaaatacctctaattcaaaattcacaaactataatctattagccgatttcgctacaatagaatttggcactaggtagcactaggtataaaaatacgttgttttcagaaaggaaagttcacatgaacaaactcaaattagtactaattctactgacaacaattgtcagttttgcaattgtcacagctggcaacgccgaggccaaccaacttccagctaattattcattcaactatcataaagctcaagttggtgcggtgccttataaagccaagtcagcctcacaatcagcctacttatggaactatcgtcacactaaacggcttcacaatatcaaaaattatgctaattcaaattggtatgttttttacgcaaaagccaaaaaatataataacaagcgagcggtttactattatgttggtgccagtgccaatttcaaaattaaaggttggatttggagtggctacctcacccgtttactagctaagtcgcctgcaaattttaacacggaatcgacatttatcaactatgttaaaactgatcgatcgcaaagattagctagagcaattctaaagctattccctaatactcagcttaaactggatttgtccaaagccgcagccacaagtggaaattggaaacccactttagatccaaattataccaactatatcaacgtgaatgatttgaagcctgccggatcaacccaagtaagcgatgatataatgtggtatttaagcaaaactgccggaaagcctatcacccaaagagttaaccatgttaagcgtattttaaatgagaatgggtatccagacgaaaagcggaagagtatggaccattactatatcgggattgcttcttttgacggcgctcaagatggtcctgaatcgtacttcaccacaccttatccatccgttttgttagatgacagtcaaaataatagtaccttgatatacttggccactgctaaataactatttgtatattaaaaaataatttgctagtttcgaaagcagtttattttcaccaattgtcaggttacgaaaaccacctcattaaataggcaaatacacctacaatttaccagtcttgaactttaatgaccctcattttacaatatcgggctgtggggttgctgtataaagaaatgaatgatgttgaattcgatacatccccaccaaaaaattgccgcttgcagaagaatactgatccttcttcgaaatactataaattgtggtatttaaataacggctgtaatctttatcatgatacgggttacaggttatggccataacaggatgaccatcgtgtatcatacgcaagcaaacagcgtttctgggtgatgtagacaacgaaacgatacaaataattaaaaggatgatcactgacaaaaatacttttcccaacttcataatacttttgtctttcgttttcaatgtctttagatctccgctttaattattatccgactttaatgccatatgctactctcgcgttcaccagggcctatgtatattgctttcccccatagattctttcacatatcattacaaatgcggacctgatcagtcaacacacttacatcagccttttgaaataggatacattcttcattttcaattttacgatgctactttttagatgatttttttgctgtccatccttgccatataatgacgactaatgcgaataaatagaatattcctccaaggatatcagaaaaatcaaatgccagcctatcattataaacaatcgcaaatccaccgataaatattggtattaaccatgcccacttactcattagaaaatcatgcattctcatatatatcaccctttccagcgttgcacgcctgagtatatggtttgagtattacccattttctcatcttttttaacttttaggattaagatttaccggaaagcaacaagtgtggccaagataattagtcatacgccaactaccatatgaattttagaagtatcgcatggaaaaagggagcgctgcgccagcaagaataaagtatcaaacgatgacaaccacgataactataagtatgataacaacaatttttgtgagtcgcgtcatctacaacaccccatatcataaattttttgttggaataaaaaacgtgataatcccaactaaaatttcgatcataaaaaaggggaacataaaatagtaatcttcaacaatttgatagataactggcaccaagttacaaataatcaaaattgaagacaaaatcctaactactattttgtttactggaaataaatatatgcttccgacaataacggtcacccccgaagccccgattatatagtaaataatcgatgtcagcggaggcaatggataagggccaagcccaaaaatcccaagaaatccattaacacaaccgagaaaaattaatataaagcatattagaaatctatacggattcttcataattaccaaacttcctataaaataagccagacttttttaatgttcacagtgatagcgctaatattttcaatataagcaacacggcataaatcaacaccagcattttccattttgataaaataacttctttaagcgctaaccaccagttaatataaaatgattgtgtatgattgtactgcagtcggtacttataagtatcctttagtctgccaaccagtaagagaagtgccacttgaagcacagccagcataacgcagtacaatgcataaatggtaaaaggaaaccaatcattcatttggataggaaccttcattatcgtagccgccaacggcatgactccgaccgttaattgtccggagccgatcactgagagaaagagtccggaaaacagataggtcggcaatagacttaaaatcaaagttgggataatgagtttaatattccaggcaaaccaggaaagcaatccacagagtaaataggtaacactaatcttttgttcacctggtaacacttgaacactcggctgatctagaaaaatcatagtgatttgaatgacggaaagtgtaacccataaaattataaatggatttcttcttgctttggcaaacaactgtgaaaacatcccaatcccccttgtatcaaaaaaggcttgataacgccaacttgttaaaaaacaatcaaatccagcttcatcatgaagctttaatagtcaaaatattcagacgataaatcatctcgtctatataatgtgttcagcaaaattaaagacaacatacttttgaactttaaaattatagacttcgtatgaaccgtcaaatgatgggtaaccatatcgactctgaatagaataagccggttttctaaaatatttttcagacttagaaaaatacttgggatgacatttcagtgcagtaatcggatgcccatctatagcaatccgtaaccgaacagagtctttgggaaacaaagacaggatcatgatacaaataataaggataaagaacacgccagctagaaactttaccaatttaataatccatgatttcaaatgcctccatccctttttttgattttaaaatgccagatttttcatcctaaaagctttctcaacaatacattaacaatcacgcaaagaacgacgaggtcaaaaataatggcgatccagtaacgtcctttcactactcgtaccagatcaacccccatatatactagtgcaatgcaaaagaagggtatatagaatttaggaaccaataaatacaatacaaaaaggataactgcaattaagcctcaataggcttcgaacccgtttcgtattttcttgataattcaaatcacccgcttaaatcaatagttgaatggcatctaacctcagataacttattttttatttgcgatgattaagcagcatcatttcgtccatttccacgttggattccaccccacccctttacttaggtaatggaaatgattaatttttgcaaggtaataagaattatcgtcataatactgaatcacaaattgcttttttctttgcggaacataataactgtagcccgaatcaaacgtgtcgcggaaactgttgttgactattctagtcgtatgagcttttactactaccgccttctttggacgctgaacaacgtcatcataaaatcgatatcccgttatatttgcaaaccaaagttttgaaaaataaaaacgcacattatagtcactattattttgaattttagtatcataaacagctacactgccaaaatattcatgatatttttttgaaacacgggtaagctttttattaaatcgaaaataaaaattaatatgatcatccctattggatcttgcaaacacaccataattaacggtagttgccgcaaaagttgttggaatttcatatgacactcccaacattaatccaaaaatcaataatcccctttgaatccccttcatcaatatccccccaaaaaatgtgatcagagatatgacgtccctgtgaaacatccttaattatgttgtaatccaatcggcccaattcgtcaacacagttttgtaatgataatacacattaacgattaatatcatattatgatttatatctgttttatatcactcatagtgagtttatgacactaggaacctatgtatacaaaatggggagttgtgctattttttccttaccaagaattactttttaaacaattacgttcatggttgaccacaaatgtaacactcagctttattcaacgacaatgaagagaaaacaacataaataactgcgcatccggtatcaattcatataagaaactccctaacctgttgtttatcagcgcactaaaaaacatctgcgtaacagttagtcctatttaccaagaaatagctgttatccagatactttaactaactgaaacttgaaagtatgaagacagactgatcccttggtatcacagggcatattttaattaatttaaccatttagcttgctgttaacagcgaaactaaccgtttcggcaaaaatgtgaagaacttgattcatcattgaataattgggctcttcttgcataaacttcatgattataatcgtttttaacgaattagaagccatacagtgcttgagacaactcaatatctggcatggcttcgttcatttaaagaataaatccccaatggtgcgatcatcctgatttgccgttcctgccaaagaataggtcatagtcatcagacaattgctaatggccacaagcccgtcataattttgaacttgtgatttgtcgagccgcaagtattgcttggcaacttaagtaattctcaatttgccatcttcggggtaggtatagtgaatgatctcttgtggctgaaggcctaactgagtcgttgcagtactaggagtcatctgacggggccgattagccacaaatacaagcgaagcttgatttggttcccgacgtgcgcttcgacaaagcagctgtattgataagcttgcttgggtgatatttgagcctgcagtcgcttgtataatgctttaaactgaatattgccgtccgcgactattgatagtaaattttgggaccgtttaagcatgccaaacgcgtttaatccccacttggttaattcatagaacatttttggtgagctgtaccagctaatcaaaaacacatagtcagctagaacgccatttgccgagggcttgcttgacaagttgcaatgaaacgaggttcattttttgctgtgcttggcgacgtctccggccagcaattgtcgtgatcggttgttttagctgattttccaaggacgttttgtggctttcttggaagacattaatgcaaagttgtcggtaagaatgtatggcgtcactccaaccccaattaaagcccggtaccccttaatattaagtttgtcatggtcaaagactcgcggagtaattggttgggtggcgtcgtactccggggaaaagagtgtatcgtcaatgatcaattctaaccgccgccggcggtcaataaacggtcgtaaatgcttgattaaatgatcccaactgacaatcaagcgtgccacttgatccgccatcgttcaaatatttctgacggtggactggtaaagttaggtgtttcatgggctcgaagcgagcgtccaggagactttgtcgtgagcagccattcaatggaccttcatcaagctgatttctgaagccggcgataattcaccaacttggtgagtttagatagaccatgaggggaagaattgatgaacaatattgtgaagctcgtttctgtattttttgtttataatattcctgacgtaagtctcctttgtatcttggttttggtcgactaaagtatacaacgcaggagagcttgcgtttatttttttgccaaaaaagccaataaccacacgcctttggcgtgattattagctttcaagtttcagttaactaattaaagctaactactaccgccataccgaggataaaatgaggcgatactttcaaaacgtctgaaagtatcgccctgtcctcgttcaccagcagaataattttctcaactgttctttagtcaaaaattttactcacttcgacgttaatttaacaactatctatacaattccggtcgtcgatcagcaaacaccggcataaacccacgagcatcatctgtctcgtttgtctctatcgtaaccgtcttcagctgagattgatcgtttaatgtcagcagttcatctcccaatggattataaatcccggaatgaccaccgaaatcattatcgggatcactgccaacccgattgacggctaccacaaagctctgattttcaattgcccgggcggctaacaagcgtcgccattgaggcattctaacggtcggccattcggctggtacaaaaatgattcgactatcatccaaactcagtgttcgtagccattccggaaaacgaatgtcataacaaatcacgcttgttgcattaatacccttaatttgaaaatgatcttcttcatgtccggcagacaaatatttgtcttcacgcatcaagccaaatagatgaaccttttggtaactggttaactgttttccatccggaccaaatatatatgttgtattataataagcgccgttatgtgctgtagccacagagccgccgtgaacaatcaattgatatttttttgcaagttttgccagtaacgttttggctcgctgcccatcgggatccgcgatttgtgcaaatctcgtcaggtcatatccggtattccacatttccggaaataccacaatatcagcatgttcttcagcagcctgcttaactgccggctcaatttgagcaaagttcttatccggttccccaaagtaaatatcaagttgtgcgagtgaaattgtcagtttcatgaagtgcctcctgccttatgtcaaaaacatgccacatcattcatttggttcaatcaataggttaactgacccaatcatgatcattatttaattcattatatgccaaaaatccgtttataacataagatctttccgtcactacaggccctgcctgtgatataatcatttttgtcacaaagcaaaaacaggtaacgagctactaaaaacgggggactattatgagcatcagtatattattagcactcattccaccaatcacatggggtgcaaccggtatcattggaactaaaatgggtggatctgccgcacaacaaacttttggtgaatcatgcggcgcattaattttggcacttggcgtctacttattctttgttatgccaaacggtatcactgtcgacagcagaatctggttagtcgggctttgctcaggcttattctggtccgttggtaccgtcggtcaattttttgcctataaaaaaatgggtgtgtcagctgcattcccactgtctacggccggtcaaatcgtgtgtaacgccttaatggcagctgccgttctgggagaatggacgactttaaacatgtggttcttcggcattatctcaatcgctctggttacggttggtgccctcttaacagccgcacgttcaaaagcggaaaagaaaacagcgaagaaacgcccaagcacttacatgcagggactattcgcactgcttttatcaaccatcggcttcatgctttacttcgtctttccaaacctgctcgtaaaagtcggcttcatcagcgaaagaatccataacgcaaataatggtatcaattacatgaccgctattgtcaccccacaggcagttggtcaggttattggatcagcattgattggctattttattctgcatgaaaagcaattattgggaaaaccaactttcaaaaatcttgtaaccggaatcaattggggaatcggaaacttatttatgtttatttcagccgccaaccccgctattggccaagcaaccgccacaacactttcgcaattgggaatcgtggtcggcacatttgggggtatttacattcttcatgaacgtaaaacccctgatcaaatggtcaaaattgtccttgggtcagtattagtcattattggtagtattttaattacgaatttaaagttactgagtttgtaatctaaacatattgtttaattctgttgattagttaaaaatcacggattttgaacaatatttttttatttttttgttttttgaaagcgcaatcatagactaatcattgatctgccgccctttgtgattcacaagggggctcaatattttcatcacttatgaccgtccttttttaattataaagcgttatctgtcaaggaataaagccaatagcgtcaatttgtttatgacatgtctgattagctggttttcacgaactttcatagattctggcattgacaggttttgggtgagatgcaataatgtgcgtaagcgtttactcaaacaacttattgcctattctgatttatcccttgtgttgtaaaaatgaatctgagcttttatcaggctaatactcacttgttaacaattaatccgaaatatacacaatcccaccgcttaataaaatcagctttttgagtaaacgcttactcaaaaaatcaaatgagcttataaagcccatcaaaatataatcaaatttaattggagatgatcatttgctgttaggcagcattgaggctggcggtactaaatttgtttgcgctgttggcaatgaagattttcgtaccattgacaaaacggtttttccaaccactactcccgaagaaacacttcaaaaaacagtggcttattttaaaaagttcaattcattaaacgcccttgctatttcttcttttggaccaatcgaaataagaaggaattcacccaaatacggttttattacaaacaccccaaagaagggatgggcaaataccgattttcttggaacgttaaaaaaacaatttgatattccgatgttttggacgactgatgtgaacggttctgcttatggagaatacgtcatcgcttctcttttcaatgaaatgctggattcactcgtctattacacgattggaactggtgttggagcgggtgtcattattgatggaaagtttgtcggtacccggggacataccgagatgggccatgtttatctaagacgccatccagatgatctgagttttaagggtatttgtccttatcatggtgactgtttggaaggattggtttctggtccaacatttgaagcccgcaccggcaaaaagggacaggacgttccgttaacagatcatgtctgggatattatggcttattacgttgctcaagcggcaattcaaactactctcgaactacgccccaatcgaattatttttggtggtggggttgttagtgaaccatttttgcaaaaagtaagagaacaatttgcaaagttactaaatggatacgttgaggttggcccattaaatgattacattaagatgccaatggctaaacataatggttcagcaaccattggtgacttcgcgttagcgcttcgagaatataacaaataaacttattaattcattcaaggtggtgatacacggtacttaaatacacaacctaacttacgtcatgtttttatactattttaattatctactaggaggattttaatcatggacattaaagaacgagtttcacttccaaatattactaaggataactatcccgacacgacccgtagtgctgttctcaacaaagtatttgatattgaattaaaggacaccccacttccaccaatgaagccaacggatgtattaattaaagttatggccgttggtatctgtggctcggatgttcactactacgataccggtcatattggtgactttgtggtcaagaaaccattgattttaggtcatgaaagttccggtattattgttgccactggagatgaagtaactgatctcaaacggggagatagagtcgcaattgagcccggtgttccttgcggtcactgcagttattgtcgcgaaggcaaatacaacctctgccctaagatgcagtttatggctaccccgccagtcaatggtgatctttcagaattgatcacttacccacaagattttgtctttccaattcccgatgacatgccctatgaaattgctgctttaaatgagccattttccgtcggcattcacgtatgtcaaaagttggatgtcaagcctggaacgactgcttttatttcaggagccggtgcagttggtcttttagctatcctggctttccgccaatttggcgttgataaaattattatcagtgatagtgaagaccttagacttaaaaccgctaagaaacttggtgctgatgacgttatcgacattcgtcaggaagactcactcaagcgtattaatcagctaactaatgacgagggtgtcgactatgttatggatgcttctgggaatccatctgctgagcgtgaggatctccgaactctaaaacgcggtggtaaactcgcatacgttggcgttccaactacggatcaagtcccattggatgttccgtttatgactgatcatgaaacccagatttttggtattttccgctatgccaacacctatgcattaggcgttaaaattttagcaaaacacatggatgagcttgagaacctcttaactaactattacagtttggatcaaactaaagaagctcttgaaaaaacacgtacagataaggccggttcattaaaagttgttatttatccaaatgagcaactacgtcaaaattaaaaatgggtgacaagacaaatgatcaaggatgatatcacaggaattcaacacgttggaattccttcaaaagatttagataaaacaattgctttttatgaatcacttggtttcgaccaggccggtttgttccacaacggtgaaaatcgttgtgcgttcatgaggtttggcaacctgaccatcgaaacatgggaaggtgatccggtggcaatgaaggccggcgctattaaccatatttcattgaatacaccggatgttgaaaaagcctttgccgatgccaaagcacaaggtttgaacttggttgaccatgaaattcaatcaattccttccttctgggaaaaaggcattcgttatttcaatattcttggaccaaatcaagaaaccatcgaattttgtcaaatattatagttaatcttaataaagatgccattttgaataacataaacatggcatctttatttatccaaatttacttaaaggagttgtaatgatgcatatttcatttgacagttcaaaattatcaaaattcgtccatgacaacgaattgggcgaaatgcaggctatggtcaccgctgctgatgccgaggttcgtcaaggcaccggtgccggcagtgattttcgggattggttaaccctgcccaaagactatgacaaagccgaatttgcccgtatcaaacaggcagctaaaaagattcagggcgactccaaggttttagttgtcatcggaattggcggttcctatctgggagccaagatggccgttgattttctcaacgataccttcttcaactacctgcccgacgaccagcgtgaattccctcaggtcttctttgccggtaattcactcagcccgtcgtacgtctatgacctgcttcatctcattggcgaccgggacttctccgttaacgttatttccaagtccggtaccaccacggaaccttccattgcctttcgaatcttcaaggacaagctgattcaaaagtatggtgccgaaggggccaaggaacgaatttatgcgacaacggataaagctcatggcgctttgcgccaagaagccgatgccaacggttatgagaccttcatcatccctgatggtgtcggtggccgttactccgtactaacaccggtcggtctcctgccaatcgccgtttccggtgccagcatcgatgacctgatgaagggcgccgctgacgctgccgacgcttataccgatccggatttgaccaaaaacgaagcctatcagtacgctgcctaccggaatattttataccgcaagggcttcacaaccgaattgctggaaaactatgaacccaacatgcagtacctggctgaatggtggaagcaattaatgggtgaatccgaaggtaaggatcaaaaagggatctacccttcatccgccaacttcacgactgatctgcattccttaggccaatacatccaggaaggtctgcgaaacttaatggagaccgttgttaaggttgatcatcccaaccacgatgaggatattcccaaggaagcggataacctggacggcttgaagtatttggaaggccgaaccatggactttgccaataccaaagcttttgaaggcgtggtcctggcccataccgatggtaacgttccgaatatgagtgttcatattccggaccaaaccccttacaccctgggatacttgatctacttcttcgaaattgccgtttcaatttccggctacttgaatggcatcaacccattcaatcagcccggcgttgaagcttacaagaccaacatgtttgctttgttgggcaagcccggttacgaaaaattaggtaaggaattaaatgatcgtctctaattaaggggtactgatatgagtattttaatggctttaattcctcccttaacatggggagcggtcggcatcatttgtaccatcatgggtggatccgccgcccaacagacccttggagaatccatgggtgctttaattttggggttgttagtctacttcttctttgttatgccacagagtatccaggtcacttcccacatatggcaagtaggctttttctcgggcattttttggtccattggcacagccgggcaattcattgctttcaaaaagatgggggtctcggcagccttacccatttcaactgccggccaaattatttcaaatgcgctgatggctgctgccgtacttggcgaatggattactgttagcatgtggctttttggttcgatttcgatcgcactaattacaatcggagcgctactaacatcagcaagatcccatttggaaaaacaacgaaaggaaaagagatctccaacctacatgcagggaatagttgccttaatcatttcaacaatcgggtttatgttatatttcgtattcccaaatttattggtaaaaacgggatatgtcagcgagtctgttcataatgccaatcatggtataaattatatgactgccattgtgacaccccaagcatgtggtcaggtaatcggatctattctaatcggtatttttatttttcacgaaggtagacaattgtttgccaagccagcttggcgaaaccttgttacaggactcgattggggaattggcaacttattcatgtttatttctgcggcaagtccattgatcggtcaggcaatggctacaaccctatcgcaaaccggtgttgttatcgggacgttcggcggtatttatcttttacatgaacataaaacatcagatcagatgatacggattatcattggatcaattttggtcattgccggaagtatcttaatatccaacttaaaaattttaacgatttaaaccataaagaaaccgagccaagattaaatccggctcggtttcttgttccgcaactcatttgtttacttattttgttgtttccctgacatcaatcgtaaatggaatttgaattttttgaatatcatcaatctgacgtgccgggttaataacttcatctacagccatttgtcccattaaatgaaaattttgagtaacactggttatttgaggacgggtccttaaacatactgctgttccatcaatgccaatgactgcaatattgtcaggtactttcctttgaagatcgtacaggccattggataaccccagtgcagcatcatcgcttgttgccaaaacagcatccacacctttcatattttcatagtactttgcggcatcgagtcccgattgataactatacttgccgtccccttcaaatacccaaccgggatcagtctttatacgtttctctttcaaagcttccaaatatcctttgtaccggttaacacctatataatcttccgatatatttgcaccaacaaaaccgattctttggtatccctgatccaataaaaatttggttgcctgatacccaatttgaaaatcattagatgaaatatacgagatgcggttatcactcgcacttgcaacttcctgtggatagatattcgcgtatcggagccgatcaataatttcttggtcgggtcgaacagacagaaaaataacgccaagcactcgtctttcaatcatgctctgcactgttttggcaatggcggtttgatcgtcccgtttagacatcatcataatgacgtcaatattattacgatccgcttcttctaaaattcccttaatgacttgatcatttgcacctgtttcagcaatatagttaataaccccaattgtattattacgttggctcgccaaatcagaagcagaacggtttttataataaccaatctcgttggcaatctttttaacacgtttggcagtctcttcactatatcgaccacgaccattcaaaattcgcgaaacagaagcagaagacaaacctgctatttttgcaatgtcggctatttttgctctcaattgatttcatactccatttatcatttaatacaatccattatacaataccatgcaaaactaccggctcctttaaaataaaaagccgaacctaaaacggatcagcttttgtataaaaatattttaaataatgatcgtccatttttctcttcacaccatggccgtcaacgctgccaatacgccaaaaacaacgcctggaaagctggcgatgatcaaccgccagtctttcttaggcttcaaccagccatagctaacccataacgtagcgtttaatgcggcaaataacggctggatgggtgaaattggattaccgtttaaattactgataatctcaccgatatatgaaacatacataataaagttggcaatcgtcgcaaaatccccgattaacttaatttcatcaatgcgcttcttatgtagtgcgtcctgaacctgatttctaaactgtccctgtgtgggccttaattgactttgcatgccgatcgcttccaaatcttccccgatttattctttctttcaccactagtattaccacttccctaccctaaaagctagatatttttactttgataattacttttctaagaatcggcaaaaattaatcatctgataactattatttcaaaaaaaatttgcgtttcaaatccaattgctcattcagatgttaaagtcactaaatcccttgatacgtatagaatcaattcaagtcaattttaaaaagtcatggtgtttttctctacttttaacacacatttaagatcataaccaaaaaaagatcattaaaatcattgacatttttatgaaaagcctctaatatacaaagcaacaattaataattcgtccatgagaaaaaccaatgaagtggagatcaaggtcattgtgcacgtaaagagagttgccggtgctgagagtgcaatcgaacgcagatgattaaatggaccactgagggttctcccgaaagagttcgagtacggagaaacgtgaaggcatacgtcagttgtcggagggatgttggtccctcgctaagagtgattaattgggaatttcatacaaatcaagcgatattatttgtagaagacccggttaattgaactaaggtggcaccgcggaataatccgtccttaacttatcaaagttatggacggattttttgtataaacggaggtcttggacatgagtcaaacaaacgagattaaacgatggcaattttcataataactttcagtcacttaaaacaaacaactatctaaggtcaaaacacaatttggaggaatttatgatgattaaacaagccattgaaaaagtcgttaaccacgaaaacctaacatttgaagaaagccaagccgtattagacgaaatcatgaacggtgaagcatccgaagttcaaacagccagcttattgaccgctttaactgccaaaaacccaacgattgatgaaattgccggcgctgctgcttccatgagaagccacgcacttgcctttcccgaaacaaaggacgttctggaaattgtcggaactggtggtgatcattccaacaccttcaacatttcaacgaccagcgccattgtcgttgcagcaacgggcaccaaagttgccaaacatggcaatcgcgcagcttcatccaagagtggtgctgctgatgtccttgaagctttgggactggacatcaacgaaacaccagctgtcagttacgaaagcctacaggaaaataacttagccttcctgtttgcacaagaatatcacaaatcaatgaagtacgttgccccggttagaaagcagcttggcttccgaactatcttcaacatcctcggaccattggcaaatccggctcatccaacccgtcaactgcttggtgtttatgacgagtccctactcgaaccattggccaacgtattgaaaaagctcggtgtcaaaaacgccatggtgattcacggccgcgacgggctcgatgaaatgacaaccgccgatgaaaccgcagtggttgaattacgagacgggcacttgactaaatacacgttaaccccggaacaattcggtttgaaacgcagtcaacgtgccgatcttgtcggtggtactcctgaagataacggccaaatcacccgtaacattttggccggcaaaaaagggccacagcgagacatcgttttactgaatgccggttcggcccttcacttggctcatccggaactatccattcaagaaggcattgatctggctgcaaaaaccattgatgacggtaaggcccttgaagaactcaatcgactactggctttctccaataagcgtaaggacgtggtggcatgatcctggacgatctggtagctgttaccaaaacccgattggcccgccatcaacgacagcagtcattcaccgatttaaaacaagttgttgccgagatgccggccaatcccaaaccggatttccttactatattagaacaacccggtttacacgttatctctgaggtcaaaaaagcttctccatcaaaggggacgatcgtttcggattttccctacttggaaatcgccaaatcatacgatcaggccggagccgatgcaatttcagtcttaaccgagccggattacttcaacggtcatcttcattatttaaaagaaatcagtcaaaccgtttcggcgcttacccttcgtaaggacttcacgattgatccttacatgatctatgaagcaaaggcaaacggtgcttccattatccttttgatcgtcgccatccttgatgatcaacagttacgcgactatcgacgattggccgaaagccttggtatgcaggcaatcgttgaagcctataccgctgacgaagtgacccgggcattaagatccgatgcaaagattatcggcattaacaaccgaaatctcaaggactttaaagttgattttaacaatagtttaaaactaagggacatggtgcccgagaacattcccgttgtcgcagagagcggcatcaagacccaagaggatgttaaagaactggcaggagccggcttcaacgccattctcatgggtgaaacgttaatgagatccaacaaaaagaaacaattaattgaggcatttaaggaggcttaaaatatggtacaggttaaaatctgtgggctcatgaagcccgacgacattttggcagtaaacgcagccgaagctgattttgccggctttgtcttcgctcccagccgtcatcaagtatcacttgcaagggcattaactttaaaaaagttgttaaatcccaagatcaagaccgttggcgttttcgttaatgagtccatggatgaaatccttgccatttataaagccggcgtcattgatatcgctcaactccatggaaaaagcacgccgggtgacattacccgactgcaacgtgccggcctaaaggtcattcaggtttttgaacgccaatcaatcgacttagcttcaacagctgattacctgatggttgacagcggaaagggcagtggtcaactacttgatttaaaagccatcccgcatatcaatcgaccactcattctagccggcggtttaaccccacaaaatgtcagacaagctgttcaacttgttcagcccgatattgtcgacgtatccagcggtgttgaatccgatggtcataaagatgccgataaaatcattcaattcattaaaaacgcgaaagaggaagtcttactatgaaaacattaaatgaagaaaaacaacaaaagaaacgtgtcggtcgctatggaaaagactacggcggtcaatatattccggaaacattaatgaccgaacttgaaaaagtaactaaagtttttaatgatttaaaagatgatccggcatttaaagccgaattaaatgatttattggtaaattacgccaaccgtccatccctactctactatgccaagaatatgaccgaagacctcggtggtgccaaaatctacctgaaacgtgaagatttaaaccataccggcgctcacaagatcaataatgtgatcggtcaggcattacttgccaaacacttaggcaaaaagcgattgattgcggaaacgggtgccggccaacatggtgtcgcaaccgcaacgatcgcagcattgatggggatggattgtgaaatcttcatgggtaaagaagataccgatcgtcaaaagctgaacgtctatcgaatggaattacttggcgcaaaggttcatccggtgacaagcggatcaatggttctaaaagatgccgttaacgcaacccttcaagagtgggccagtcgaagcgaagataccttctatgtgatgggatcagccgttggccctgcaccattcccagcaatcgttaagcacttccaaagtgtcatttcaaaagagtccaagcaacaacttcaagcaaaagaaggtcaattacctgacatggtagttgcctgtgtgggtggcggcagtaatgcaatcggtagttttgcggattacatcgacgacccttccgttaaattagttggcgttgaggccgcaggtaagggagttgataccgacagaaccgccgcaaccattgaacggggcaccgttggtattttccacggtatgaaatcattattcatgcaaaatgatgacggtcaaatcgatccggtttattccatttctgccggccttgattacccgggcgttgggccggaacatgccgccctcgcacaggaaggccgcgcacagtacgttggcattaccgatgatgaagccgttcaggcatttgaatacattgctaaacaggaaggtattgttgccgcaattgaaagttgccatgcggtagcgtacgttgaaaaaattgcaccaaagatgtccaaagatcaaatcattgtctgcaccctttccggacgtggtgataaggatgtcgcaagtattgccaaatacaaaggagtggacattgatgagtaatttatcagacgtttttaaaaatcacaaagcttttattccgttcgttgttgccgatgatccggattttgcaaccaccgttaaaaatgtggttgcacttgccaatggtggtgctgacatcgttgaattaggcatccccttttccgatccggtagcggatggtcccgttattcaagcggcagacttaagagcatttgacgccaaggttcgaaccaagaccgtttttgaaattgttgaagccgcccgaaaagaaaccaatgtcccaatggtattcttaacttacttaaacatcgttttcaaatacggctatgaggcctttttgaaacgttgtgcagatttaaacgtttccggtttggttattccggatctaccatatgaaagtcgtgatgaaattgtcccaattgccgaaaaatacggtgtcgatattattccattgatcacaccaacctccggccaccgaattgaaaagatcgccaaaagtgcttcaggatttatctacgtggtttcctcaatgggcattaccggtgagcgaaacgaattctttaacggcttaaaggacttggtgactgaaatcaaaaagtataccgacgtcccaaccgctatcggttttggtgttcatacgcctgaacaggctcaagcaatggcaggaatcgctgatggtgtcattatcggcagtgccattgttgatattgttgctaaggaaaaacaaaacgcaccgactgctattgagaagtttacaaagcagattcgagaagcggtcgattctaaaaaacaggttccggttaaataacagctttatcaaaaaaataggcatcgcttcactttccggtcctttggataggttaagtgaaacggtgcctatttcatttttatcgttgtttcaactttttatttaattgaaagccaaaattccgattaaattaatcagtcgtcttttcgtcctgaaaatgtccatatagtttttcataattaatggttcccagaccggttgcctgattatacagtttacccggctgtcccgtgtagtatagattgttattttgatcggcatcatctaatacattaaatggtgtatcctgctgggccgcaaacttgtaaatttgtgggttccaaaacccgattctggtttgaaggccgctacccatgacagcattagctgcagccacctgtggcgcagcgtaactagtcccgccaccaatcatccagatcttggtttgcgctgttttgatctttttctttgaattacttattacttttggacccgaaagataagttgcatagccggtttgaatgtccgcattgcttgaaacatccggtaggtttcttgaatgtccggtcccataaatgacacgtgggtgtttattaataaggtacccgccctttttatattttaaaagttcaatggctctaaatgtattaatacccgagaagccctgctggtaccttggtgttgggtttaaagcggaaaatccgccaccgccaccgggaaaattggcgggctgattcttacttggaacggctgaataggtatcaccccaggctcgttcctgtttgacactgacaacccggtgattgatgatcttttgataaggtaaagttgttccgccgacaataacctgataaggagaagtcgtgaccgaatgattttcaactttgccgggcatgtcccaaggcccattgtccccgctggccctaaaaactgtaatcccttgagcagctgcctgttcaagcagtaaattaaatgcatgattatattgacgcaacgttgaactatgatcatcccattgtccgggtagttcaacggtcggtgcgaagctcgttgaaatctgttgatcttgattgtcagaaattgcttgtgcaaacgtcgtaaaataaacggctgaatcattggtcgcctgattgaccgaacttcctatatagaagtcaatatcagcaccgggagcgatcgcacttgcggattggacatccaaagttgcttcaatttgggcttccgataaagaatgattcatatccttggtgaccgttttagcgttatcaattgtgtaaatcttatgaatttggtttaaatgatcggcaacaccggcctgtcgccaatatgtttgtagatcacttttgcgaaaatcaccataggacacaattccaattcgctggttttgtccagttaaccctttgtcgtaaagagaactcagttgataatgatcagcaaacttggcagcaccatattgctttgaaaattgattgccggatatgtcggtctgaggcttttcaccacttgttggaacagcggcgttgctgatcttggcactttttttcgacgcaactttgccatctgcctttttggcatataggccgataaccgcaaccacatttttcgacaatttaccaggcaggtgatacgttgtccgtgacggttttcctttgacataccttgccttaaacgctttattcaaatcagacctatgccctttaactttgatagccaggtttcctgcaaacgttgacgtcgtcaaatggtacttattcagatacgttttgactgaattgacataggcggttgattgaccgaatttttctgcaaactgacttggcgttaaatattgatgataggacgatgatgaaggattcaccgtatcataaacgtcatttgttaagttcgtttcgctggtcggcttaaaaacaacactggctgtcatgacatgattatctgatttcttagcctttcccttagcaccggcagtcccgctggtggtcaaaaccagcaaggcacttaaagcaccaattaaaatctgctttcccctcatagaatcccccgtctttctaaaagctttctactacggtgataaatggtttcaaatacataatgtattataacagtttaactaagtcatccttattattaacgcttcaaaaaaggctgccaaacaaaattttcgttggtagcccacttcattttttgatctttttctccccaaaactaacctcaatcacgcttaactattttttagagcctatagtctccatggtgttcgacttgaaaaactgattcattttagttgacttatgtctgataaaaaacaaatacacaatattagtgatacccaaaattccccaagatttccaaccactgtttgtatcccttattcgcataaagatggctaaatctttcatcatctcgtcgaccaactcatgagtgaatttgaaaaagttcaaatcgctattaaacttactatttagcaatagtgtaaacaaaaacactaaaagccagccaattagatatgatcttccacccctggcatataaagccttttgatagatattaacttctttaccattatcatcaataaaaaaatatttagacgttgatagctctttgattttaaaattaacactttgataaaatcctacgacaattgagaaaataagaataacgatcaacatgacaatatcatgaacactattaatattcaatttagaaaaaaattgatataaacagaaaataggtaaaaataacagcctcatcttggttactttagaaaactcaaactgatctttaacgaaatatatgatgattaataaagaaacgattgaagaatatatcatcaaaatcccccctacttttaaaatgttaattcaatcatttatcaagaaaaatattgggatcaagctcttcagtaaccgcttctatactttattcaaaatgcttgtatctaaagtaacggtaccctatcttcttttcaaacacatgcttggatagtccggttgcgttggccaatgccaagtatattaacaaggccaccagtccaaaaatagcggcgtaaataaacgcagaaatcttggtcaccggtaaataaacctgattcatccctgtcgctgccaatccaacaacaattgcgaagcaggcgttcacgatcacgttgagcgtcaacttggataatttcacgttaaactcttttcggacctctctgatacttaagacgcagaccaatccaaacgaaatggcagtcgccaaaatggcaccaaatccctgaagccaggtaacaagcggtatttgtagcaccagcttcacaataagaccgccaatcaggtaaaacatcgcttttttactgtaatgcagtgcctgaagcaacgtcaaactattaattgccaatccaaggattaagctttgaatgatattccaaaatagatacttaccgcctaaaaagctgaatgggaagaaaacaccattaatttcaaaagacagagcacttaaaatcgtcacaatcggtaccagcgtaaaaatcaacatatttaagttttgaagaaccaaatcaccaatatcctttttaccggctgcccgactacttgccaagattggcagcgttgtctcagcaaccgccaacgccaatgaaacaacaaccgtcgtaattttagtcgggttggcagaaaacatggtaaaaatgttctgcgtgtatagcgccgtcttatgtaagacgttttccatgacctgcttgaaaaccagttgatcaaccagttgtgtcaatgaaatgcctgagccaacgacgacaaacgggatcgattcataagcgatcattttaaaagtcctgccaagtccttgtagatcgtaaggcttactttgctttgctctttctatataatcagcattttgtttcttataatagagcgccaaatatagataactggctaatgccccaaccagtgccgccataacacttaaatagacagcgtggataaatgacttgtgaaaaataaaaattacaacataggtggcggccaacataaagaccactctgataaattgttcccataattgggacacgccatatggttttaaatcctgattcccttgaaaccagccacgaacggcactcatagaaggcaaaataacaatcgcaggaaccagaaaacgaattgctgttgtcgaaatttgtggtgatacaacaggactgtttgctgataaaagtggtgccagtatgtacaatagaataccgcaaaccacaccggaaaccaacattaatccgaagccaactttagccaatcgtttagaattcaaaaatttattttcaccattataataggcaacccgtcgtgcaattgcagaaggaaagccagccgttccaagggagatgaacagggcatatggcgtgtatgaagtattaaacagcgcttgcgctgcattttgatgtgcggcacttcccatcattgccagccaagggattaagtaaatcacgccgagaactcgtgaaaagatactcccaaatgatagccagaatgagccggacataatttttttattcaaagaaaacacactttctagttaaatgtctaaaaggatattgtaccgtattttaacgggttacagacacctaattttggaatacttttcaaggtttacttccctatttttgaatcatcacggtttgcgtgattaatcagcccaaattctacaaaatcccggtattcaccgtggaaataaatctgctctttaaataccgcttctttagaaaagccaagccttttgggaatagcatcactcttatgatttcccgaatccacctgaatcaagatcttatgtaatcccatcgatttaaacccatgatcgatcatgagctttagcgcgcgtgtcataatgcctcttccctgaaccctactggaaagccagtatcccacttcggcgtgtcgatcagcgtgatcgatattatgaaaatcgatcatgccaaccggtacaccatccatcgcaatggttaacataaatacttttccttcaaccatccgtccctgtatatatttgatgaatttagcttctgcgcgctcagacttggtgtcatcagtccatggcatccactttcttaattcatcgcgatccgcttcaacaacctggaaaagggcatgtgcttgatccctttccggcaacagcaaactgatacgatgatcgtcaacattaaaatgattaaagacaaacatggtttaattcctttcaaaaataatggtcgttgacacttagcttctattataacctatattttgaacacaaaaacccgacttggcaaagtgccaaatcggatttttctttctatattatacgatcacacattgttattttgtataatcaattgatttcgtttccttggttgtcaataaagcaattaatgaaacacaagccatcaatgccaaatagaaaccaacagaatggattccccatttatcaacaaggaacgctgcaattgttggcgcaaacgcggcaccaatgatagctgccaggttgtaggcaattccggaaccggaataacgggtactggttgggaataattctggcaataatgcaccaaccggtccatagataataccataaataaagaaaccaacaaagatgaagaacaaaccgccagcgaggttatgttgtccctggaaaaagaatgggaagatcaatgcaaaggcaataatcatcacagttcctgtgaccaaaaccttttttcgaccaattcgatcggcaaataatgaggccacaacaatcataacaccgaacaaaacaacaccaagcattagcagcaacaaccactcacggttattaaagctcattgcggttgtgacgtaacttaatgaccaagttgtcaacaggtagaagaaggtgtaggcaacacccataatgaaagttcctttaaggatttcagcccaattatgtttaaagacttgagccaatggggatttttgaaccttggacttatccattgccaaacggaatagtggtgtttcctgcattttttcacgaacaaccaatccaacaataaccaggacagctgatgcaagaaacggaatgcgccaaccaaaggcttgcatttgtgccggcttcaaggttgactcaagaacaaagtaaagtccgttgcttaagaagaaaccgattggggcacctaattcgggaaaggctccataaagggcacgcttattagctggtgcgttttcagtcgcaactaaaacggcaccggaccattcaccgccaagcccaattccttgaatgaagcgagccaggcaaagtaataagactgataggatgcccaatgttgcataacttggcaacactccaatcacaacggtggcggtacccattgtcaatagtgacacaaccaaggttttctttcttcccaatttatcaccaaagtgaccaaatactagtgagccaaggggtcttgcaataaaggcaacaccaaatgttaaaaggctcaaaataagggcaatcgctggggtcactttcgggaaaaagactttcgggaaatatgtagctgctgcggtaccataagcataaaaatcaaaaaattcaattgccgttccgatcattgaagctaaaataactgttcttacaggatctctttgtaaagtgacagtcgattcttgtgtggaatcaactgctgtcgtaggcgtatcttccataaaaccattcactctcctctattatttacgtgttgtgaaagacaatacaatcactcattaccaggcaacattttcaaccattttcataaaccgcctcctttcctgaaataaaaaacgccaagaactgtattgacagttcttggcgaaatgcaccaaccctgcccgcatttgcttgcgggcactctaattagcccgcagtattaataataatcacaatgcgagaaattaggctatttaagtttaaagctgagttagtgtttttcatttcatgtgatccccttttcataaattggttttatcttatcagaagaaaaattaaaagtaaatgaaatttcaaaaattaagggttaatacctatataatcagatattaacccttttaatgatattctaatgttataacgtcacttatcctgactaactatcgcatgatctactgaaaaacgcttattagtcggtactcatcgtcgcatacttctgaatttccggagatagatcgaatatcttggctgcttcggataacattgcatgatatggatatgaaccatcacggtaaggttcaatcaccacttcctctgaaatcttggaaagtggttttttaccatccttaacctgtaacttgtctaaatccgcaatgattcttttctcaacttccgcatagcttcccaccagcggttttgtctgcaaattgccttgaactgaaattttcataaaaatccctccgcaatctatcgttttttttgagaaaatacatccgtattgaacgattcagatatatttagttacatgataccagctattatcgatttagttgagataaattttaataaaaacgtcatcttaatgattcaaatccacctaactttgataggaaagaccgcgcttaaggcgtttccagaagctagaatcatctgtctgcaaaattaacccctcataaattcggctgatataccaagcaaataaaacaattgttaaaacgagaaccagaagtgacaaactgatttcaagtgcaccggcttcattattaataattctcaacggcatgaaatatgacgagaagaaaggaacataggataaaatcttaaccaccaatcccgttgcgttactctgaaatggaaaagtcaaaaagaatgccaacattcctaaataaatcgcaggttgagctgctttgggtgcgtcttccggtttggcaaccagtgccccgctgaaggccgaaacaattgtgtatataatgacacccaggaataaatagaccagattgacgttcaataagttcccaataatcggcttaattaatgactggtactgatcaaatacctttctaaaggttgaaatccgcctcaaaatttcatagaacacatacccgccaataatgtaaacgaggatctgggttaaaataaccatcatcacacccgtaattttaccgataaagtattttgaagctttcgtactggaaaaaatgatttccatgatcttcgtacccttttcagaagcaatttcttgagcggtaacggacgaataagtaatcagaaccatgtaaataacaaagaccagaatccaaaacgacgctattttaacaatgtcgttactgcttgagctttgtttaatgtgctgcttgaaaatcggctgttgactcagcgacttcatttggcctgaactcagctttgcattttggacatttaaagcctgctgattcttatttaaaaaattttcaacgctcaacttcaatgaactatccattgactctttcgaataatagcgtgcggagacctgctgattggtcacagacaattgtaaatatcccgccagcttgtcatcagccacttttctcttggccgtattcgttgttgtcactttctgactaatatcatctttattggtactaatgaattgttttcgcagcgccggattatttgaaataacagcgatcttatccgtattggaaccggaagtcgcactcatatagccaacaccaagggatactgccaacattaagaatggtgaaacgaccaaaatcacaaagctccatgatttcacctgccgtaaatagatttccaatgccacaatccatgttttattcatgagtcgtcaccgccttcattctaaagatttcatccagagtgggtggctgttggctaaattcttgaatataatgaccaccggttagcttatcaaaaacttcaggcccggtgctcggatcatccaaccttaacaggtatcgctgatcacgaatatgggtcactttaacgacatggggaagctgatcaagctgatcggacgaccaatcagtcgtgacataaacttccgatttgccaaacgaatccctgacttcaccaatcgtcccgttcaaaaccacgctgccggttttcaacatgaccaagcgatcacaaatgctctcaacgttggccatatcatggctggaaaaaataattgccgcaccttgatcgcgggcttccaaaattgctttcttcaagagatcggaattaaccggatcaagaccgctgaacggctcatccaaaataatcaatttaggatgatgaattaacgtacaaatcagctggaccttttgctgatttccttttgacagacttttgatcttatcggtttttttcccttttaccgcaaacttatccatccagtcatcaatttgcggccgaatgacctttgcaggtttatctttcaaccgggccaaatagataatctgctgttcaatcgttaacttcggcatcaagctgcgttcttccggtaaataaccgatattatcaaaatcagcttcggtaaccggttctccatcccatgtaattttcccaccatacttcagaaaattcagaatgctgtgaaacgttgtcgacttacctgccccgttttgaccaataagaccggttatctgaccatccggaaccgtaaagctcacatcattaagcgccttaaccgttccaaattgctttgttatattctcaatatcgagcatgtgatcacttcctttaaattaatcatatcataatcattaaatgaataataattagatatgccttataaaaaagcattgttattctgaagtgttcgtaatttaacgaaaaaaaataaactattgttgtatgatcataaagataaagtgaggcgatcggacatgacgaaaaaaataccatagcgcattcggcgtatatggcatcattgaagtaaatagtagtttagttgttattaaaaagaatggcggtccatatatcaatcgatacgatctaccgggtggcagcttggaagatggtgaggcacttcaaaacgctattatcagagagatcaaagaagcaaccggattagtcctaaaagagatcacccagctggggattaaagcttcagatatccctggacctaccaaaaatggcaatataatcagcacatttgcgttttctaccagatttttttcacggccggtgttctcaaagatcaagtttctcaatttgttggtcaagattccctaggcgctgttggcatgcccttggacagactcactcttaccaattcgtcacctcagcaaacgacccattccaaatgctttcatggtgccggcttatttgttcggccgataaactaccatcaaatgttgtgtgcaaatgatgagtaatcgccatcttgaagcccaaatcatgacccacacgaattaccgtatcgatacaatattccgtctgcaaaccgcaaacctcaacagaagatagtttccgatgatgaagtagatctgccagtccagtttcaaaaaaagaatccgaatggtacttaagcatcacccgatcagaagattggtgatgcagtgctttgaccaattgccaatcgtcactgccataaggtaactctgaatcaacattctgaataaaaataaccggtcgttgggtatgaagatatgcatctattcgctgattgattctatctatcaactcattaaaaccgactgcttcttgaaggccgttttgaacatcaatgacaagcaatacatctttcaccataaaacagttcctttctcctcgatcagcccttcagtcctcgagcctggcgatccatatcttcaaccacaatatcaaagatttcacccaatgaagcacagtactccaagatttcccatggtttgttagtgtgaaaatgaattttaatcagtgtgtcatcaccaactgcaattaagctgtcaccctcgaaatggcctttaatataagcatcgattgcgtcttcatccagatcatgaccatcgattagacattggacgtcatatttatattcaatcattatttctccctccatagttgcattaaaaactattttcaagttgttatttaatacattatagctgtattagcctaaatagcgtacgataaacgttacaaaaaaagaaatcgactgttcagccgactcctttcatgcatctacgattctgatatctgtgtattcttgacttcactactttttagttgattatacatcattccccattgctccatcgctgaaacaaccggcttcaatgtccgtccaaattcggttaacgaatacgtcgttttaacgggaaccgttggataaacctcctttgaaaccacaccatctgccaataattcctttaactgtaaagcaagcattcttctggaacaagtagacattaatttttgtaaatcactaaagcgtttcgtaccatccagtaaatgataaacaatcacgctcttccattttccggcaataatctgcagggtactttcaacggggcaaccttcttggcaatcataaatctttctcttcaatttaattcctccctgaacgattagatatcgtcactttcatgttaattcccgagagtaatcgtttcaatcagaaacgcttactctggaaaaatttgtaacatagtccaaaaaaattcacctcttgtttcgattctgaatcgttctacactaaaactaacaagagaggagtcatttatatgaaagctattggattcaccaaacctttaccaatctcggatccaaaaagtctggaaacgttcgaattagacagaccatcacctaaggggcgtgatttattagttcagattatatcaacttcggttaatccggtcgatgtacaggtacggggcaatggtcatcacactttgaaaaagccaaaagtgattggctgggacgcctatggtcaagtcgttgaggttggcagcgatgtatcaattttcaacattggtgataaggtattctacgccgggtcatttattcgatcaggatcagatagcgagtaccaattggttgatgagcgacttgtcggccatgcgccaaagaaactcacagcagcccaaatcggcggcatgccgttaacaagcctgactgcgtgggaagtactctttgagcgcttgcaaatcaatcctgatcaaccagagaagaatgctgataaaacaattttaattatcaacggttccggcggtgtcggctcaattgcaacccaactcgcacatatggcaggactcagagtcattgcgagtgcatctcgtcctgaaacaattaactgggttaaaaagaacggtgcagataagaccgtcaatcatcgccttaatttagtttccgaagttcgcaaacttggttttcattatgtggactatattttaaatttaaatgatcttgatggtcactggggtgaaattgctgagcttatcaaacctggcggcaaagttggcgcaattaccgaaaataaacacggtattgatttacaaaaactaacaaaaaagtgtgcatcgtttcactgggaatggatgtattcgaaatcctactatcacaccgacgatatggtgacacaacaccagattcttgatcgggttgcaacactgttggataacggtgtgatccattcaacggtcaccaaaacgttaacccccattaatgttgataacttaaaacgggctcaccaagaagtcgagacaaaccatatgatcggcaaaattgcgatttctaacgaatcgtaacaaaaaacgcttttccggcagaatcgctaaccggaaagacgcttttttgattctagtatcgatatacttttggaataaccacatggcgcttggtcttaaacggtaaatatgccatctgcctatctagtagaattgaccgataataatgtccatttaccagaactctcgcaggatggtaaaggccaaagcagccatctttaacccgtttatcgaagaacgaatattgataatggtcctctaacttgattctctgcatgatcaggttcttaccgaaaactttgtgttccccctgctgaactgaatttgctgttattttcatattttcaaactgatgatgatcttgatcgtagagatgccaagaaccgataaatgatgatggcattgtatgtgattgaacaactttgggaccagcttgggcattggcctgtactccaaacgcgactgttagcatcgttatcccagctatcaacagtaattgttttttattaaaaatgcttttcacttccaaaaatttctttctgatcggtcttcactttatggtcaaaataacgttgcgcccattgtccatagccaacactgcacactgccaataaaacaatgtataaaaccagcttcgctaccgaaacaaataagagtggcacgccaaaaagcaatatgaaaaaagcaaagaaagtccagccaaaaagtcttttaacgccattctgccgatgccagcctgacttatctttaaataaccagtagagcacgagccccataataccaaaccgccaattgacttgccaaaacagacgccttgtataatcttttgtagaacttctcaataaaatctcctttcaattatctataaaatagtcaactttacgtaaattgattaattgattaataaaagattattcgaaccttttataacgtcaaatccgcccttttccaataatccatgtaatgccaaaccacgtaagttgttgcaatgataacaatcatcattgcactcacgttgataatgactggtggaaatgcgttaagcatcgctgcatagagtccgaccaccatcgcgccaacaatcatggttcccagaataacaaatccaatcagcatattaccaccaccccgattaaacagctgagtcgcatttgtccacgttaggtcaagcagtcgccagtcacgagtgtagttgtacatactgcttaaaatattgccgaggacaacccccaagcaaagcgtcagcacattgagccacagcaattttgcaaaaaaaccaaacccaatggccaaacaaatcaaaaccaaggattgaacaatgacaatcaatttgaatttcaaccaaagatagcctttgaaatcaattggcaatgacttaatgaacgccaagttttgtcgatccagtgaaatcatcacacttgaaagagaaccctgattaaccgtaataatagctaccataatcccagccacaaacatcacaccagcgtatttagcggtaaggttcgccaatgaaaaaccattttgaacaaacatggcaatgctgtaaatcactaccgggaatattgtgatcgatatggactgggttaacaacgttggatttccaagcaagccaagattataacggataaattggcgtgccatcccctgaccttgtcgatgtttgcgttttacggttctcgcttgcacatttgcaccgctcataacctttggcagtaaccacttctgtaataggacacccatgacaaatactgatatcaaaagaacggcaatcgttacaaggctgaccagactagtcggatcaacgacgatctgatgtaattgcgcaaaccccggaatagccttaagacttgtggaattatcgttgtttgccatattcatcacaaatactgcaacagccattgcaaccattgtgatacccgtcatcaggaatgtcattaatttttgatgatgtcgataaatccccgtttgagcaaaactaaaaattgcgattgaacaaaatagaaataaaaatatgtagtagagaataaataataatgtcccgactgtaaatccgatgccaatgaatcgtcccgtttgaatgcctgtaatcacaaacatcatccacacaggcaatgcagttggcaaaatggttaaaccgactaccgaaaatttggcagcaaaaactgcccattgactcaatggtagcggcaaatagtcctttaggtccttactttcaaaaaagacgttatcaatcgtcgtcacactttgagataacccaataatcgtaaacaaaccgacaatattggtaaattcgccaatatccttgaccaaatttgttgtgagcagtaatgccccatatataaacgcgaacagtgcgcccaagagaagatattgataaatgagtgatcgatacagtgccgcacccgtcttgccgttttcacgctgctttcgagtttgttgaggattaacatacaaaatattgattttaatcagttgcattaattgccgattaatcatgtttgtcttccccctcaagttgattgatcatttcattgtcaccttgacgcccggccatctttaagtagatcgtttcaagagtcgcgtttggcatagtacttagaagctgattaacagagccattataaattaactgcccatgacgtaaaattgccaattcatcgcataattcttgcgcagttgccaacacatgggttgaaaatacaacggtttttccctttgcagcatgagaacgcattaacgtttttaaatcatagattgcttggggatccaatcccgtcattggttcatccaacacccaaatatcaggatcgggtaagagtgcaccaatcacaatcgtcttttgtcgcatgccatgtgagaaatcaccaatcgcttcatctgcgtgtgaatccatatcaaataaccgagccagttcggtttgacgctgttcccgggtatccttgggaatctcataggcagaagcgattaaatcccagtaatcattagcagttagttcgagaaacatatccggagagtcaggcacatacccgatctttttcttaatagataaacgatgttcggccaaattatagccgtccacgctaattgtccccgacgttggttcaataatactgaccagactttttaatgctgttgatttaccagcaccgttatgacctagaaagccaaaaatcttaccgcttggaatggtcaaagaaagatcttttaatgcttcagttgaaggatacacttttcttagatggttaaattcaatcatgttatacacgcccctatcccgagatttgtttcattatacaccggacgcctatcgtaacaaatcgcaaactgaaacacaaccgcgataaacattgataaatcaagattgccatcattcaaagcatccattcacgccgctaatcaagtattaggttataccgattttgtgaaataaatatgaattttttatggataaataatgaatttaaaatggttaagtgggtgaaaccattctttaggtcaacaagcttatacacgaaataatgcaaaccgataaccttggtttgcattatttgacatgtgccatcacgttaggaaccattagaatcacaaaaaattgaagtttgcaatttccataaagctcttaaaaattgattttttaagctttagagacccctatcaaataaattgttagttttttggtcatatctatgtttaagtagaattgaacaaacgtaaaggggtgacttaaatgcacgatgcagaaacaatcggaaaacgtatcaaaaaaattcgtattaaaaatcagttaacccaaaatcaacttgccgaaaagttatttgtcacacaacaaactgttgcgcgctgggaaaacgataaacaccagcccccgatcacagcggtccaggatctggcaaaattattcgacgttgatgtttcatattttttcggggaggatctgattatcgtgagaaaattcaatttctttgcattattgggaagtctcgtatttaatttcttgttcttttggatcgtcgcgctggttgtcattactttattcattaccatttggggaacgactgcaggcagtctactatctcccattattatcttattccaagcctatcaaggaattcgtgccttcacatggatcagatttgcatcaaccattttaatggccgtggttgcccttattttaataccgttattatggatgatcaccaaatacctctggaagatcttacgtgcctactaccgatataatatcagttcaattatctatgaagtaacgcctcagccacatcataaaggttaagacactgatcgtttgtcattacgcaaaggaaggtgactaataatgagtcaacaagttatcaacgttcaaaatatcagcaaaagtgttcctattggtaattaagatgcaattccatgattataaatttatgacaccatttttattaaaattattttcaatttacaaattaactggcaaaggaatttgtaggaggcactaaagatgcaaaataataaagtaatagttggtaacaatatttctaagacctttaaaaaaggaaaaaatattactacagttttaaaaaaggtcaatttaactgcaaatcgaggagaatttctaagcattgttggaccctcaggttccggtaagagtactttactacagtgtatttcaggaatgcttaaaccaacttcaggagaaattgaactgctgggcaacaaaatatataacctgtccaacactaaaatggcaaagttacgaagaactacaattggttacatatttcaaaattataaccttgttccttatttgtcagcttttgaaaatattgttttgcccttaagactttcaggaataaagtggaatgcaaccaaaatcaataacttgctcaaagaaatgcgttttaccgccagtcctaatagtaaagttgaagatttatctggtggtgaacagcaaaagatagcgattgcccgttcgtttattaaaaatgatgagattatttttgctgatgagccaactggtgcacttgatactctctcaaggagattcattttcgatactttgaagaagatggcaggaactggaaaatgtgtcattatggttactcatgatatcgaaatggcttctcaaacagatcgatctttagtacttatagatggtatggtcagctcaaatattgttaaaccaactgaggattccttacttaatgcatttaaaagtttggagtgaaaataaatgataaaagtaattgtggcgcagttcaaaaattcgtataaacagtggggcggagtgctcgccctcctaagcattagtgctgtaatgattggattttgttttaatggttcagtctctgtattttcactaagtaagcaaacatttctgaatgcacataacccactcccaatcttcatactgccattagtttttggaggaataacactaattataatctcaagtggggttataaagttagccattgtatctttgcagaaagaatatgttctttggtcattattaggaacttctccattacaattaaccttattgattggcgggcaattatttttaataggaagcgtttctgggataattggttatattttatcactaccacttggtaattttctttactcgatactacaaaaaattgtcggaaaatcatggcttcctagcatcccaatgaatccatctctaattgcaatttttattacgattttgttaactgccatgcttgcttttgtttgtggattcatacatgcaaattctatatttaaagaagtaggaatccttcggggtaaggaaaagcatagtcatgatatcggtttcatagtaaaggtattaataattgtagggtgcttatttttgctatttaaaaattacacagcactgagctttgcttctaaaggtattcaagcgataatagcaaaaggccaagttttacacgcggccagtttctacgttgctaacctgttatcaatcgctttgttattaatgattctttttggattaacggccaaggaaattctaccattcttaatacatgctttatttattacgcctttcggtcataaagtaaccggtccaaaaattgctggacggatgcttatataccaaaaacattatctaggttcgttgatagtaccctttattattacgtcaattctattgactgataccctttttatgacgcttggcataccaggaaacaatggcgctcaaaattctagtggaacactggttacgtttattgtatatgtagccgctcccttaatcatagttcttgctaacattttttctatgatgctaatggttacaaataaagaacagcaaataaatcatcagttgcgtattttaggcacaaacacgactcaacttgttgcaactgtcttttataaagcctttatttgcggaatagttacagttatttggggagccctatttaatagcatactttatctagctttgtataagatcagtttactagtccgatcacctgctaagctaaatatatggtcaatcctttatttccccgttgctagttctatcttatccttttcatttattttaatgataggttgttattcaattaccaagagtcatcatttaagagaatagaaataatgcaattgtcttatcaatgtacagaggtgtcggtaccgttatttctgctcgttcaaaagattggtttcaatctccatcatcccatgaacgtttcactcagtacgatcacttattggccgacaatctcatttttgattattttgatttttatcataacagtcgatgtcgcccggataatcaaagtacagtcatcgaacaatatgtcttaactccaatattgtattaaaaaaacaacccgtcgtgtcatgaccttttcgcatctatccggggcggtagaaatcgaggcaccacaattgactggtaacgatattctgtttgggattgagcaaggcccatccggtaataaaactcattatatttacagtgttaaaaaatctattttctagatgaaaaaaaccttcccgaataaggaagggatacatattatttactttatttgggaattcccaattgaattgagcacgctccataatctcgcatgtcccgaaagtctggtaaggtaactggatatcggtactgattagctaagttaaagcccctttggtcatcataagagtccgcatagccgacaatgtctaagccaatgtcgtaattagacatgctatttctcttgtcttgatcgtaccccagctctgtaagcctttggtcaatcagtttaacggctttagagggtgccatacgttcatagtaagtataatttccctcgctattaaacgaattcaaatctatagctttagtacttgtaaattcgttcaataaataagttttttggggtaaagaaacatactgtaaaaggcacccgtaaaatgtaggaaaacggcaggttagaactgttggttttcctacattttttgtatcatgaatcacatcagagtgtaggaggaatttgatgtgagacgtgatttaagagaa

SEQ ID NO: 431 - DNA, 94868 bp, Unknown
  Metagenome-assembled genome
atcttttagttggctagagaattgtcggcgactttggaaaaattgtgagcgtcaattaaccaccagtctgcaaatggtcgttttagcgtttttagcactattacttaagagattttagacagcttctaagaacgcggaaatcttaagaaacgctgctactaaataatgttgtcatcaaaaaaggcgtcacgacaggttgtgagcattgctcatcgtcatgatgcctttttgaatacgtaaaattttatgtaaaagaaaaagcccctcacaggaggcttttattactttgatttaactttaagcaggtgtaacgttagctgcttgtaagccacggtcgcctttttcaacatcaagggtaactttttgaccttcttcaagagtcttgaagccatcagcgttgattgctgagaagtgaacgaatacgtctgatccgttttcaagagtgataaaaccgtaacctttgtcgccattaaaccatttaactgtaccttgttccataagatgaaacctccgtgcgctgtgcgcaattataaattttgcatttgaaacttttgaagtaaggagacatctttgaaaacgccgtaccaaatttcgaagttaaccaatacattaatggtaactatacaggtaccctggataaatagcaagcattattaaccggctattgtgttattttcaaaaacgtcattgatgaatcacatacagggtaaggattacacgcttaaaaataattttgaaacaatttggaaatgaactgaaaaaataagtctaccaaactcccctacaaaattaattattgtgatcggaggttgtttaaagaagatataataaaataaagcgataggaaggaagcctttatcaatggcaaaacaactgacgacattaatcaccggtgcggataaggggattggatttcaaacagcgttggaattgggtaagaggggacaccatgtcttggttggtgcgcgagacgttggtcggggaaaagaagcggttgaccgattaacaaagagtgggataaccgctgacctacttgaaatcgatgtgactgatcggacaaccattcaagcagcagcaagtcaggttatgactaaattcggttatcttgatgttttgatcaacaatgccggtgtggctttggatcagcatcaaccggcttccgagctgtcaactgaagtcatgcaaaacgactttaacgttaacttttttggtgcggttgatgtgattcaagcttttttacctttattaaagaaagccgatactgcaaagattattaacgtttccagtaatatgggctcacttgggttggcaaccaatccggcttctcaattttatggtataaattccttagggtaccaggcatccaaggcagcgttgaactttgccacgatttgttttgctaaagaattggccgatacaactataacggttaattcggttaacccgggttggacagcaaccgaatttggcggtcgtgacttaaagcagtcgatgccaaccgggatgcagtcggttaagaccggagcggctcaaattgtaaaattggcgagtgatcctgaaaataaaataacgatgacattcactgaaaatcaggggacattaccgtggtgagaattcagcttgagatggtatgataacagtaatgatttattaaacgaaaggcgggtgttgaatggggtatattggacagattgcgttaattctaattgcaacattactggcaggtgcgatcagccagaggttgacaatgccggcggtcattggtcagcttttggtcggtgttgtattaggcccaggtgtttttaatgttcttcagaataccgagttaatgcatgccgggtctgaaattggcgtcattatgttgatgtttattgccgggattgaaagtgatttggatttattgaaaaagtattttaaaccggcgatgaacgttgcgatgattggggtgctcttcccgatggttgttttttacggttacgggcaactaatgggacagtcatttgaaaaggcgattttttggggtgtgatcttcgctgccacatcggtttcgattagtgttgaagtgcttcgggaatatcatagcctgaatacaaaagagggtgccacgattcttggtgccgcggtggttgatgatattattgcggttatcctgctgagcatttttgtaagtgcgtttggcgtgggtgattctcaaaaaatgaatttggtacagtcaacactgtttcagttgctgtactttgccggtgtcgttgtcctcgttaagtggttggcaccgattatcctgagagtggccaaacggctgcctgtccgtggggcagtaccaattacatcgctgttcctgtgcctttccatggcatggttggcggatacaatcgggttaagttcggttgtcggcgcattttttgcgggcgtggctgtatcacaaaccgattttcaagatgaggtttcggatagtatcagttcggttggctatacattctttattccgatcttttttgtgagtatcggattggatatgacgtttggcggtctgcttcataacttgggctttgttattgtgatgaccttgctggcaattgtgaccaaattatttggtggtgctattggtgcggcgataacgaaaatgaactggcattcggcatttgcgattggttcaggaatggtgtcacggggcgaaatggctctgattattgctcaaatcgggttgtctgctcatttattggcaacaaatctatattcggaaattattatcgttatcgttttatcaaccattattgctccaatgctattaaaatggagtttaaagaagaccggcgcataggtcggacttttgaaaagttgagatattgagaggagagagtgacatggttactgaatttgcaagcggcgccgttgtctacaacgttcaggacggtgatatctgttacctgttgttacaaagtgcgaccgatgatttttggggattaccgaaggggcatgtggaaccttacgaaaatttaatccagacggcagttcgggagattaaggaagaaacaagtttggatacgcgtatcgatgccaagtttaaagagacaatcgattatgatatgaaaaacgggcaccacaagacggttactttctttgtcagtaaagttgctcccaatgtttcggttacccgccaagttgaggaaattaattcgtttggttggtttaattacaaagatgcctacgataaattaacatatgacaatttaagacaactgttaaaagatgcggacagatacattcgaactaaagaagaaatcggggattagtgtgcaatggaaaatcgagtttttgtgattaccggtgcagccgggagtgggaaaaccacgattcgaaattatttacatgataagtatggcatgccacgtgtgattacgcatacaacacgaccaccccgggaaaacgaaaagaatggcgttgactattatttcgaaacaaaggactctttttctcataaccattatttagaatcggttttgtacgcgggcaattactatgggtcatcgtatgaaggattggagaatgcgtggcagaaaaagtcgtgcgcctgtattgtattggatggtgcgggtgcagtgacttataagcgtaaactgggcgaaaaagcggtcattattttcttaaaagtaggggataccgaaattctaaaaaaacggatggaaattcgcggtgatgatacaacaatggttgccaaacgcgttaagagtgaggaatatgcacgtgatttggaaatgcctacccagttgaaaggaaaagcatttgaaattttgaatacggatctaaaacggactaaggcacaagttgacaagattgtcgctaagtatccacacgagggatagaatgttgttgagaagcgtcctttatgttactattaattgtatagtaaacagtaatcattactaatgtgtaactcttgtcaaatgaaaagtaaaggtgatttcaatgcctgcagcaattgaagaagcaacgcgtctattaaaaactaataattttaaaataaccaaacagcgtaaagccatgctggaatatcttgtcgacacagccaccaaacgttttgtcgaggtcaccagcattgatgattttatgcggcaaacatttccaaaaatgagtcataacactatttatcgcaatatttcagaatttgcagatctgggaattgttgaacgccagatacagggtgatcgggcttcggtgaagtttcagtgcgattttcaacacgaacatcatcaccactttatttgtagcaactgcggcaaagtcattgaattaaaagattgtccattaagtgatgctatcacagcacaacttggcggatgtgaaattaccgggcatctttttcaaatctacggcctttgtcctgagtgcgctaatttaaagaataattaatcaaaaattcaagatttgttgataaaattgtgcgataatgtggtttactaatttagagaataggaagttttttgaatggataatagaattccgccattagtaacgccatttgcaatcttatcgatttgtttggcacttggagcgactaacgtagtggctaataaagtcacgggaactagtgagggaacgcctacctccactcaaacgaccagccagaagaatatgaccaattcgatttatggtaaaacgactcctaaaaaggatgataccagcaataacgataaggccaaagaatcttcagagaaggctaaggagtcttcggaaaaggctgcaaaagaatcgtcgcttaaagaaaaacaaaaagaatcgtcatctgctaagaaagcatcatccgatgctaatgaaagcagcgatacgaatacggatgatacatccagcagtgataacggtacaaccggtacgacaaccaagaagtcgggaactacgacgaataagtcaaatacaaactcgaagtcgaatacggggacaaccaaaaaatccaacaatacaactgggaacactgggacaacaggcgatacaaacaaagataatacgactgataatcagacaaccgggcaaactaacgatggcaacaccggaaatacaggaacaacaaccaataatagcccgacaaattccactggtacaaataatgacgatacaacaactcaacagaatacgactggaggtggtcaataatgtttagttttctggatatgattaatcattaccttggctacttcaatattaacgttgcggttaaaagtcgaatttatacggttctgggatttttaggcaacatctatttgttttatatcagctttcggtttttacaaaataaattctactcaaagggctttttacttttagcggtctcaattattttgttctactttttaatttgtaacttcttttactactttacgaagaagcagccgtggtttgatatttctccaaaactagcgagaatgttgcatcttcagcctcatgaaaaagaaattcaggcaaactccaagatgggtaacacagtgattcaggaaccatataatcgtcaagataatgcagcaaatgggatctttgacgagcagcacgttttgccggctaaaattgatgtgtcaccgtccgaacagatgaatctcaatcgattggtcgcccaaatgcagcagcaacagctttttcgagctgattataatggtatggatgatcgaaaactttacgaactgttgaagattaatggcggcaagccgatttatgcaattggcaagggtgttatgatgccttattttgagatgagacatcagaataatgcgttgattgtatatgcgggattgaatcaagctgagatttatccggtaggttcgatcaagcgggttggcctacagtcgattcggtcgattgacctttctgatttgaaactttatttggcttctgctgaattatttggcggaccgtacaaagaaatcggccgggttggaatccttgagcacacccagaactacacattacgggtaagcgttgcctataagaaactctgatagatgagaagcggctaatattaaaatataacgttaagaagtttgggacatcatttgttccggacttctttttgattggcaaaattcgaaaaaagatacttttggacatacacatgtcagactctgattcaattttcaatagtcgatttttatgtttgttatgatgtgatttgaacacttttattgcgttctcttttcttttcacaagaattcctgtaaaattgttatacattagataattttaacgatctttttctttttcacattttgatacaatcagttcgagtgttgaactgttaatctatcacagcagtgtttcatagcaaaataacggttaaacaagacgtgaatgacaggaaatgttacatgcccctaaatttaatgttacatttttttgacctcatgtcacttttaacctaaactggagatagattcattcttagacaattctaatattgtctactattggaggaaaataacatggcaatgatcgaatttcaagatgtacaaaagtactatggcaatttccatgcattgaaagatattaatcttaaaattgaagcaggtgagactgtcgttttaatcgggccttcgggttcaggtaaatctactttaatccgaacggttaatggcttggaacggatccaagaagggaaattaatcgttaacggacaggatttagcgaacaaaaagaccgatattaacagaatccgtaaaaatgttgggatggtttttcaacattttaacttatatgcaaacaaaacgattatggaaaacattatgttggcaccacggattgtattgcaccgtaatgaggatgagaatcgaaagattgcgttggagctgttggatcaggttggtcttcgaagccaggccgagaagcttccggcacagctttcaggtgggcaacagcaacgaatcgcaattgcccgttcattagcgatgcgtccaaaatgtctgctgtttgatgagccgaccagtgcccttgatcctgaaatgattgatgatgttttgaacgttatgaaagatattgcccgtgactcggacatgacaatgttggttgttacccatgaaatgggctttgctcgtgaagtggccaaccgggttgttttcatggatgacggtcgcattttggaagatgacagcagtgaaaagttctttgatggtgaaccaaccaatgagcgtgcacgacaatttcttgggaaaattatcactcactaaaacgtcgaattggaggaaacatcatgagaaagatcttatcaaaggttggattggtcgttgcactactgatcatggttgtttcactgggtgcctgcagcagcacttccggttcgaaacgcgatgttctaaaggacgacaaacaatccaatacaattacttggggtgttaaagccgataccaagctattcggtcttatggatgtgaaggataaccaaatcaaaggatttgaagttgacctcgctaaagcaatgaccaaagagattcttggtaaaaaaggcaaagcccgttttattcaagttacaagtcagacccgaatgccattactggcaaacggaaatattgatgccattatggcaacaatgacgattacaccgcaacgtgccgaacaggttgacttttcacgttcatactttgatgccggacaagcaatcctggttaaggatggcagtccgattaaaaatgttcgggacctaaatcgtaaaggtgccgtagttcttggcgttgttgggtcaaactcagttcaaaatattaagaaattcgcacccaaagcacgagtacttcaactgtctgattattctcaggcactaactgcgctgaagtccggtcaaggtgatgccttaacaactgataacggtattctttacgggatgtcaatcgaaaacccgggttattccgttgttggcggaacctttaccaaggagccatatggaattgcaacagctaagggacaacgaccatttcataatgcaattaatcatgcattgacgaaggttgaaaattccggtgaatataataagctcatttacaagtggttccataatgttaaaggctttgatatgaagggggcagaacgatgataagcatttttcaaaattacggtggtgaattgctcaccgggcttggtcaaacgctcttatgcagtatcattgcgttaatctttgcgttgattatcggttctgcatttgcgattatggagaccatgccaaacaagtttgcccgggttgttgctcgagtttatattgaagtttttcgaaatattccattattggttattacaatgtttttctacgttgtcattccaatgtatatcgttaagattagtgggtttgcatcagggaccgtcggattaacattgtattcttcggcatttattgccgagacggttcgttcagggattcaatctgttgatcccggacaaatggaaggtgcgcgttcaactgggttatcctactggcaatccatgagatacatcattttaccgcaggcatttcgatacgtcattccaccactgggtaaccaattcattaacctggttaagaattcatcggtcctggccttcgttgccggctttgatttgatgtatcaggcaaacgtcattgcatctgattcattgcaaagtatgagcacgtatatgtgtgtcggcgtcctatatttaattttgacgttgccgttgagttattacatgcgtcatcttgaaaagaaattggcctaaaggaggaatgataatatgctaacagttttaggtgcatattcatgggttaatatcaagttccttctagagggagcctgggtaacgattctcgtttccgtttgttcaattgtcttgagttacatattcggtgtaattcttggcgttacccgttacgttcaaataaagtatttatcagcgatcgtcggttttgtcattgacattattcgtaacttaccattgatcctgattatcttctttacctactttggattgcctcatcttggctttaaacccgatccgatttgggcttcggttattgcaatggcagtctttgaagcggcaatggttgccgaaattgttcgtgccggaattgcgtctattccgactggacaaatggaaggtgcccgtgcaaatgggttgtcctactggcaggcgttatggtacattgtgttgccgcaagcaattcgaaatatgattccagcgatcgtcagtcagttcatttccttggttaaggatacgtcattggcaaccattattgtgttaccggatctaatgaaccatgcacaaattatttacgggcaaaatacaaattatacgattccaatgtttcttgcactagcagtcatgtacttcattgtttgttactcactatcattattctcgaagtatctggagaaaagaatcggtgggggcaacaagaaggggaaagccgatgaggttgtgcaggatgcaagtgacgcttaactcattcgacttaaaattgtaaaacattgtgatggtagcctgttattaggctgcataaaatacaaaaagattgactgtcattttttgatagtcaatctttttgtttaatcaaggacttcaatttctttaacatcggcaaactcgctcatttttttaataaaattatttgaattaacctttttctttagtctgacagtgactgccaatgtgaaagaatccggatcatatttaacaattctcatctggatatttaaactgccgagtgatttaagcctttcaggtaatttctccatttccgttaattgtccagccagggtcacctgcaaacgcaatagtgaccgatttgggtatctctttagtgctcggattcggcggacaatcgtttgggtcactaagatgcacaatgttccggcaatcccaatgatgtacatgtcagcgcccacggccaagccaatcgcagcggtagcccagagccctgcagctgtggtgaggccgtcaatttgattgtttcgggtcataatggcacccgcaccgataaatccgataccggttacgacaccggcggcaattcttgaaggatccacaccaatgttggaatggccaaccagatcaaagaaaccatattttgaaataatcataaatagggctgagcccacagcaaccaacatgtgggttcgaataccagcggtttttagtcgggattttcgttcgaatccgaccaatccaccgcaaactgcagctaccagtagtctaagaacccactccatttgataaaggataaaactcaatttgtcaccttcttacgtattgattcagtgaatgctttacaattccaatgataaaggattcggaaattaattactaaaattagcaccggaatctgataatgattgactgggcaatctattattgtttgtagtaaaaaagagttggcacgttttgcatgccaactctttttttaatcttaataacgagaaattaaccgttgctcttgacacgattttcattaacgctgtcatcatcttcatcgattggtgcgtcttcgttttttggttcaacaatgccatgctttttggtttcgtaatagaaaacagggacaccgacagcaacaaagataaaggatgttaaaacgcctggaaggtctgacatgatttcactgacaatcacgaacagtgaaccaccaatggccacaattggcgttaaggggaatagcggtgttgaaaagacacgatgttggtttggattgcgctttctgagcagaaagacaccaacaaaagccatcacgtagaagcaatagacagtgaagatacatagttctgaaagtcggtctgcatttgagaagacaatcatgatagccacaatgattaattcagcgatagttgaaaaaatgggtgtgtgtgactttgggtgtaagtatgacaatgtctttgaaaatggtagttgattgcgtttggccatggcgtacataatacgtgggaacgtcatgatcttaccgttcatacagccgacaatcgagatgataataccaatactcaagattttgccgcccacgttgccaaaggcagttgtggcaatgaatggaatggcaccagtacccatactgtgaattttttcagcaggaatggcgcgataaacaccatatgaaactaacatataaatgaccagaacagctaaaataccgaatgtgattgcttgcggcaacagttttcgaggattcttgatttcaccgccaaggttggcaattaaaatccagccatcgaaggcaaataacgttgctaaaattgcgacaccaaagtttcctgcagattggtggacttccgaaatgctttggcctaacgcaccctgttttccgaagaataatccgaaaatgattaaagcggcaaccggaacgagtttacataaagttgtaataatagcaaaagttgcaccgtagcggttggaaaatagatttaagataccgaccagaatgattgttccaatagcaattaaagcattgtatttacttggaaagccgaaaaaatccgacagtaaaatagcaaggtaggcacctaacgatgcgatcatcgcaggcccgtaaatgacaatttgcatccatccggacagaaatccccagattcggccgtagattttttccatgtaaacataaagaccgccggtttcgggcatttgggaggcaatctcggcaattgttaagccggctgtgatggttaaaatcccacctgcaagccaagctaaaaggcccatggtagttgaaccggcatcatccagtacagctgattgacggacaaagacaccggcaccgataatcgttccgattaccagtgataacgctgaccagaggcccaggtcccgatcaagcgacacttctttttgttgtttcattggttttcttcctctctttaatgactgtgatggtcaaataattaattgactattattccgttggtaaaaggtatttttcgaatcgcttggcatcgacactgtttagttcagctgtcacgacggtgccgttttcacgatagtcagtttttagaatagtcgtattgtcgtttaaataggaaacgatgtctcccttgtcaaaaggaattaacaaagagcgtgtttgataatccttgaagactttctctttgataatattggccagttctttgagggatggctggtcggttgctgccatgatcaggttgtcaccttcgcgagttgggtaggcgatatccatcttatcggctttattaagcgcaacgaccattgggatattatcaaccccgatttccttcaatgtttcctcagttgttttaatcatcatctcccggtgcggatctgaataatcaacaacctgaacaagtaaatcagcgttggctgcttcggccaaggttgatttaaacgcttgaaccaattgatggggcagttgactgacaaagccgaccgtatcactcaaaagaaacgatttttggtccggaagcgataattttctgactgatgtatccagggttgcgaacagcatatctttaaccatgacctgcttatcatcgttgttgccaaataagttgatcatgccattcatgatggttgacttaccggcgttggtgtaacctaccaaagctacagtcggtgtgtcgctcttatcacgttgtttacgtttggtttggtcagccttactggattctttaagttcacgattaacatgggtgatgcgattttccaatgttcgtcggtttaactcgtattgtgactcaccagcaccacggttggtaaacccgccgccgctactggtaccggtttgctggtcgagacgctggctggcactggtatgaagacgcggcagttggtattttaatttggcaagttcaacttgtagcttggcttcccgcgattgggcccggttggcgaagatttccaaaatcaaaccggtccggtcaataattctgaccttggttgccttttcgatgtttcgaatctgactgggtgagagttcatcgtttgcaacgattgtgtcaacaccgtcatcgataaccacttgagtgagttcttcaatttttcctttaccgaagtaggttgccggatcgggtttatctaatttctgaatcaatgtttcgactacttccatattgttagcttcggccaagttgttcagctcggtcatcgaataatcaaaactgtttggatgttgattaagcccgatggttactactggtgtcagtgtttgtgttaagtccaaatgtgttcctcctctaaagttcgtgttcaattatagcacacaagtgtaaaaatatagtagacaatctcttttttgatatgacattgtaattgtaagcgattgacgtaggattaaaatatgatttgaaaatgtaggttggcttggtcatgctaatagtaatttaatgatgatgtggcagaattcttcttttttatgagctgaagtgtactggaaaagctatttataaatatccgaatagctattgattttaattaaaatttaatctagaatcgactatgttctcattttttaaaatacatattcgaaagggtgcatatatatgaagataaggtcgtttgccaaactgggtggtgcaattgcactttccgcactggtgttagctgggtgcggatccaacagttcacaatccaagaaaaaagaattgaactgggtccaacagagtaacatgacaacgatggatatttcaaaggtaacggatcaaattggtgcgcagactttgaacaactctaatgaaggattgttacgaatggccgaaaataataaggtgattccgggtgtagcgaaaaactatactgtttcaaaagacggtaaaacctggacgtttaatttgcgacattccaagtggagtgatggatctcctgttacggctaaggattttgtttattcatggcaacggacagtcaatccaaagacagccggtcaatatgcttacatatttgcaaacattaagaacgctactaaaattaattctggcaagatgtcaccgtcaaagctcggtgtcaaagcggatggcaactataaattagtggtcacgcttgaaaaaccgcaaagttactttaaatatttggctgcagacgttgagtttttcccacagaaggcctctgcagttaaaaaatacggatccaaatacggaacaaccagtaaagacatggcatataacggtccgtttaagatgaccggttggacaggaaccaatgatacttggcatttggttagaaacaagaactattggaatgccaagaaggttaaactcgatcaggtcaattttcaagtcattaaaacgcccgaaactttcctgaaccagtatcaggataataaggttcaggtgacgccgttggttggtcagcaggtcaaacagtataagactaataaaaactatgttttgagaagcaacgcggctacttggtatcttgaaatgaaccagcataaatacaagttctttagaaatattaacattagaaaggccttgtcgctaacaattgaccgaaaacaatttaccggtaaagttttggcagacgggtcaatgccggctaaagggtttgttgccgctgatatgtcaactcataacggacaggattatgcggatgcagcctatgaaaaggatgcagtagaatcaaacctggcacttgccaagaaatattgggcaaaagggctgaaacaaactggtaaaaagtcggtttcctttaacctgatggctgatgataccgatgccggtaagaagacaaccgaatatcttcaaagccgctttaccaaattgcccggtttgaagattacaaacgaaaacattccatataagacacgtttggcccgttcacaagacggtcaatttgatatggttgtcaccgagtgggttgcggactttccggatccgattactttcttacagttaatgcaatcgaataacgcttataacaatggtccatggcagaataaagaatatgacaagttaacgaccgatgctgaaggtcgggatgccaataagccaaatgctcgttggaatgatatggttaaggcgggcaagctgcttgctaatcaggaaggggtcatcccactgtatcaacaagctcagccacaacttgttaaatcaggcgttaaaggcattcaggcatttccaactgcaccattatgggattggagtaaggttacggttaaataattgagaataacgtttttttgattatcttttcttttagtgagtatgaatatagaaaaacggcagaggcatttttctgtcgttttttgtatgccaactggaataatgtaaatagtagtatcggacatatgtctgatttcttatgatgcaaccgcatcgctaataataaatgatcaattgattatctaaagattattgcttacaatttaaattacccgctgttatagttcgacgggcaattgatacatatttgggagtggggttttgaagcgagtaaagcaagtaatcagctttggtgggattgcagtgatgatcgggttggtactgactggttgcggtgagtcgaagtcaacaagtcgtcctaaaaacaagataacctggatgcaatcaagcgagttatcatcgatggacatttcaaaaatgacggatatgatttcggatacgaccctgaatggttctaatgaagggttattgcgaatggttaaagggaataaattaattcccggcgttgccaaaagttatcatgtctcaaaagatggtttgacatggacctttaacttgcggcgttctgagtggagtaatgggacaccggttacggcaaaggattttgtttattcctggcaacggacgattacaccgagaacagcgggagagtttgcctatacatttgaccatataaaaaatgccaaggcaattaatgccggcaaaatggcgccgtccaaattgggagcagttgccaagggaaatgatcagttgattgtccatctgactaaaccacagagttatttcaaatatctggtttcccaagcatatttctttccacaaagccaggcagctgtaaaaaaattcgggacaaaatatgggacaaccagtcaagatatgatttataacgggccatttaaactaacaggttggacgggaaccaatgacacgtggtcgttagtgaaaaataacaggtattggcacaaggatgccgtcaaacttgatcaggttaaattccaagttgaaaaggatccttcaaccgttatcaatcagtatcagagtaacaaactggatgttgcggtcttaagtggtcagcaggttcaacagtatcgacacagcaagcagctgcatattcgaaaaaacgcacagatgtggtttatggaaatgaatcagaaaaagcatccgttctttagaaaccgtaatattagaaaagccatctcgttaagcatcaaccggaaacagtttacaaagaaggttctccaagatggttcaacgccttcaaagggatttgttgcacttggacttggtaggcgtcatggtaaagaatttgcggatgaagcttatgtaaaagcggctgtgaccaacaatgcgaaaaaagccaagcagttatgggcaaaggggctaaaacagacgggtaagcagtcagtgacgtttactttgttggcggatgatacagattccggtaaacgaagcgctgaatacattcaaagtgaattgaccaaactacccggattcaaagttaatgttgaaaatctgccgtttaaaacacggctgactcgttcatccaacggtcaatttgatatggttctcagcagttggaccggggattatcccgatccaatgacgtctttatccaacatgacgtcgcatagttcgtataacaatgggaaatggacaaataggcagtatgaccgcttaattgcagaagctgaaggcgaggatgccaataaaccgcagcagcgttggcaggacatggtcaaggccgaaaaggtgctggcaaatgatgagggtatcgtaccgctctatcaagcagctgtgcctcaacttgtaaagcccggaattaaaggcattcagttctttccagaatcacccgaatgggattggagccaggtttataaaagcgaatgaggaatattaattgatgccttaaaggtgtcaatttttttatttaaaattcagaatgttccttgaaaatgaaattaaaatgtgatgagatgataaaaaatcaataatcgtttgcttgataagtgcttaaagaagctgatgtaatcgattataatgataactgttaccgtttgaaagataatgagcaaaaaagttaacaaacgcattgcttttaattaaattttaatctagtatagactcgtgtcaaaaattgataaatatttttgaagggaagctacatagtatgaagctaaaatcagttatgaagataggcggggttggattgctttctgctttagtccttgcaggatgtggcagcaagtcttctcaatcagcaaatagttctcaaaaggtaaaatggatgataccggcagcaatttcatcgatggatgcatccaaaataacggatttgtattcctcacaagtgttgaatgcaactaatgaaggccttttgaagatgggtgagaacaaaacaacacccggagttgctaaaagttattcggtttccaaagatggtaagacttggacctttaatcttcggaagtctaagtggaatgatggaaagcctgtcactgctaaagacttcgtgtttgcatggcggcggactgtaacgccaaaaacggcttccgagtatgcttacaattttgccaatattaaaaatgcttcaaagattaattcaggtaaaatgtcaccaaccaaattaggggttcaagctgatggcaactataaattagttgtccatttggtaaagcctcaaagctactttaaatatttggtatctcaaggctactatttcccagaagaacaggcagctgtaaaaaaatatggctctgcatatgggacaagtgctaagaagaatgcttacaacggaccattcttgttgaaaggatggaccggtacaaacgataccgcaaagcttgtgaagaataagagctattggaatgctaagaatgttaagctacaacagatgagtattcaaacggttaaggatcctgcgactgctctgaacagctatgaaagtgggaaacttgatttcacaactttgaatggtactcaagttaaacagtataagaataataaggactatcatgattatcttgaagcttcaacctcttatatggaaatgaatgaaaagaaagattcaatctttaaaaataagaacatccgtcgggcactatcacttgccattgacaagaatcaattagcaagtaaagttattgcggatggtacaaagggagccaagggatatgttccaacaaagatggcttctagaaatggtaaggattttgccagccaagcctacgttaaagcaggtgtggaatataatttgacggaagctaagaaactttgggccaagggtctaaagcaaacaggtaagaagtcggtttcactttcactgctctgtgatgatattgatcagacggttaaaaatgcacaattcgttcaaagcaatttggaaaagttaccaggattaaaaatcacaattcaaaatgtgccatttaagaatcgtttgagccgttctcaaaatggtcagtttgatcttgttctttctgcttggattgccgattatccagacccatcaaatttcttggatctcttcacatccactaattcatataataatggtaattggaagaattcagagtatgatgctttaatcaagaagtctgaaagcacggatgctaataatgaagcagcccgttggaatgacatggttcaagccgaaaagattctaatgaatgaccaaggaattgttccattaacacaagaagctcaatcaacgttgatgaagtctaaagttaaaggtgttcaattcttcccaacgtcaccacaatgggattggagtaaggtttcggttaaataatagtcaggtaataaactggacgctttcaggaaagtatttaaaggattggaaataggcaaaatgacatgcttggttccaatcctttttgtttactcttattatgttaagatgccctttattttactgggagtactctgtgaatgtcaggtagataaattaatctttgaagcgctttaattagtagagctgtcgtaaaaattcatttaaattcaaattttataacttttctttataaaatatttttgtgatttggaatttaaaaagctagacgtatcaacgctttttgttaaaataaacctcacaaggccatgtatggcagtgttatgaatctagattagttgatcaatgtattgcttttaataaagttttaatttaaaatatatgcattgccgagttagtaaaattatattgaagggaagtatttcacgatgaaaatcaattcaatcgcgaagcttggtggggtagtactgctatctgtattagtacttgcaggttgtggtagtaagtcatcacaatcaggctcaaagaagcaggagctacgatggcaggaatcttctaacctaccaactatggatctttcaaaggctacggatcaagtttcagctgaaactttaaacgcaactaatgagggattacttaagatgtcgacgaacgctaaggttacgccgggggttgccaagaattacacagtttcaaaggacggaaaaacttggacattcaatcttcgtcacagtaaatggagtgatggcacaccggttacagccaaagactttgtttattcatggcaacgaacgttaacacctaaaactgcttcacaatatgcgtacatatttgaccatattaagaatgcaactaaagttaacgctggaaaagcacccgtttcaagcttgggagttaaggccgacggggattacaaattagttgtaactttaaaccgacctcagagttactttaagtatttggtagccaatgcagaattcttcccacagaaagaatcggctgttaagaagtacggttctaagtatgggactcaatccaagtacatggtctataatggaccattcaagttaaccggttggagtggaactaacgattcttggacgatggttaagaataataactattggaacaaaaagaatatcaagttggacaaaatgaagattcaggcggttaaagatccagcaactagtttgaatcagtataataccaataaattagatgcaattaatttagttggttctcaacaagtttcacattataagaatgataaagattacaaatcatttttgaacgcctcaaccttctacttggaaatgaatcagaagaaggatccggttttgagaaacattaatattcgtaaagccatttccatgtccattaatcgaaagcagttgacaaacaagatttttgctgatggctctgttcccgctcgtggcctcgtggcagcaaaaatggcttatcgaaatggtaaagactatgccgatcaggctgaagttaagtcggctgattctcaaaacttagctgaagctaagaaactttgggctaaaggcttgaaggagacaggtaagaaatctgtttcacttaacttattatctgacgatacaccaaatggcaagaacacaactgaatttcttcaaagccagttgactaagttgcctggtttgaagattaccaatcagaacttaccgtttaagacgcgtttacaacgctcacaagacggtaacttcgatcttgttatttccgcttggatcgctgacttcccagatccaatttcgttcctttcattatttacttccgataactcatacaacaacgggaaatggaagaattcggaatatgatacgctgattaagaatgctgaaggcaaggacgctttaaatgccggtaagcgatgggatgacatggttcaggcacaaaaagtcttgatgaataatcaaggaattgtaccattatatcaacaaagcacagcgaaattgatcaactccaaagttaaaggtgttcaatttttcccaactgcacctgaatgggactggagtaaagtttcaattaaataacttgaatttgcgattcgggttaacagttcatctcaatggaggctggttatctactgtccagcctcttttatgttaaatagacgttattagtgattttcactaggataattagaaatgtgaggaaccttatatggcaaagtatttaggaaaaagaatattttatattattctgactttgtttattgtaacaacggtcaccttctttctgatgaagttcatgcccgggacgccgctgactaatcaagcaaagctgtctccgagccaaattcaccagatttacaagcagtatggccttgataaaccactgtggcaacagtatctaacttaccttgccggagccgttcatggtaactttggaacatcgtatcaatttagtgatcaacctgtttcctacttgatcagcagtcgactcgggccttcgttgacaatcggtggagaagcaatggttgttggtgtcttaatcggcattatcgtgggttcaattggcgctgttaagcaaaatacctggattgatacgaccgcaacgatcctatccattctgggtgtttcaattccttcatttgttttggcggttctgttgcagtactatctcggattgaaactcagacttttcccgattgccgattggggagggtttatgtatacggttctgccgacattggcactggccgcgtcgccctttgccgaaacggctcgatttatgcgaaccgaaatggtggacgtgttgagttcggattacattgagcttgcaaaggcaaaagggctaaataaaaccggaattatttatcaccatgccttacgaaacagtttaattccgattgtgacaattgttggtcctttggccgttaacattatgaccggatcaatggttgttgaaaatattttctcgattccgggaattggggaacaatttgttaaatcgattttgacaaatgattacccaaccattatgggattagccattgtttattgtgcaatgttgtgtgttgtgctgttgattaccgatattttgtatgggctgatcgatccacgtatcagaattaataagtaggagggacacttgaaatggcagataatgcaaaatcaattaaaaccggtgattttctgccactgtcagatgtagatcgtacacatcttgatagtgagaaaattgccgcgccatcattgactttcttacaggattcgtggcgccgtttaagacacagcaaagcagcaatgatctgtttggtcatcttggttattttattcatcttatcgtttggttcaggactgtttcaaacccataatccgaatgcaactaatccggatttggctaatttgcctcccaaaattcccggtattgatattaatgggtttaacgggacgattatgcaatccggcacacgaataaacgcttatgcacaagctcatgcgcatgcaggaacgtattatattttaggaaccgactatcttggtcgtgacctattttcacggatcctatttggaacccggatttcattaaccattgcgctggttgccagtttctttgatttggcgtttggtgtggtttatggcattatctcaggctggcttggtggctgggttgatacattaatgcaacggatcatcgaaatcattttatcaattccaaacttgattgttatggtccttttaattgttgttttaaaacccggtatgtcggcgattattattgccattgcgattaccagttgggttaacatggcccgactggtacgagcgcaaacactggaattaaagaatcaggaatttgtattggcggcaagaaccttgggtgaaagttcgttcaagattgcctttaaacatttgttgccaaacttggcaagtgtgattatcattaacttgatgttcacgattccaaccgcaatcttcttcgaggcgttcctatcttatatcggtattggtgtgagtgcaccacaagcatcacttggtacgttgattagtgatggccagaagaacttccaattcctaccatatcaaatgtggtatccggctatcgttttgtcgattattatgattgcatttaatatcttgggtgatgggcttcgtgatgcctttgatccaaagagtaataggaagtaggtgttttgagatggaaaacgaaaaaaatgttcttgaggtaagaaatctcaaaatcaacttcaaaacttatgctggtaaggttcaagcaattcggaatgttagttttgaccttcgcaaaggagaaaccttagcgattgttggagaatcaggttccggtaaatccgtcacgactcgtagtatcatgggcttaaatgcaccaaatgctgaaatcgccgacggaacgattatgtttaaaaatcaggatttgttgaagaaaacacggaaacaaatggatcagattcgtggccgtgatattgccgaaatcttccaagatcccatgacttctttggatccaacaatgaagattggaaagcagattgcggaaccattgatcattcataaagggatgaaacgggaaaaagcctacgctcaagcccttgaaatgatgaaattggttggtatcgagaatgccgagaagcggattaatgattatccgcatcaattttcaggcggaatgcgccaacggattgtgattgcgattgcactggttaattaccctgaaattctgattgctgatgagccgacaacggctttggatgtgacgattcaggctcagattcttgatttaatgaaagaattacaggcaaaaacaaatacctcaattatttttattacccatgatttgggggttgttgccggtatggctgatcgagttgctgttatgtatgctggtaaaattgtggaatatgggactgtggatgagatcttctataatcctaagcacccatatacttggggattgttgaattccatgcctaccatggatacatccggaacggaattgccctcaattccggggacaccgccagatttactgaacccaccaaagggtgatgcgtttgctgctagaaataagtatgctttaaagattgatacagagcaggagccgccattctttaaggtgtcagatacccactatgctgcaacatggctgttggatccacgggcaccgaaagtgacaccgcctgatcaaatcattgagcgtcaaaagcattttgccaaattgactcatgaggcgattgacactaaccgtggtaaacacgttgaagaacaggaggagcaactgtgatcgactattcgaaagcaaaaaaagtattacaagttgaacatttaaaacaatactttaacgttggtaaagccgatgaagttcgcgcggttgacgatattacatttgacgtgtaccaaggcgaaacgtttggcctggttggtgaatcgggttctggtaaaacaacaaccggtcgtgcgattattcatttgtatgaaccgacttccggaaaaatccttttcaagggtgaggatgtttccaaattacggtcaaaggcacaaaagaaaacgttcagacgtgatatgcagatgatttttcaggatccatatgcgtcacttaatccacgaatgaaagttaaagatatcgttgcagagggcatcgacattaaccatttggctaagaatgatgctgatagaacgaaacaggttgaagatttattggaaacggttgggttaaacagagaccattccagccgttatccccatgagttttcaggtggccagcgtcagcgtatcgggattgcccgggcattggcggttcagccggaatttatcattgccgatgaacctatctcggctttggatgtttctattcaggcacaggtcgttaacctgttaaagaaacttcaacgtgaacgggatttaacttatttgtttattgcccatgacctttcaatggttaagtatatcagtgatcgaatcggcgttatgcattacggtcggatgttggaaattgcatcttcggatgaaatttatgcgcatccattacatgactatacggccagtttattgtcggccgtaccggttcccgatcctgagtatgagcgtgcccgccaacaaattccttatgatccaagtaaagagtttgacggcaagccacgccaattggttgaaattgtgccaaatcattgggtacgggctagtgaagatgaaatcccgatgtatagagagcgtgcccgaaagcattctctgttgaaggattaagtcgttaatcgacataaaaaggaagtttggacaccatcgtccaaacttcctttttacttactaactgatcaacacgattccgggattaaagaatcgatgattgactaaacatttttgctgacattattaaaataatcaacggtatagttggtcccatcccaattgacctttgtgacgctgccgtttttagttgaaacgttaaccgggatatcgctgaagtggctaacaacgttacgaattagggttccatgggttgcaatcagaatgttatcgccatccttggcatttttaacggtctgatcaattgcgggttgaagccggttccagaacgcttgactggtttcggcatctttgtaagggtcagcagccgcaattgtgtcctcggccttatcgataccatattcggcaatcatgtcatgaaatgaattcaggccatggggcccgccaatgatatgccaagttttgacatcatcttcaccttcccaataaccgaagtttagttcacgaaagcctgcaagtggcgtagtggttttagtgtctgatgggttttgcgataggattaaacgaccagtttcaattgcgcgtggcagatcactactataggcagcgtcaaaatgaatggtgctaaggcgctggccggcatcaagtgcatcgttgatccccttttcagtaagggacgaatcaataacgccctggatacgatggtacttgtttaagtatgtttggccatggcgtacaaaatatagtgaaattgtcataagaaacctccatatacatttacttgaattacaataattgtagcatagttcattaggaatttggaagatagaccaatttttaaaatgagttaattttgctgagaaataatgacaggtattcttttttgatagtgttcgtaaatttgttgttttgatcatctttaacgcaactgtacaaaaatcagtcggattattggtctgaaccacatgcacgtactggactgaaagagtgaaacatgataaactattaagctaataattgtagggggttcaaaatggcagataatattaaaatacaagaacaacgccacctcaacagcgtcatcaaaaagatcaaaatttcagaaaccgatctcgaaaagaaaatcaagtccactaagaaagatgttaaggacatttacgctaatttcaataatgatgtccatctcaagacgtctacttatagtggcatgatggaaactgccatgtcgatccgacagcaacagcaaatgttgtctgagcgggagaaccggcaggaacacgctgcccgtgaattagggacattgaataaacttgagaaaaatccttattttgcgcggatcgactttcgtgaaggaaccgaagaccacgatgaaacaatttatatcggaatggcttcgtatacagacaagccggatcactatctgatttatgattggcgcgcgcccatttccagcatttattataatggtggtattggggatgtcacttatcagacgccggacggtgatcagaccgttgatgttaaattaaaacgtcaatttcaaattgaagattctaagataaaaaccgtttttgacactgaagaagttgtcggcgatcaaatgcttttggatgcactcggtagtcattccgataccaagatgaagagcattgtgacaacgatccaaaaggaacaaaaccagattatccgggataccagttccgaattgctattcgttcagggagcggcggggtctggtaaaacggccgccgttttacaacgggttgcctatctgctgtaccaatacagaggccatttaaattcgggccagattattttgttctcacccaaccagttgtttaatgattatattaatcaagtgttgcccgaacttggtgagcaaaatatggttcagatgactttttatcagtacagctcccatcgtttgccaagcgttaaggtcgaaacactttcacaacgattcgatgatcagcttgaggagaaaacccaacagcttaatgagtttaaaggcggcttggattattttaaagctgtcagtgcctatgccaatcacttgaatacggaagatatgcgttttcgtaatttgatgtttgatggtaaagtcctgattccaaaggaaaaaattcaggaaatctactacagctttaatgaaaactataatttacgaaaccgtttgtcagcaaccaaggatcagctcttaaagatcttaaatcgacgtgttcacgttgagatgaaaaagaagtgggttgaagaagccgttcaaaacctttcccgtgaagaaattatgcaaatgcataaggagggcgaagaagaaattttaaattctgacaaagaatttaattttctggcgcgtcgaatcgtcattaaagcttttagacgggttcaacggcaaattgttcgcagtcactttttgagtattaacaaccaatttgtccatatgctgagaaacgtcccgcagatactggatcttgaccaacatggaattgaacctgaagcctggaagcaggatattaatgcaacggttgggcgtcttaaggaaggccgtctgtcattggctgatgcgaccgcgtacatttatttgtatgatttgatgaccggtaaacgcggcgataaggatattcgctatctgtttattgacgaagttcaggattattccgcttttcagttggcatttctcaaattcagttttccacgtgccaaatttacgttgctgggtgatttgaatcaggcaatttttacccacgaaaatagtcgaaaactgttaggggagttatcaagtatgttcccagccgagaagacacgggtcgtccaattgaccaagtcttatcgttcaacggaacaaattacgaactttaccaaacatattttgacaaatggcgaagagattataccatttaatcggcagggagaattaccacagattcatgttgcccccgggatggatgctgctgtagaacaagtcaaaaatcaagcagaagaaaacctctccgaacatgagacaactgcgattatcgggaaaacacttaaagaatgtcagcagttggccactaaattggccgaagtcggtgtgaaatcgactttaattcgaacagagaatcaacggttggtcaaggggattattattgtgccgtcttatttagccaaggggcttgaatttgatagtgtcatcatgtgggatgcgtcaaaagcctgctaccctgatgaacgtgaccgtcaattggtttacacaatttgtacgcgtgcaatgcatcgtttgacgattgtggctaccaaagaattatcaccgatttttgaaaccgttcctgaagaggaatatcaatttatttgaaataacaaaggctgtgtcagtaaataacttgtcacagcttttgttttgagaagccgatctttagaatagaggcgcttttctaacggttagatgttataatttattggtattcttgacgggcggagataacaacttatggatgatttaatcaattattattcgtttaccaaagagcagtggaaacatttctataacgaaatcgacttgccgttaacgcagagtggtttgcggcatatcaaggcgttcaacgatcggatttcaattcaggatgtgtcggacatttttaaaccgttggttcatatgattcgattgcagaaagataattttgatcagtggcaaaccatcaaggcgcggtttttgcacaagcgggtgaggtcggtgccgtttattatcggtatttccggaagcgtagcggttggtaagtcaacgactgcacgggttttggaggaactgttgacaaactattttaccggtgaaaacattaaattgattacgaccgatggttttctttattccaatgccgaattaaaaaaacggggaatcttggatcggaaaggatttccggaaagttatgacatggcgaaactgattcggttcttgaatgccgtcaagtccggtgtccccgtgattcaatccccggtatactcacatcaaagttatgatattattcccaaccggtttgatatcattgaccggcccgatgtgttaattgtagaagggattaatacactacaactgccaagcaatgaacagatttatgttagtgattttaccgacttctcaatttatatggatgccgaggaatcattaattgaaaaatggtacttggagcgttttggcaggctgatggatacggcatttcaggatccgcataactattactacaaatatgcaatcggtgatcgtgatgaagcctttgagatggcaaaggatgtttggagaacgattgatttacccaacctgaaagcaaatattctcccgacccggtcaagagctgatatgattatgcacaagacagataatcatattattgatcgtttgtatttaagaaaatactgactttttgtttttttccaaacaatgttgaccaatcatagtaaaatcgtttattatttatgtagcaactttgaaagggtgtatgatttggcaaacgtggacttatcaagcttcgataagattttagtgctggatttcggtagtcaatacaaccaattgattactcgtagaattcgtgatttaggcgtatattccgaacttaagtcacataaattgtccgcaaatgagatcaagcaaatgaaccccaagggaattattttctctgggggtccaaatagtgtttatgaagagggcgctttacgggttgaccctgatgtattcaagttgggaattccaattttaggaatttgctatggaatgcagctaatggcctttaccctcgacggaaaggttgaaaaagccgataactcagaatatggtcatgctgatattgaagtgacttcaaacgacgcagtattgtttgaaaacacacctcgtaagcaaaccgtatggatgagtcacggtgatttggtaaccgatgttccttctggatttgaaaatgttgcaaccagtgaagattgcccaatttcagcaatgcaggatgttaaccgaaacttttacggaatccaattccacgccgaggtacgcaatacccagtttggtaacgaaattctgaagaactttgcctttaacgtttgtcatgcgaagtccaactggacaatgaacgactttatcgaccttcagattcagcatattcgtgaaactgttggcgataagaaggttcttcttggcctttcaggtggcgttgattcttccgttgtgggtgtccttttgcacaaagcaatcggctctcaattaacgagtatcttcgttgaccatggcctgttacgaaagaacgaagctcaacaagtaatggatagccttgttggtaaatttggccttaacattattaaagttgatgctcaggaacgtttcttatctaaattggaaggggtcacggatcccgaaaagaaacggaaaattatcggaaatgagtttatccaagtctttaatgacgaggcccgtaagctggatggtatcgacttcctggctcagggaacgttatacacagacgttgttgaaagtggaactgacactgcgcaaacaattaaatcccaccataacgttggtggtttgccaaaggacatgaagtttaagctgattgaacctttgaacaaattatttaaagatgaggcccgagaaatcggtgaaaagctgggaatgccggaatcattggtttggcgtcagccgttcccaggaccaggccttggcattcgtgtgctgggcgaggtgacacctgataaattgcggattgtccgtgatagtgacttcattttacgggatgaaattgctaaagccggtctgcaacgtaaggtatggcaatactttaccgttttacccggcttcaagagtgttggtgtcatgggtgatggtcgaacatacgactacaccgttgccatccgggctgtgaattcagttgacggtatgaccgctgactttgcccgtttgccatgggaaatcttacaaaagatttcgactagaattgtaaacgaagtcgatggggttaatcgtatcgtgtatgacgttacgagcaagccgccttcgacaattgagtgggaatagggaacacactttttggtgatgctctatgagctacatgagcgttaaacctcaattctcaacgttttgacgaattaaataacacgaaggcccgctatcgattaaatttgaggtgggcttttttaatatgttcatcaatacgtatatgcgtactgatgaatatacgtataagatgcattataataagtgtacgaggagataaaaaagtgccagcgacggcgagaaaaacggaatgcctaattttgaaacatggatgtaaattagttcgctaaagaggttctcaccgacaatatgaagatggagagggtcatcaagttaccattgttttccatttttggtgggttacaaagaagaactgaatagccgttctaaagcaagcaggtttgagatggtccgccactttggcatgttttactcgtactttaatcgatgaaagggaaaataaaagtgaaaaaaaataatattgtcatttatccggcgatctttggtcccgaaccagacggtagtgcgattaatgtgacctttccggatgttccggaagccattacttatggccgaacagaggaagaagctgtgtattccgccaatgaggctttagggctggctttggcaagtcgtaaagatctcccaaaaccgagtacaattcaaagtattaagcctgaagaaaagggtgattatatggtcatgattgctgttgatcttgaagatgctaaaagaaaaataaaaaagcctactgtaaaaaagaacacaactattcccgcggatctggacgaaaaagcaaaaaaagcggggatcaattttagtgaagtgttaactaatgcccttagagaaaagttgaatgaataaaacagtctgcgggtttatagaaaattgttttattcactcccattatcgattatggacgctatttttgtgttgtaattaaattgttagtaagtttatcgttaatttcgaggcttcctttcggctgtagatattgtatttaagttgtcgcaaaaatcttccaagggaaagcatcatcacaagcacaaaaaagaaacgatatagtattaacaatcggacggcaatgtcaatctgttggtgtattatagataaaaaggagtgtaattacaatgacaatatttgcgtttatcatttcgattatatctttaatgatcagtgtaatcacattaggtgtggtgttacgatgtggcaaaaattgatttaaatgatctggatattatgtcctcaaccgaagccgctaataattttttcaatagaagcttatatcatccagtgaaagcatttcaccgctatttggataaatgattccacaagcagacaacgtcttccccaaagtcgtataatagatgtaatctaacaaaccagggaggacaacatgactgaattaaaacgcttttatgagacattccaaccaacacattacaacatttacctggatattaatcgggaaaacaaaaagattaccggtaagacaactatctcggggaatgctaaagaatcaacaatttcaattcaccaaaaagatttagcggttgataccgttcaggcaaatgaccaggatgtatcatttacgatcgatagggacaatgatgccattcgcattgacttgccccaagctggagagacaacattgacagtgacttatacagcatctctcactgatagcatgatggggatttatccatcctattacgaagttgatggtgtaaagaaacaaattattggtacgcaatttgaaaccaacttcgcccgtcaggcatttccgtgtgttgatgagccggaagccaaagcaacctttgatttggctattaagttcgatgaacatgccggagaaaccattttaagcaacatgccggagaaaaaagttgaaaatggggttcattattttgacaccaccgttcggatgtcaacttatctcatcgcctttgctttcggtgagttacaaagcaagatgacgacgaccaaaagtggtgttaaagttggcgttttcgcaaccaaggcccacaaggccaatgaactcgactttgcacttgatattgccaaacgatcaattgaattttatgaggacttctatcaaacaccatatccgcttccacattcctggcaattggcattgcccgacttttcagccggtgcgatggaaaactgggggcttgtcacctatcgtgaagcttatttgcttctcgatccggataataccgcacttgatatgaaacaactcgtagcgacggttattgcccatgaattagctcatcaatggtttggtgatcttgtcacgatgaagtggtgggacgacttatggttgaatgaaagttttgccaacatgatggaatacgttgccattgatgccattgaaccggattggcacatttgggagactttccagacttccgatgttccggctgcattacaacgtgacgccacggatggtgttcaatccgtacacgttcaggttaataatccggcagaaattgacgcattatttgacgccgcaattgtttatgccaaaggagccagaatgctggttatggtgcgtgccctgcttggtgacgatgctttgcgtgccggcttaaagaaatactttgaggctcaccattacggtaacgccaccggcgctgatttgtgggctgcgttaggcgaagcatcaaacctcgatgttggcgcaatcatgaactcctggttggatcaaccgggttatccggttgtttcggcatcagtgattgacgggaacttaacgctgtcacaacaacaatttttcataggggaaggcaaagaagccggtcgtcagtggcggattccgcttaacggtaattacgatgttgctcctgaaattatggatcaacagcaggtcaaccttggcaactacaatgacctgcgtaaggctaacggcaaaccgttccgtttgaacgtcggcaacaactcacactttattgtaaaatacgacaagacattgttagacgacattttggctgatgccacctccttggatgccatttctcaattacaacttttacaggatctgcgctatctggctgaaggtcatcaactatcgtacgcggctcttgtgccattattatctaaatttgcggacagtcacgccaccattgtgaatgctggtttgtatcgaattgccaatgatttgaaaaaatttgtattggcagaatccaaagagaagaagcagttgcaggcgctctttgatcaattaagtagtaagcaggttgcacgtttgggatggacaggcaaagccggtgaatcaaatgatgaccaattaacacgaccaattgtcttaaatgccgctttgtatgccgaaaacgaaaaggcgattgcttcggctcatgagttgtttagtgccaacagcgacaaacttgaaacattatcagccgctattcgggtctttgttttgagaaacgaagtaaagaactttggtagtgaggcgctctttaaaaagttattaacggcttatcggcaaacttccgatgccagttataaatcggatatctgctctgctttaaccagcacgactgatccggcattgattatgaaattagtcgaatcctttgaggacgccaacacgattaagcctcaagatttgcgggcttggttccgtggcgttttggcaaatgaagacggtcagcaagctgcttgggactggattcgaaacgattggcaatggctggaagataccgttggcggtgatatggaattttcaacctacattactgtgatcgcaagtatctttaagacgccaacacgtttagcagagttcaaggcgttctttgaacccaagattcaaacgccaggattgactcgagaaatccaaatggatatcaaagtgattgaaacccgcgttaaattaattaaggatgaaagacaagctgtgaatgatgcggtgagtgaggctgttaaataaattttccttgaaagctacctcaattaaatccatatcaacaaagttaaaaatcccttcatagtgaagtgaggggattttttgcgtgcttatgacatttttaattaatcgtgcatggtgcttttaaccagttaagcagggtagtttaatttaatcatttctcaacaatttcttcgccttttcttaaccttacttacattctcttaaccttgactaacctggattaccgaaattaaggtttatgtggtaaaatctagaaatggttttagtaatcaatatcataaggtgttgattgtcttgttttaagcatgaaaagggagttcaaattgattctagatctgataattatcgttttattgattggtggcctgatcagtggttatcgggccgggttcatcaatcagtcagttcggattgtatcgttgattctatcgtttatggtggcgatttactattttcagccaaccgctaatatcatgattaatatcgctaaaaaaattggctttgcgcccggtatccaatggctttacgtgtcggacattgttgctttcgtccttctgtttgcactgacacatgctgtttacatcatgttgggcagccacttgaacgggattgcgaaagttcccggcttccatttgggaaattcattgctgggttctgttatcggtggcataacacagtatttaatcattttctttgttttaaatatcctgattgtctttccgatttcatgggttcaagaccagtatcaagaatcacaaatttctcaaacaatcgttaagaaaacaccgattttatccaagcgtgaatccaggacccaaacgattaagcagggtgcattatcctcgtcaattgtgtttttaaacaagcagggagggtcttcaaatgaagtggattaatcgattagtggcagtcgtggtcgtcctcctgacactgaacatttttattcaaccggattccgtgaagtccattggtaaacgggtcaataacgcagttgatttaccggcaatgttaaagactgaaattgataaaacggcgacccacgttaaaaatgctgggacggcacaaactaattcaggtgaaacgccgattgaaagtattgttcaggggcgtaagttatccaacaagtattattaccactttgcgtcaggcgttcctgagcaggcaaagaaggtcttcttgcaggcagttgataagtacaatgagaccggtatcgtgaaattaatgccgctaagcggtcagacaaaatctcaatcaaatgagatcacgttttacgtttatcataaacgggttgaaaccggatccggtgctgttgaacttggccttggtggtccgaaaatctatccttgggttggcagtcacaactatgacttgaatcgtggaaaagccggtttgaacgctgagtatccgcagtccagtatgcagctttcagtgacaatgcatgaaatcggtcacgtcttgggacttgatcacagcatgaagcgcagttcgattatgttcccggttgatcagggcagaaccagtttttctaaagaagatttagcaacgcttagaaaaatttatcaataattaaaacgatcataaaaaaaggctaaggaatggttgctggcgacagcttgttccttggcccattttgtgttttcagtgaacgtgttatcgctttttaaatcggcgatcaactatatatagtcgacgattcttttttaagtaaagtagccctgcaagaattgttgtgagtatttccgtaattgggaaggtgtaccaaaagtaggccaatccccagaattgaagtagccaggcaatgggaaccagcaaaaacaattctctggtcaggctcacccagatacttttttgaagttgatttgttgcctgaaaataaataaccaacatcatcgagatgccggcagggataaaactgctgccgatcactcgaaaagcgtgaacgccaatttgacgtaattcaaaatctgatgaatagatgccaagtaattgtcggggaaagcagatgaaagcgagtgcaccaattatcgtgacggaacaagcaatcagtaaagccagtcgaaccgtttctttgattctaatcaattgcttggcaccaaagctaaaactgatgatggataagataacctgctgaaggccttcaagcgggataaagaaaaaagcttgaagcttgtaataaattcccagaacattgatggctaacccggtaaactgtttcaaaatcaaattcaagccgacaatatagactgtataaagggattgaagcaggattgaagcactaccctgatggtaaatagcgacgcacactttgcggctgatttgtccgttcaaagcataataatgatgaagttgacttatcacaatcaatagtgctgccagttggccggtaattgttgccagcgccgatccagcaatgccaagctttgggaatcccaagcggccgaaaatcagtaacggattcagtaggatgttaatgagattgccacaaatttgagcgatcatcggccacctcatttggccctttgcctgcaacattttggtgacgactgcctcgataaagagactgacagatccaattaaaataataaacgcgtaagttctacccagactttgaaccgtggtgctggaactggataattgataataaggcttgattaataacaagccaatgcaagcaaaagcaaaatagtttaaaaacccaagaaacaaaccacttttaacaacggtttcctgccggtggaccgcctgactgccatccaagtgggcgattagaatattaatgccggtaccggttcctgtggcaatggcgatcatgagcagttgcacggggtagatgattgaaagtgcggtgagagcctcaagcgcatactttgtgacaaaataactgtccacgacgttataaattgattgggcaaatagggaaatcatgacgggcggcgccattttcaacattaaatttggaatgggcgttcctcttaaattagcgatgatcgtcacctacctcaataatcttcttatcatcgatcatagcactggcggaaaaggctgagatacaaaaggcactcgaaacaacaatttcgagtgccttttgtagataagagaatgccgtctattgatgatcccgacgatagatttccattttcttttgaaacgttgattcggtaacgccgtatgccgtgaaagtaatggcgtttgcgccggcatcaatcgtttcttgaatctgctcgcttgttttgccgcctgatgcaatgatcggaaaatgcggattaatatcggcaacttcccgacgaagccaacgcaccagttttgcggtattcttaccgccggcaacgttaaaagcgtctacaccggcatcaattcgctccttaacgttaatcgaatcattaacaaccgtataaatgattggaatatcaacaacgtgctcaacactaagaattgtttcggttttggcaggtgcatttaagacaaccgcctgggcaccgttttcttcagcaaaactgccaatggttgccgaacgcaggccctttgtcagaccaccgccaatcccggctaaaatcggtacgtttgaaacagtagaaatggcacttagaatctttgtgttgggcgtccagggataaacagccaataccgcgtctgcattactattcgcaataacggcaacatccattgtatagataatacttttaattcgcttaccaaataatcggataccggacgcatttttgatgacatccgggctcttaacgatgtcctgtcggagttccgaagaaatatccgggacaaattttttgttaacactagcgtttgaatccatgatctaatcccccttataaaattagtcttcaaccattattatagggatattggccgtcttttaaaagaagcgggattataatttttacttttttaagcgggcctgcaactgcaaatcgtagtttctgactaccggaatgatccatgcagcaattccagccgcgacagcgctgatgcctgcaatgacaaatagcatctcaaccccgatggcatcggccaagggaccggcgaagatcagtcccaaaggaccggtcaagcttaaaagggagttcaaaacacccagtacccgccccaattgctgtggtgggtaactttgttgaatcatggccattagcagggtattgaagtacggtgttgcaaggccggccagtgcatttaaaacgacaaaccagagaaagccatattggtttcccggcaaaagaccgctgaaaccggtagtgattccgataatgaagaaagcggcgataacgggtatcatccggtttttccaatttccgaaaatgccaatgattgtaccgccaaccaacatgccggccgagtaaatagcttcgattaatcctgcctgtccgacggtaccctggaagtaggacatggtcattaacgggtacatgcttgcacacggcatataaaaaagtgtgaatgccgccccaataagggtgatgtaccacagtcccttgttcttgacgagttgggaaaccccaagtttggtgctatgaagaacgtgcagcgcatcatcgattttttcatttgaaggtattttgacaaagagtaaaatgccaattcctatagcggctcccaaaacgtctaacaaaatcaggaatttcattgggataattgcaaaaagcattgcccccagcgcaggtgcgatgatcatgtttgcggactgaaccatccctaactgaccattaacccgggtgatttccttttcgggcaccatggttggaataacagcctgaatggttggcatctgaaaagtttgggcaattgagcgcatcaataatgagatgaaaatcagccaaagcgggaacgcattgaaaaacgttcctgaaattgacagaataatggcgaaaagagcagcaacaatatcaggcacaatgagaagtccctttttattccaacgatcaatcagcggtccaacaaaagggctcagcagaaccattggcagcattcccagaatagttgcaaaactcaggacagttgctgaaccggtttccttggttaaataccaaatgatggcatattgaacaatcatacttgtaatgccggttaaaaattggctggtcaggaataagtagatattcggccgccaatgtgtgatagatgaatccataatttcccccgttttctacaatcaaaaatcgtcatcattattgtaccttacttaacctgaataattcgagttaaaagaaccgtataggctgactttcatcgaggattgtgatacgctttttgaagtagaaaaaagaagacgctttgtaaggagaaaaaacatgactttacctcaattagacttggcgaatgcccagggccccaaagcaactatcaagacgaaccatggcgacattaagattcaattgtttccggagcaggctccaaagacggttgaaaattttgttacattagctgaaaaaggctactacgatggtgtgacttttcaccgtgtcattcctgattttatgattcagggtggcgatccgacaggcactggtgccggtggtgacagtagttttggcgggtcctttgaagatgaattttcaccggagttattcaatattaacggtgcgctttcaatggcaaatgccggtcccaatacgaacggcagccaattttttattgtcaccaacgagcacgttgacgatgggatgatcggtcaaatgaagcaggccggctatccggatgaaattatcgacacgtataaaaatggcggtacgccatggcttgacttccgtcataccgtttttgggcaagtcattgatggcatgaatgttgtcaaagaaatcagcggtgttaaacgaagtgcttctgataaacctgaagacgacgttgtgatgacgaccgtcgagattacaaaataatcatttgattaatgaggaagcgtgtgacaaaaaggcggttagtttccagtgcaattggattggactacctgaacatgctccggctgagatagtaggataattcagttgtacggcaggaggttgccttttttctaccgcttttgctcggtaataatggtaatgaaactagaaggagctggacaaaatgacttttgtccagctcctttttatgttaaagtcggtgattcactttgattttagaagttgtttatttgttataaaataaaagcaaataacatttgggacggtgaaatcatgataaaatttgatgaaacatttcgtaaggaagttaatcaagtggcaccttacattcagggcgagacagaagatgaggtccgccgccgttatcatttggataaagtggttaagttgggatccaatgagaatccgtacgggccatattatcatgcccgtcaggcaatccggcgcagtgtggaagaaatcaaccggtatccggaagatgattttatcgagaccaaacgggtcattgccgatcaatttgatttaaaaccggataatgttggtcttggcagtggtgccggaaacattattgaaaccatttccaagatgtttttaaacgctggtgatgaagtcttgattgcacagcagtcgtaccggttgtatcgagaagtttccaagctgatgggagccaaggtcattgaaattccgctaaccgacgacttccagtatgatctggctgcctttaaagctcagataactgagaaaaccaagttgatctggatttgcaaccccaataatccgacttcggcagtcacggacccgtccctgttggaatcctttattgcaggcttgcctgaacatgtttgggtcgttgttgatgaagcttatgccgagttttcaaatcccgaccaattgccgaatttacgtcaatttattgggcgtaaacgtgtgattgttttaagaacgttttctaaattttatgggttggccggcattcggttagggtatcttttggccgaccagcaggcaattgctgcttatgatacggttacggagccctttaactccagtcgggccgcacttgccgccgccattgcgtcgttaaagtatgatcagggacaggcaaaaaaggtactgaaacggattcagggtgatcgtgaagggctaacggaatcattggaactcctcggacttgaggtcgccaaatcagaagcaaactttgtttttgcaaatctgccggaaggcgccccgagtgcatcgaaaatgagtcagcagctgatggcgcaaggcgtcattattagggatggcacgccctgggggtatcctcagcatatccgaattacaatcggcaggcacgatgaactggaatttttcctgcaaaagttaaccactatcttatctgaataaatgacaaaagttgaaacgtcaacacccccacaatacaacctgtcttaatgcaaggcaataagtgagtgggatgatgatgtttcaactttttaaaaggtgtccgttaagagttcaaccggacaatggtcggatccaaaaatgtctgttaggatttttgaatctgaaatgtgatcggcaagccgtttgctggtgacaaaataatcaatccgccagcccgcgtttctatcacgtgaatggaatcgataactccaccaagaatagatatcttctttgtccggatagaaatgacggaaagtatccatgaatccctgatccaacaacttggtgaatgattgacgctcttcatctgtaaaaccagcgttatggtgattggatttggggttcttaagatcgatttcatgatgggcgacatttaagtccccacaaaggatgacgggtttgtgactgtctaattggttcaaataggcatgaaaagccttatcccaacccattcgaaagtctaaacgttttaatttagcaccggaattcgggacgtaactggtaactaagtaaaagttgggatattccagtgtgatggctcggccctcatggtcaaattccggagcctgaataccataactaacggttaacggttcatctttggcaaagatggctgttcccgaatagcccttacgttcagcgtagttaaaatattgtcggtatcccggtaaatccagtttgagctgaccttcctgcatcttggtttcctgaatacagaaaaaatcggcgtccaatttttggaaagtttcggcgaagtcctttttaacaactgcgcgcaacccattgacgttccatgaaataaatttcatttacaatgaccatcctttgactatgattttataactgattaacttaattctactataataacttggcttgtggttcaactcagaaaagaattaaaggcgatgtttggtatttgacgagaagagtgtaatggaaaagacccgattaacaactgataattttgtcagctgttaaccgggtctttctggatggtgtcgaatagggacaccttatttttggatagaacgaatcaacttctgcatagcctgagcttggaattcagctgttgcctgcttttgaagctcggcctgttgtactttggacatctttggatttttcttcatcgctgccataatctgtttggtaacgaaagcttttccttgtgcctttagctgtgcctgatacgttttattttttagctttttttgaagcactttggcttgatcggtagaaaggaccagccagtctttattaacgtagattttattgtgacgtttaatcaacttgccattttctccggcaataccgaaccagagttttgaggcaccgtctttatatctccaacgagttgtttgggtttcgattcgtggattaccgctttctttaatgacttgattagtcgtgtcattaacggtagtatgcgatttcttctttgcgttttcagatgtttgataaatgtaaacctgatgcttattggctgtaccgattggttgatagagcagcatcttcatttgttttgaagggctgacagaatgaagcggctgatacgtggtctttgtttcttgtttcatcccaaaatgatctttatcgtttttaacaatataaaccgttgagacgatcattccgatgacggaaagaatggttaaaatccaactgagcggtttattctgaatgtaaacaaagcacagaaacgagagaacggcacaaataattaaggttactaaaatcattacttgtcacccccgtttttagtcgtgtaatcagcggatgaagcacggttcttcaagaagaacgatgttacaagagccattaaacagaagacgacagcaacgacgaatgcggcgtgataaccacccaaagttgcattgaagaagtcgtctttatattgaagtggattagtcgttaataaatgatgtgccggcttgtcgctgttggtaacatttgtcaaaatactgattaagatcgcggttccgacagaacttgcgacttgacgctgtgtgttattgacagcagttccgtgacttaataagttcattggtaatgcgttcattccaacagtagttgaaggcatcatggccattgaaattccaaacattcgaatggcgtagaagaccacgatataaatagtcggtgtgtctttggtaatgaagataaagggaatggatcccagtgtcagtagtaccataccaataatggataaatttcgggcaccatagcggtcaacggcacgaccggtaattggactcataatacccatcattagtgcgccggctaataatgttagtccggattcaaaggcggacatgcctttaacgatttgcaaataaagaggaatcaccatttcaacaccaaccatggccatcattgtaattgagctcaggatggctgaaaccaagaaaggcgttgaacgataaactcggaattccaaaaatggtttgtccatcgtcaattggcgccaaacaaagaccgcaatgaagacaaggccaatgattagggttgaaatgactttagtactgccccaaccatcgtcaccaactgatgagaagccgtagagtaaactaccgaacccaatggttgatgtcacaactgaaatcaggtcgataccagtctttttagttggtaagacgttcctaatgaaccagaaactgccgatgataacgatcagcaataatggcaaaatcatgccgaataaatctcgccatgtggcgttatcaatgacccaccctgaaagtgttggaccaatggcaggtgccaagccgataacgattccggcaaggcccatggctgttccacgtttgtcaggcgggaagattgataacataattgtttgaagcagcggcattgtcacaccaacaccgagtgcttgaattaaacgtccgattaaaagaaaactgaaattgggcgccgtgtaacaaacgacagttccaataaagaagaccaccattgcagtaatatacagtggctttgaattgaaacgggtacttaaccaggcactgattgggatcatgatcccgttaaccagcaagaatccggttgtcaaccattgaacggttgaagttgaaacatcaaatgctttcatgatagtgggaaaggcagttgaaaggattgtctgatttaagattgtacagaaagttccgatcaacaagaaaacaatcattaaaccgcgattgtagcttttcccgttgttatctaccgatttagccaagatctattaccttcttttctctaaaaattgttgccatctgaaaaacgatacttgactaatataagattattcatttcaattgtcaactatcttgacaaagttatttaaaaatatatactaaatgttaagaaatgtgattacgatattaaattgtctcataacaaaaatgttgataaatcagcattggaaaccattacaaaaatttgtgaaacgaggaatagaagtggataaagaatttcaacaaaaattagctaaaatccttgaaaagaatgattggcatttgggcattggcgatgtggaaaatgcgacaggggtttcacaaaccaagttacgttattgggagcgaaagggctacattaaaagtgcgcagggaaaaggtcaaaatcgaaagtttacttacggcactttaatgaaagtctaccagatgaagatgtatcttgatcaggggtatacgttagcaatggctgccgaaaaagcagaatcaaaaagtcgcattatgaaaacattgaagcgcgctgtctttgaccgatatgaagggatggagacaatcgaaggatggccggcaattaatttgggatcattagttggcgaccctgaccatgttgtttatgctattgttaaagaagacaatactgatcttgaattattgcctaaaagtaaaattgaataagtatcatgatgattaagaagcttagatataggggtggattgggaaatgacagataaaacagatgttttagtcgtatatttttcgatgacgggaaatacgaaacgggctgccgaagaaatcgcattgaaagttaagggcgacattgtcaggctgacgccgaaagtaccgtatccggatgattattctaaattaagtgaagtggccaagcagcaactggatcaacaccaactaccagagttggctaatgatcatattgatttgtcaccgtataatgtggtgttcattggttatcctgcttggtgggcacagccatcaatgctgctgcataccttttttaagcaggaacattttgatggtcaggaagtcattccgtttatgacaagtgtttcctccaaagttgaagaaagtttgccggttgtagagaaattgcttcagggagatgtggaattgttggatgggatcactgcaaatagtaatgatcagattgattcattcttaaaagaagagggattgatcaggtagcagcgcttgttttgaaagtttttttcaaaatttttgaaacttatacttgatttttactagggtagaagcgttacactgttattatatttatttttagaaaattgttggaggggtctaattgctagaaaaaactgtatataaagaattgctgagtcacgcctttgatatccccgtttccgttacatattggaatggtaagactgagaattacggtggtgacaatccgcaagtcaagattgaaatcaaaaaagaaattccgttaaaagaaatgacttcccaaccgactttggttttaggtgaagcttacatgaacggtgatattgacattactggtagtattgaagagttggtagcatctgcctatcgcaaaggcggcagttttttaacaaacaacccctttctaaagcatctgccaaagatatcccattctgaaaaggaaagtaagaaggatgtccaaagccattatgatattggaaatgacttttatcgcttgtggttggataaaacaatgacttattcatgtgcctactttgagcatgatgatgatacattggaacaggcgcaattaaacaaagttcgccatattcttcataaactcaatccggtttccggtaaacgcctattggatattggcagtggttggggaacgttgatttttatggccgccgaagaatttggactgcatgcaaccggtattacgttaagtaaggaacagtatgattatacccagcagcaaattaaggaacggggcctggaggataaggtcaacgtcttattaactgactatcgtgaagttaaggaccaatttgactatgtgacatctgtaggcatgtttgaacacgttggaaaagaaaacctcggtttatatttccaagacgttgaaaaattcctggtacctgatggtcgggcattgattcatggtattaccggacaacatgagggtgctggtgttgatccattcctgaacaagtacattttccccggtggttatattccaaacgttgctgagaacctgacacatattatgaatgccggccttcagttaaccgatttggagccattgcgtcgccattatcaaaagacgcttgaaatttggtatgataactatgtcaaggtcatcgatcaggccgaagcaaagtatggaaaaccgtttaccagaatgtggtcactgtatcttcaaggggctgcagcttcgtttgaagccggtaatattgacgtgatgcaatatctcttgactaaagcgccaagcggtacaggtttaccaatgacacggcagtacgtttataagacggaagattaatcaaaaattgatctggattaatgcttaaaggcaacacataacaaatggctgtgatatttctttgcggaaatattacagtcatttttgtgatttaatcatgttagaagaggtgacaaacgttaaagcagctttgactttacaacgtcaatgaggtattcttttagtgtaatttaatcaaattataactttaccggttttaattgcgttcaatcaattcgggcaaattacatataggtggtggattttttgaagaagattttagcgtacaatattttggattacgaaagagaatttgttgttgagtgggcagcagaacatcccgatgttcaagttgactttaattcaattgagttacatgatgatacggtacatctggcagaaggctacgacggtattgattatcgacaacgcagtcaattaactgacggttctgacctatacaaaaaattacatgattacggtattcatcaattggccttaagatcggccggagtggattcatgtaacttgaaatatgctaaagaaaatggattgactgtcaccaatgtaccgtcatactcaccacgggcggttgctgaaatgacgttaacccacgcaatgaatttgattcgacatattccacaattccaaaaacgaatccggcaaaacgattatgttgttaatggcttacgatcaaaagagatttccaatctaactgttgggattatcggtgttggccgaatcggcagtactgtcgctaaaatcttcaaggcacttggtgctaaacgggttttagggaatgacattaaggaaaacgatgattttcgaggcattgttgactatacaaccaaggaagatatttacaaaaatgcggatttaattaccatgcatacgtatatgagtgatcaaaattatcatatgatcggcaaggatcagtttggaaaaatgaagaatactgctttattcatcaattgctcccgtggcccgattgttgatacagatgcgttggttaacgcactggaaaccggtcagattgccggtgccggaattgatgtgattcaagatgaaacaaagatctttaaccaatcgtttgttggggaagataaaattccacttcccgtttatacaaagctgatgaatatggataacgtctttctaacaccgcatgtggccttttacactgaccacgcggttaaaaacatggtcaaacaatcattggatgacacattgatggaaatttccggtaaggaaagtccccatcgaattaacgtttaaattgacaaatcaaggaatccgttcagtcaacgattttttcgctgactgaacggattccttttttaaataaacaattcagttttaggcgaaccttatttttttaggtggccggaagtgccgtttaatggttgatctgaaaatacccagtcattatttggaagatggtgtcctgattctgtaatccgggtgacttttgaagccggtaatcgagattcaaaacttaaccgactagtttgactattgttatcattactgatgtccctttgcagtttatgacgcagcgcgtgaacgttgaagtcgttgttaacgatgtaatgtttataatatttttcgccatgactgacaattacagttccttttggcaacacaatagctcttttaacaactgatgtattttgtttatcgtaaaatttcaaattgactttgaattcttttttgactctgtaaaacttatttctgaaagtaccttcatatttgctgatagagctggtcttaacgttcttaggctgtgaactggcgcttgccatgaatgtgtaattggccagtccaatcaatgaaccaaatattaacgaagttagaagtagtttcttcatcgcagtttcctttcgctcaatgtgtctaatgatgtagagctgatcgttagagaccaaagtggtcaacccctataatcaactttatcgtgtaaaagccattttgtaaactgtttattcggaatgaccaatccgggtcagataatctccaaagggttcttctgtatgactggcaccggtttcttttttctcataccaagagattttgtcattaaggatttgaaggtgatgttgcacttgacggtacttttccataaagtcgtttcgggtttcctttagtaaggcaagccgattggggatggtggcgtcaccctgggcccgccatttaacatacaatttcaattcctggatactcatgccggttccttttaggtgcagaagaaatttaacccagctcacatctgtttcggtaaaataacgtcgatctgcgtgatcacggtgaggattcaacaatttttcacgttcataatatctgatggtcggggcgcttagaccaactatggtggcaaattgaccaatagaataagtgactttcttttcgatttcctgcatcaattttcctcatttcttaaataattgattgacttaaagtccactttaagttgtaaggtattgtttgtaaagcataagcgtcaaaatgctttggtgtaaagttaaggtttgaatccctaaaaaatgaggaatagtgaacacgctggatttcaggaggcttataacatgtcagttaaaaataaagtggttgtgatcaccggtgcatcgtccggtattggtgaggcaagtgcaaaattacttgctaaaaatggtgctaaagttgtcttgggggcaagaagagaggaacaattaaaagcaattgtggccgatattaagggagacgggaatcaggcagtatacaaagtaactgatgtaacaaatcccgaggatgttaaacagttagtagcattggctaaaacacagtttggcggtattgatgtcatttttaataatgctgggattatgccgagctcacctattagtgcgttacacacagaagaatgggatgcaatgattgatattaacttaaaaggggttttgaatggtgttgctgcggttatgcccgattttacaagccaaaagcatggacaaattatcacaacttcttccgttgccggtttaaagagttttccgggtgcaggtgtgtatggtgcaacaaaatttgctgttcgaaacttgatggaagttattcgaatggagagtgcccaagagaagactaatattcgaacggttacactttatccgggtgcgattaacacggaacttttgaatacaattagtgatacggctactcgttctggaatggatgacttgtataatgccgttgggattggtcctgatgcggttgcacgagtagttaactttgcggtggatcaacccgaaaatgttaatgtcagtgaatttactatttatccaacaaaacaaggataatcaattggttgttaaaatacttgaaaaatgatgatgtgaaatgaaaggaagctgaatgatggctaaaaatgaatctatcaaaaatggtgtgatttttcctgctggtcctaaaaatgaggcttttgccaaatattttgtagggcaaagctatttacaaggactggttaatgatccggatgtcaatgttaacgttagtaacgtaacctttgaaccgggatgtcggaacaattggcacattcatcatgacggttttcaaattctactggttaccggtggtgaaggttggtatcaggaagaaggcaagccggctcagcacttggtaccgggagacgttgtggttactcatgatggcgtcaagcattggcacggggcgacaaaggatagttggtttgaacatattgcgattaccgccgggacgcctgaatggttggagccggtttcggataaagattatcgtaaattggagggatagttataatggtaaaaaaacagacagcaggacgtgatcatttgggtgattttgcacccaagttcgctgaattaaacgatgatgttttatttgggcaggtttgggctcgggaaaaggaactttcttcccgcgatcgaagcatgatcacctgtgccagtttgatgtctcaaggtctttttcctcagttggaagatcatatgaagatggccaagaaaaatggggtaacaaaggaagaaatggttgaactcattactcacctggcattttatgcggggtggccaaaggcttggtcggcgtttggactggctaagaaaatttataccgattagttaagcagggtgattgtaatcaatattaatttagaatcgttattgtatactcctgaaaaatagtttagaatgaatatagattaaaaatatttggagggatttgaatgaactttatcggtaaagaaattgaagattttaaggtaaacgcttatcaagatggcgacgtcaagcaagtgaccaaaagtgatttattgggacattggtcgattgtctttttctacccagctgatttttcgtttgtctgcccgactgaattaggagatttggctgataactatgatgagtttaaaaacgccggtgcggaaatttattctgtgtcggaagatactgaattcgttcatcaagcatggcatgaaaagagcgaagaagttggaaaggttaagtatccaatgatcgcggatcctgcaggaaaacttgcccgtttcttcgaagtgctggacgaagatgccggtcaggcttatcgaggtgttttcatcattgatccgaaaggtaaagttcgttcatataccattaatgatatgggtatcggtcgcaatgccaaagaagtattgcggacgttggaagctgctcaatttgtggcagaacacggtgatcgcgtctgcccagctaactggaagccaggtcaaaagacactgaagcctggcacccaactagttggtaagatttaagcttattttcaatcttttaactgtttttaaaaaggccatgttaattccgatggatagtaaatcggaaataacatggcctttttggatataccacatgatacaataagccataatacttttataggaggcaggaaatgaaacaacataaaaggattgatattgttggacatgtcaagctgcaggtattattaaatctaatggcaattcctctttttttcggtttttggtttttgatggtgttattaactgggattaatgctttttcaatggatttatggcaactatggtctatctttattcttttaattgtttttatggttgttcatgagttgatccatggcttgttttttaaattatttcatccaagagatcatgttaaatatggttatactaaagggatgctctatgcgacaaacccggggaaattgtataagcggtggcaatttatgattatcggtataatgcctctgattttaattacactggccttgtggggactcttttggattggggtcatacatgcgtcagtgttcattttggtagccgcattccatgctgcaggttgtgttggggatttatattttgaaatcattttaatgttttcacccataggtgcaatggttgaagatacggctacggggatgacgatctatgttaagcaatgagcagactggaggcatactttggcggtgttattaatttttcttggctttctggtaggcgcttttattatcagtatgggtggcggcggtgggtccttttatctgggaattctaattggaattgcccatttatcgccatccagtgcggctgcaacgtcgctatttactgcgctgccagcgttagttgttgggacatatagccattatcgaaccggcaatatgaaattcagttatggcaacaaactgttaataacggcattgccagcgaccgttatcggcagtttagtatcaggtgtaatccccgtcacactttatacttgggcaattgcaatcattttgtttgttttaggtgttcagacactccgaaagtcttttaaggggaagccatcatccaacctaaaaccatggaccgtttatttatttggggcattaagcggtctgatggttggtatagcaggattaagcggtggtggtccggtcatggcagggctgttactattgggactcaacatgcctcaagcagctgcaacctcatcgtacgccttgattgctttatcgattgtcggattgatctttcactcgacgcagggcaacattgcttggcaggtgggcctgctacttatggttggctcactggcaggagcagccattatgccaaggattctagcacattttgatccccgtaaagttacaaaaatccttcagccggtgatgggaattttgttggtattgatggcgattaaatttgtcatttgatgaaatgaattaaattagatggtaatggtacagcccctctaaaacaccatggtcactatcagcgatgtaagtggcacgctgtttgagctgatcacttgattgcttcatggaaatgccgtaatcagcaagcgaaaacatactcaggtcgttgttttgatcaccgaatgcatagatctttagattgggattaccaataagctgttggattttggaaatgccttttgcttttgaaatttccaacggcatgacgtcaactgcatcgggagcgtaacgaagaatgcttagctggtttttaaaagcggactgataaagggcttctttatcatctttaatataaaggtttagaaagttcacgggctcatgtcgaaaaaactcgggatagatcggaacttgatcaagatgattcttattaacatggtttcgagttaattcgttcattccggtaatggcgaatccctgctgattaaagaaaccaacatcgtcatggtagtgattggccattcgaataacggattcgattttatcgattggaaaatgatagttttgaatcagtcgatcgttataaatgatatagcagccatttgctaaaatataagtatgcagatccagctggtcaaggagtgtggtaatttcatagtgactgcggccggttgcgattacaggaagaatatttttcttttttaatgtttgaatggcagtaacggtttcggaagaaactgaaagtggcccgtcatcacacagagtaccgtcaagatcgaagactgtgattgtttcaatcatttcattggctccttaaaagttaatcatgatagtgaaaaatccgaatttaagggactgactgaatagtcggttcctttattcggatcgtttgagttaagactattttatttgttttttggaaaaatgacaaactgttttaatagaaagaaggtttgtcgaagtgggtattgggttcgttgacacccaaactctttcgggtgtacttgtccgaatcatctttcaaaatttcaacaataaacttggcaaccgcttgacggctaacttcagtaccgccaaatggttcaccgctttgagtaacttcataatcggtattgttgtcgtcattgaataaccaggccaatcgtaattgggtgtagtccaaatcggattttctaagaacggcagcggttttctttcgacgcgtaattgaactttcgatcatggcattattccactgaccaaagttgcctctgacttcatcttcaacgcccaaaacagttgcgacaattatttttttcacaccgttggcatccatttgtttaacgatattttcaacagcttccaaatcacgcatttcatttaaatagacggcatctacgccatcaagggcgtcatttaaggcatgtttgtcgttaaagtcaccatcaattaaagtttcccgatccggatcagttactttaattcgttttgacgcattacgggcgaataactttaatttgtaatcggtttgtttgagcaggtcggcaattaagtaagttgaaatttggcctgctgcaccaagaattaagactgttttcacaaaaattcctccaatgctgaaatgattttgatctatcgttacatgtccactataacgcaattgttgaagtgtgagaaattgaacaagctttgagttgctaaagattagttagtggaataagggcttgtatacaaaatagttacaattgaggtattgaatcattcaaagcgaaagtttacaattatgtttggatagttcatatcctataataatgttttgatggaggtattagaaattggaagatcaaaaagtaattaattatagtttacatacgctttataaaacgagcttggcaatagtaggtgtgacactgtttagtttttcgctgggaatggcacagccgagtacgaatgcaaacgctgatgcagtcgtgcagacaagtaaccaagctacaaagagttcaagccctctaactaaaggcaatattataattaattcaggtttatcagactcaaatggtgtgatccttgggaacggtgataaagtcagccttgacttgggcataaatgttcaggggggcgggaagcgagcgcattcattcaggggataagttcactgtcaaattttcatctaattctgttgatattgattccttaacgccctcatgggaggttaatagttccggacagtcttttgatgacttgttttctataacgagggatgctaataacaattcaattaccatcacggctaaacaaaatgccaattttgacaaaattcagcaattgaaattcaatttggcgggtcatgcccaaaccactgcagaacaaaaagcggatgcaagtgtgacggcagactttacattaaatgggcagtctaacccacttgcaacccagacatataaatttaacgttaaggattcatccggtggctcaacaatagcccccacaccgacaacaacgactgttgcgatttggggggatgcgaccggggcggcattgcatggtcagcatggccttgatccagttgaatccgccaaattctctgataattggcttgataatgacccctcaaataacgcaatcgattacgtacacaatcaggattctatgttggcatatgctcaactggccttaccagttactaatcggccgacaaacatagtatggcatatttggcccgaaaatggtcaagacctagatcctaataatgcgctggtatttatagcgccgaatgatggggtgcactttccaaacgtgattaagaatcccggactaaagtcagatcctaagcatctcggtggccttgtatttacgtcctctcaattaccacctgttaggccttcctctgaagggcaaccaactattaacatagctttttatgttgatgcaaaaatgaaggatggaccgcaaactataaaaacttccgttgagaataagcaaggtcacttattatcatcaaattcaaaaacattggtctatcaacaaagctatcctacgggttataccccattctttagagaacaagatcggaccattgacctcgcaacaactgaaggaaagaactttcctaaagcagctgacataagttccgatcaaattcgcgataactttgttcaaaagaagggtaatagtggctattaccaaggagactataatgatccaacaggacaaaattataggtatgcaattaccgatggttcatatgatccaacaaaggtagggtcttataaatttcagataacggttactggtgaaaatggtaaccaacttcagcgttgggttactttaactgttaaaaactctggtggcacttccggtggcggtaccaccccaaccacccctacgacaccaacaacgccggtgacgccatctacaccatctggcagtagttcatcaagttcttccagcagttcgagcgtcacgtccagttcttccggtgcaccaagtgaagattatcaacaaccgaaattccctgattatgttgccaaaaaaggaatggcggtttattcacttaagaaaattgggctatacagtaagaagaacttctcaaccaaagccagaaaagcatggtactcacgtaaaccacgtatttatcggccaatgtttgttgtaacgggatatgcacgttcggcaacgggacacttacgttataaggttcgtgatgtcaatcatcttaccaagaatcggaacaagaagggctacattaccgctaactggcaatatgttcgtccggtttattatgccaaaaagcattcaaccgtgacggttattaatcctcgcggtgtcaatgcttatggcaaggttaatttaacgaataaagttaaaaactacaaacaaggaaccattcttaaagtggtcaaagcagttcattaccatttgacaacgcgatatgttctaccaaatggaaaatatatcactgccaacagaaagctggtcaacatgggacggcatcgcttccctaggtacgtccgtgctcgtggcgccattaatcgatatagtgatgttaactttacaaagcagaatcgtcactttaccaaacaaaatcataaactgtttagggtttatggattcgattattcgcatgcaaacagtatttcaaatgtcggggcactgcgttacagagttgccaacggatatatttcaggaaataccagactggttagaattgtcaaataagcttgttttagcctaattaaataaaaaaatgactcatcagttgaccgttttgtcagttgatgagtcattttttatctggttgaatcccttatttaaataagtatcgcagtgtagccgttcccgcagcttttgctgcaattaataaacagcgctcatccattaaaaagttggggctgtggtggggatgggtttgtccatcgttggcatcacaaccaacgtatagaaacgtgctgggacgtttcagtgcgaaataggaaaagtcttcagagggatcttgagcaccaaagtcggttacttgagtaacttcgggaatgtttgccgttttgatatcttcaaccgtttgaacggtaaattttggatcattgtaaagaaccggaacatcagtgataatttgataatccgctttaacaccgaaggttgattcgattccttgaatgatttgtttgagttgtttatggataacggttcgggttgattctctcataatccgaacgtcgccctttaaggtgactgattccttgataacgttattggtgccgacaccgtcaaatgaaccaaccgtaatgctggcatgatcggccggttcgattcgtcgagacacaatggtctgcagggcggtcacaaaataacttccggcaacgatggcatcgtttgagagttgtggcatggaagcatggccacccttgcctgtgaaagtaacggtgaaatttgaacgaccggtttggctgtcacccaggtgataaccgattgcgccggttggcattgtggacatcacgtgaatgccaatcacgttgtcaacatcctttaaagcaccatcttcaatcattgacttggcaccgccgggatagacttcctcagctggttggtgaatgatgcggattgatccttttagttgattttttagagcaataagattttttgctaaaaccatcatgtacgctgtatgaccatcgtgaccacacgcatgcatgacgccgggattttgggatttaaacggtaaatcgttatcttcctgaatggctaaagcgtcaaaatcagctcgcaatgccaactttggaccgggttttccactgtcaatgtcgaccagaataccgtaaccggtgccgcaattgcgaacggtacagtctaaatcatgataaaagtttttgatgtaagcatgggtttctttttctttaaatgatacttctgggtgttcatggagatgacgtctaatctggatgatatcgtcttcggattgagttaaccgttgcatcaattcctgttctaagtccattcgttatttcctccaaataaatcagtctgatgttttttgtgcttgaaccaatttcatgagtagtggtttgattcgataaaaaatgacttcggcaaccacaaagccgacagccagagcaatcgcaattgtcaatgtgttaaataaatattcagacgtatgtgattcctgacccaatgtgaagcttctcatcccaagatacaagatgcctcccggaacaagtgataccaagctggggacgtaaataatgttaaccggtaccttgaataaaacagcggagatatttcccagtatcccaatgacaattgctgcaaagaagttcggcaggattaagccgtgattgacctggagaaccagatagtaaacggtccaggccattgaaccggtgatgccggcaggaagtaacgatcgcctgggaatattggtgatcaggccgaagccaacggtggaggctaaactaacaataaattctacaagaacgtgcatgacttaacctccgatccatgcaaagatcagtttacataatgacgtaccgatcacaacaccggccccgattgaaccggcaatgatgacagcatcaactgctcggacgacaccggaaatggtatttcgatcaataatttctcgaaacgagttggtgatagcaaccccgggaaccagtggcattaacgcactcacgataatgttgcccgcgctgctgccaagccctgaaaattgaagggcagccgccagaaagccaacaataaagccgccacagcccgccgcaacatagggcgttttgatgcgatagcctgccaataccgcccctaaatagccaatgatgccgacaaaaaaagcataacttaagtctgtccaagtagctttaaacagtagcattggtgcgactgaaacgaatcctgctccgataattttgagtggccaattaaaatcgatcacttttcgatcaattttttcaaccgattctttcaaagtatggaaatcgagttgaccacgaacaaattttcttgaaacagtattgatttcatccactttttgaagattccagtctcctaaccggacctttaccaagtgagtgcgggactgattgtttgtgccgacaaaaagggcggtaatagtggcgtgacaggcgatgtcatagtgagctgctttaccaatatattcaactgtactctcaactcgagaggtttctgctccgctggtcagcaatattttgccgactttcccacagagtgaaatcacgtcatcttcagtgatcgatttttccatgatgataatccccaaatcttttttcaagtatataaaacattataggcgtacaaacagatttggtgtagcaaaacatgatgattcaatgatcgtttctgtgatagaaataaaatatcgttggttagggataatcctcaaaaaggcatcacggatgacgattttgtgtgtcaaaaatgaataagtttaaagtcctaccaatcagagcatgagtagtgatgcacgcattataggaactgtagatagttattgactatcgaagactggttttgtgagatgtgtgaccttaaatttaaaaatgacagttgacaatctaaattaacgatgataaagttagtgacaattattaaagaattattagacgttgacgagaagagtaacgtaaacgcaggcccaacagagagcttcgattggtgagagaagcagcttgcagcaacgtgaagatgagctccgagtctgatgtactggttgaaaggctggcgcatccggtagcaaccgatacattgcagggtatatccaagtgttcttaataaatgctttgtaagaagcatttatgatatataaacacatcgattggtgtgactttcatcgactcttttattcggggaagaaaattaatcttttgtttatgagtgacataggtgacgtacctaatgaggttgttattgtgaaatagcaatgaatcaagggtggtaacacgaaaattcgtcctgtagttgaataaactatggggcgaatttttttatgcacaaaacctgatttgtttcataaccaatttcaattaaagcagtcatttatctttgtagagcaaataagttcatacaaccatcatttcaataaacagcttggcgatttgttgaaataagctagttgcactcacgttaagtattttgggagttgatgtatatgacagcaaacgcaacaaacggctttctccacgccgaaaatcagtggaccaatcaaaaactaacgcatccggtgtcgattctgattttgaatctcatgccaaccagaagagatgcggagtttcagttcttatcaggattcaaccatcttgactcggatgtggacatcacttttatgtatccatatacccatcactttaaaggaacctcacgggaaaaaatcgaagcggattatgtctgctggaatcaaatcgccgacaggtattatgatggtttgattattaccggttcgccggttgaaaagctgccgtttaagcaggttgattattgggatgaacttcaaaagattatcaaatggggaaaaacccacgtcaaacaacagcttcacgaatgttgggcagcacaagcaggtctctatctcgattatggtattcaaaaacgattattaccgaataaattatttggtattttcactgctgtgagtgttgaccatgactctcccttggctagaggcttcggagccggggggcttctacggatgccgcaatctcgacataccgagatcattcttgatgaaaccaacttacctggcgacttaaaagtgattgcaactgcaccgcaatccggacctatgattctttcatcaaacacatatcacacgacgtatgtcactgggcatcccgaataccaggaaaaaacattggcgaacgaatactaccgggaccgatacaagaatctgccaattaatcctcctgtaaactatttttcagacccggtttctggaaccgttaattattcctggaaggatgccagtaagaaactttataaaaattggacacatttattagtcgataagaaagtaggaatctcattatgacagaagaaaacaacgaattacattttgaaacattacaagtacatgcaggccaaacagttgatgaaaccggatcacgtgccgtgccgatttatcaaaccacatcatacgtgtttgacaatccggaacaggcagccggccgatttggattaactgatccgggtaacatttatacacgtctgaccaacccaacaaccgatgtagtcgacaagcgggttgcagcccttgaaaacggaactgccggagtgaccttggcaactggatcagctgctattacggctgctattttaaacgttgccggaaagggtgacgaaattgtttccgcaagtaccctgtacggtggcacatttaacctctttaacgtgacactaccaaaactcggcattaagacccatttcgttgacccggatgacccggccaactttgaggcacctatcaacgaacataccaaggcactctacattgaaagtatcggtaaccctgggattaacctgattgactttgaagcagttgctgccattgcgcataagcacggtatcatcctgatcgttgataacacatttggtacaccatacttagttcgcccattggatcatggtgccgacgtggtcgttcattcagctactaaatttattggcggccacggaaccacaatgggcggcgtcattgttgaaaacggtcaatttgactggaaggccagtggtcgttacccaggctttacggaacctaacgcacaatataatggtttggtattcgccgatcttggcgggggagctttcacaaccaaggtgcgggcagaatcattgcgtgaccttggggccacaatcagtccattcaactcattcctactcttacaaggactcgaatccttgtcattgagagttgaacgccacgttgaaaacaccaaaaagattgttaacttccttcataaccatccaaaggttgcctggattaattatcccggtcttgaagacagcaagtatcatgatcttgctgaaaagtacttcccaaagggtgtcggttcaatcttcacacttggtctgaagggcggcgaaaaagccggcaagcaattaattgagaatttgaaactcttttcattattggcaaacgttgccgatgcaaaatcattaatcattcatccggcgtcaacaacccatgcccaacttaatgaggaagaacttaaagaagctggtattacaccggacttgattcgagtttctgttggggttgaaaatgcggatgatctgattgctgatttaacacaggcactggataagattccagtggaagaagatcaaaaagtcgcagaatagcatggttcttgtttaactggtgagcgtgagaagcagtcctaaaaaagtgtgcggatcaaagcggttagcgttcggagtgtaagacgttcatttcggaaatcccgattttggatttttgaaataaatctcttacatgcagaacgttgctttgaggagcagtcctaaaaaagtgtgcggatcaaagcggttagcgttcggagtgtaagacgttcatttcggaaatcccgactttggatttttgaaatgaatctcttacatgcagaacgttgctttgaggagcagtcctaaaaaagtgtgcggatcaaaacggttgatgttcggagtataaggcaacaattaagctaaattagagaattagccctaatgattgcccctgcatgatataacaacaatatttttactaactcatactgacaatttaaatggcgaacgggctgaaaacccgttcgttatttttatacataaaattattttaatatgcgtttgaattcattaggtacgccaactgttgcagaatgatgcaagcgagtagtctaaaaaatgagtgaataaaattatcaaataaataaaaataatgaatatttctaaaaagtattgcattttgtctcatgaagatgtaatctattcacaattcattaatattcacattacgtgaataacacagaggcgattggatgcaagcagcgttagttggcgtaacgggttacgccggaatggtcctttatcaattattaaaggatcatccgaatattaaaaaaattaatatttatgatcataagttaactgaaccaacaactttggaaagtgtcgcaccggtatttaaatatgaggatgccgaggttgatccttatgatccgacacaaatcatggcagataatgatgtcgttttttttgcgacatcggcaggggtgacatcaaaacttagccggccatatcttgaaaaccattttccagttatcgatctttctggagacatgcgtttaaataccgaaagtagttatgaaaaatggtatcacaagccggccgcaccggagaagtacttgcggcaggcccaatatggcttggccgaatttgaatcagttaaggatcaaacatatgtcgctaacccgggatgctacgcaactgcaacgttacttggattggcaccactgattcaaaatcagttggttgatgttaaaagtgtgattgttgacgctaagtcggggacatccggggcagggaaaaaattatctgctacgacccactttacggaaactaatgacaatcttcagatatataaaccaaatcagcatcagcatattccagaaattgttcaggaacttcataaatgggataaagccgtttcgagtattcaatttatgaccacgttgattccggtgactcgaggaattatgagcacaatttatgctcacgttaacgatggggttaccgaagcacaattaagccaagcctatcataagacgtatgatcaaaaaccatttgttcacttcaccgaaaccgatttgccaacgataaagcaggttgttggtacaaataattgtgatattggattggcttacaacccggacacaaaggttgtcatgattgacagtgttattgacaatatgttaaaaggtgccgcaggccaagcagttcagaactttaatcagatgtttgactatgagcagacggccgggttgaagttgaaacagatgctggtgtagtgtgcggatcaaagtggttagcgttcggagtgtaagacgttcatttcggaaatcccgactttggatttttgaaatgaatctcttacatgcggagctattcttaggcaaatcagtctgcaggttgtcaattagagaatgataaaaagctgaaactaaacttaacgattttaaaagatattgagaggaagacgatttatgcaaataacgagtgaaagttccattgaagtaagcacatttgagtggccggcaggattttatacagatgccggtcacgctggtttaaaaaaggacgcggatgatcttggctggcttgtttccaaggtgccggcagacgctgcaggtgtttataccaccaatcaatttcaagctgcgccaacagctttaaccaagcaaaccattaacctggcccataaattgcaggcaattgtgatgaatagcggtaatgctaattcctgtacaggcgtgcaggggacacatgatgcagcagctatgcaaaaggctgccgccgataaattgaaaattgattcaaacttggttggggttgcttcaaccggtgttatcggggagcaattaccacttgataagattaaaaaaggcatcgacggtttgggcttaacaaaatccgatgatgttaccaaagcggttttaacaacggatacgcacgcaaaaaccattaccgtcacctgtctaatcgataacaaaaaggtgactttaaccggattttgcaaaggctcaggtatgattcatcctaatatggccaccatgttgggatttgtgacgaccgatgcggcaattgagggaaatcagcttcagggcctattaagtgaaaccgtgaatcagacatttaatcaaattaccgttgatggcgatacgtctacaaatgatatggttgttgtgatggcaaatgggcaggccggaaatgactcgttgacatcgtcccatgaagattatccgacgtttgtgaaagcttttaagctggtcttgtcacacttagccaaggagattgccggggatggtgaaggtgcttccaaattggtagaagtcaatgtagccggcgcctataacgcacttgaaggtcaacaggtagccaaggccattgtcggatccaatcttgttaaggcaatgatctttggaggcgatgcaaattggggccgtgtgatgcaggcgatcgggcagacaacggcacacgttgatctgaatggtgtgagtgtctcaatcaacggcattcaaatggttaaaaatagtctggcagccgattatagtgagaacgaggttgccaaaacattgacagaaaaagtggttacgattgatgttgatttgaatgccggtactgataccggtaccgcttggggatgcgatttaacgtataaatacgttcagatcaatgcctcataccgaagttagggggcattgtaaatgggtcaaacaattgtcattaaaatcggcggacatgctgccgaaaacctgtctccggaattctttaaacagcttcatcattggcacgatgagggaaagcaaattttgattgttcatggcggtggacctcaaatttcttcttggagcaagaagctgggattaacggttaaaaagatcgacgggattcgggtaacagacccggatgtactcaaagtcacccaggcggttctactgggactggttcaaccaacgctctgtcagaaggtaacggcggcagggttaccggcactgggactaaatgccaccggtcatccgatcatctttggaaactatttaaatcagaagttatttggtgaagtcggtcagctaactgatatcaatcaggattacatagcaacggctttaaaagatcatattgggatcacggcaccgttggcagtcggccaggcaggccagctactgaatgtcaatggtgacgtggcagctgcgggaattgccagaatgttgggcgcagaagcgtttattttattgaccgatgttccaggagtgatggttgaaaaccacgttctgtcaagtttgtcgagacaaaaagcaaataagatgtttaaaagtaagctgattacggccgggatgcaaccaaagattcaggcggcttttgatgcattgcaaaatggtgttaaaaaagtgacgatcacaaataaactacaaagtgccggcacaaccttattgaagaatcaattagtcggttagggttaggaaggaagttaattatgaagcatatttttccaacatatcaacaattcccaatggaactggtttccggtcacgattggcatttggtagataatgatggcaaagactatttggatttcaccagtggtatcggggtttgcagttttggttacagcaatgaattgattcaacagaatgttgttgagcagcttggcaaggtctggcatacatcaaatctttatccaagccagctgcaggatgatgtagctgaaatggtggcacctgaagggatgctggcattcttctgtaattcggggactgaagccaatgaagccgcttttaagttggctcgaaagtatacgggtaaggcaaaggttctggcatttaagaacggttttcatggccggacttatggatcaatgtctttgactggtaatccggatattcaagccggttttgcacccctggttccgggaattgattttgcttcttacaatgacttttcttcgattgatcaaatgacgtcggactatgcagcagtcattcttgaaattgttcaaggagaaggcggtgttgtgccgggagatagtcattggctaaaagctgtctcacaaaaatgtcatgaactgggtatcttaatgattgtcgatgaagtccaaacggggattggccgaacaggtacgaaatttgcctatgaacagtttgacgttgacccggatatcgtgacatgtgccaaggcgttgggaaatgggctgccaattggtgcgatgctcggtaaaaagaaactggccagtgcgtttggccccggttcacacgggacaacctttggtggcaataaaatcgcattgtcttcggcaaagggtgttctgcaacaattgacaccagactttttaaagattgttcaggtgaaaagtcaggttgtatttgacgcattggaaaaagcattgaagccgttatcgattgttaaagatattagcggtttgggattaatgatcggtattcatttaaccggcaacgttaaagtaggcgatgtcattgccgatttgcaacaacagggcatattgacgctatcagccgaacataatacgttacgattgttgccgccactggtaatgagtgaacatgatttattggcaggggttaatctgattcaaaatgagttgcaaaagcaggctgatttagcgaaatcgccgattgatcagctttaaaagggctataaaaaagaagaaattcaccatattttaaactggtgaatttcttctttttgttagagaaaatttaaattagtttgtatacttaacggctgtgccatacgcagcaaccgactgcatatcggcaccaatcgacccggagtcaaaacgcatcatcaccacggcatcggcacccattttttctgcattggcctgtaggcgttgaacagaaacttccctggcttcgtcaagcatcttcgtgtagtctttaatttcgccaccaacgatgttctttaagctggcgccgatatttctaacaacgtttttggattgagttgttaagccgaaaacttctccgatcacttcatattccttacctggaatatgttcagtcgttgaaataataaatttcttgtcactcataggatccactcccaactacttatttgagacctatacccagaatcagcattgctgtctcaatggttattatactagtttcggcaagaggttgggagatgattgtctgagaaaatatggtaacggataacgtcgcggattaaaccgccttttagtccaacggcgtacttgatttgagtatctcggccggccataacatgagttgatagccatatccttgttgatcaaaggttagactttcgcattcacgtttggaagtaaacgcggtgtaatggatatcattggcagtaaaactgccgtcacggactgactgggttggaatggacgttaaaatatcatctgtaacatagtaaagccggtcgtttgccggattatagctgacaccctggtttggggatccaccacggttcttaaagtaggttggggcagcctggaactggacgtcgtgttggtccaaacgaccatagaagaacatataccctaaaccattttttcgaccccagtaggcattaccctgtttatcaaatgtcagggtgtgtaattgtaaatttccggaatcaccatggtacattttaaaattatactgacgaagtggttttaaggagtccgttgtcatttccaaaacggtattgttttgattgcgtgtctttaaatccgtgagcgtattatcttctacaatgtaaaggtgtttattttgtggattaaaagagagcgtttgaccgtgaccgatgtcgacttggggacttaattgagctgcctgggcaactgccgcgtatttaaacagatcaggattctgttgcttaatgcgcttgatttgtttttgatccgtttcaagttggttttccaatgcagacagtttctgtcgattagccttggtagcatcttttttgcttgttgttgactgaaggttttggacctcggatttaatttttttgaggtcggcatttggtgcctttaattgttcataagcatcctcatattgttgattatgttgaacgccttcgtctgtgtaggggttaaagtagttaaaagcattccagacaatcatcgggtcggaaccggcacctaatttatttaaatctgctaaattatatttaacaatgacgcctaaatttgtgtcgcttccgtttgattcaataaaatacatatttccagagtcgtcaagggtcacactttgaaagttaccatgctgataattggtaacattgaagccatccggcagatataatttggtttgtaaagtggtttgttgggtactatccggcgttgtcgaataagattcaacagttcccggatcgttttcatcgatcgttctttcaatatattttcgatccatgtttcctttgggtgtcgtgttgtcaatgacgttaaggttcttctgggtgtaatctttcaacacgttaccggcgttaacctggggaatattgttggcaggatcgggcgcgtcgagaacgtctgccgagacaacttgtgttagacaaagcatactaataaaagaaaataaaagcagtgcgactggctttaaacgagtcttcatttgatttcgtcccttcaataattaatgagttgatgactgatttgtcgtagcttgggcattatcggtactgacattgatactaaccgagctgccgaatttggctgcaccaattgtggcaagatcggcatccgacaatttattatcagttaatgaataaccggttccatccaaagtcgtaattgcttcgttcgtaatcgcggtattgtcttcggattttaatgtccagttattaccggattgaacgcccaagtcggatcctttaggtgccggatcgtctgcatcagtgtttgtgtaatcgatggaagtgacgatttttttggttgaaggatcgacgaaattaattctgacagcgttatccgaaatgtctgttgtcttggtcgttgttttcaggtacactgaatttccgaattgggcgttagccagttgttcaagctgcgaggacgataaagcatttaatgaataacccgtagatttaagtgccgtcttaatatcagcctggatggcgttttgatcatcacttgagagtccggtggttccattatcggttgctgcgagtgattggccggcagaagcacccggtttggtataattaaaagaaccaatgacgccatccgtttgattaataatgttgatctgaacagcatcattcggtattgaatccgcttgtgcagctgttagtgatgttttgccaccaacggttgcttcggcaagataaccagtttggttggccgaaagcgtttctaatgaataaccggttcctttcagggcatctctgatattgtcctggagtttctgctgatccgaggcccctaacagccaaacttcggtgccgtcatccgaataagaaagaccgagtgttttcccggattgggcgtttggcttttgataatcgatatattttatcagttgtccgctactgttaaccaaatcgatacgaactgcagtaccggaaaggggatcctcagcttgggacaatcctttgtacagaatccagccgttaagtttagccgctgtttggtcaacgcttgtcacatgaacccaagtgtctccttctcgagttctggtgcccattttatcaattttaaacgcggcgtttttataggcaacggcgtctccaactgtcctgccggccccataaaccgtgttcatgggttctgtatatgtaacacttttaccatcgttgttcattccgggtgccgcaatgttaaatgtgtacttggctaaattacttggtagcgggatttccttgaaagctgtgaatttttccaaaccaccggcaaattttccgacgtgtttgccaccgtaaatccaacctcgatactgtccgtcaaaagaaacaattttataataaacttgaccattttttgtggttgcctgacggtaggcaacaaaattatcggccgatgaatccgattttgccagttctttgagcgcaaccttgctgataacctcctgggctccctttttgacggatggctttgtgtagagggcagtggttcctgtgaatgtgacgttacggttttgtgcgtctgttgttaacttttgattgttggtaatttgttcaggcacgtgagcagcactagcttgagaagcgattaacaaagcgccggttgaaaataggctaaaagctgccaagccaagcacgatcggacttttccacttaaacttattcaaaatataaacctccaaacgatttctatacattagtgagtacgatatgatgataccgtgaaatcgtagtcgaaaattggaattgacagaacttttaccggacgtttacggagattttacattgtttgaaaataagtagtgaaaaaataaaccgcttctcatttctgagaagcggcaagtgcacttgtgagacgcctaatgtggtttagaagatcgtcatcactatgcagtaaatattataacgtacatcgtcaggtttgacaaaggcttatgtgaaaacggattaaactttcttactgaataatgggtaacgttttcacatgaaaaaggttaagacgattatgattgttcagcaacgcttgaatgagaatgaccaggcgtctaatgatcaattaggaggaactgctaactaatatcaaagctgattggagggctgttagaaatgaaagtgtatttggaaaccgttaatcgtgatcgtcaaaattaccttagttttttaaaacttgcggatcccgatgaaacaatggttaaaagctatcttgattcgggagaattgtttaaaattgtggtgggggataaagtggttggcgttcttcatctagttgagattgatgatgagacacttgaaatcaagaatatagcgattttacctgaataccgagggcggcatattggttcaacggcacttcaaagccttattgaactttgtcgaggcaatcattataagcggatatatgtcggaacagccaactccagtatcgaaaacttcaaattttatcaaaaaaatggcttccgatttgatcatattgtacccgattttttctcgaattatgatcaatcgatttatgaaaatggcattcaggcactggatatgctttatttggtgtatcggtttgatgataaaaagaaagaggattagattgaaatttacttggcaaaaacaatcaaatgaaccaaagacgctaaaaaagtttttaaatactcacggaatcagtcatcgaatgtataagaatatcaagaccagtgggcaagttttgataaacagtcgatcaagtgatagtcagactaaacttgcggatggtgatcaagtgacggttattttacctgatgaagccggtgacccaaacgttgctgttagtgaacaaccaatcaaagtggtttatgaagatgataactggctggttgtcgataaaccggcaggcttaacggtagtaccgggacctgctaatcgtgacgatactttggtaaatcgggtgaaaggatatttggtgcgagccggtgtaacagacctggtgccacatattatcaccagattggaccgttttaccagtggcttggtattaattgcaaagcatcggttggcaaacagcctggcaaacgaactgttggcggccaaacagctccataaacgttacttagcggttgtgagtggtggtggtttgccggatcatggtcgaattcaaaaaccgattgcaaaggatccaaatggttatggtcagatcatttcagatgatggccgcttttcggataccgaatattgggtgaggcagcgcttaaatgatgatatgctggtggaggttgccttacacacggggcgtacccatcaaatcagagttcattttgcgtctataggtcatccgttactgggcgatcaactgtatcatggcccgatgaatatgggaattgatcggcaagcacttcacgcggtgatgttaggttttaatgatccgttctctcaatcggagattaagcttaaaagcccgttaccaaaagatatgagctcgattttagattaaaataatactcatcttgctcactgcgtaacgttgttagaacaaggcttaaaatgatgcgctgaatcgataatgagaatttactaaaatcggaggcattccggttgaagtttccccggcttcacgttatgatagcggtatcaaattaaggaggagactagatatgtctaccgaagagaccgatctgacggtcaaaaaaattattgcagaattagaaaacaacgtttccgtgcttgcatggttaaaggataacaagaacgacgaggaagcccagaagcatattaaggcgattaaagacgcgttatccaaagcgaagactgatttaattaaggcataatgttgtgttgttagcgagtttgaccggaataatgtctgatatttctatgttcttgggtttatgatattgtgatgattgttaaggttggataagcagtcttaatattgagttctgtgtttggttaggcagctccttttacgactggaaattaaattaagaacgtcttactgatataatgttggtaaggcgtttttttatactaaaaattagcgattaacttgtgaatcaagggggatctccacatggcagaggaacaaacggcaatttgttttattgaccatcaaaaacatatggtgattgatggacggtatttaagggatttagaaccggcgacccggaatttaattaaaagtgagtacccgtccgcaaaggtaacggattttatttgtgatcacgatttattgaaatatcagttgatgcgtgttgacggaatggttaaatcggatgtgaagcaaactcgaaaaatcaatcggcgactcactcgggcgatgcaaagtgatgattatgaaattgttgatgtgaacgagaatttggagaggacgctaacaatgggccagcgtgtttcggatgctgttgcccgctttggtggtagttggggatttatcggtattttcacgtttgtgttaattgcttggatgtttgtcaatggggccagtctattcggcattcactttgacccgttcccatttattctgcttaatttgggattgagttgtattgcggcaattcaggcgcctatcattatgatgagtcaaaatagggctgccgatcgtgaccgaatgaattccgaaaatgactatcatgttaacttgaagtccgaacacgaattgagaatcttacatgcaaaattagataacttaactcaaaatcaattaccacacacacttgaaattcaaaagttggaaattgaaattctgggacaaattcgaaatgaattagatgaacttcatcgagaaaaggccggtcaattttcaaatgatcaacaagatggtgaaaaagatgagaaagagacgtcggatcaataagacaaagccttgatgaatcggttggctggccgtcattaacctgtttgttggctttcttcattttgacaaaaatgggaaaattctgtaagatataatgtaacaaagtgaaaacacgattatatctaggaggatttttttgataaccgtaagagaagcacagcaggatgatgcgggccagatagcgccgctaattgatattatttttgatgaaatgcaacttgatgaattagaagacgttcccgaacctggactcgccaaggtcatcaccagggcttatcagacaaagacttatctttctgacaaagcatccacggtggtggccgaggccgatggccaagttgttggggtagtgtttggttaccccagcgaaaatgaggacgatatcaacaaggtgctgattaatttatcaaagcaaagtgccgattttaaacaaccttatatccctgattcagaaacgaacaccgatgaatggtatttggattcaattgcagttaacccaaattatcaaggtcacggtattggaagcaagctattggctgccgttccaagaatggcattaaatgatggtaaatcagtggtagggttgaacgttgatttagaaaatcccgatgcagaaaaattatatgcacgcaagggattcaagacggtgggttcgcagatgattggtgaccatttataccatcatatgcagaaaccggcaaaggatccgagcttgttatatgtttaaaaattgaatgtaagttgttcaaagagaaccacagcttgaaattgctgtggtttctttttttactttttgtcatatataattgacattttcagaagaatagattatattgtcaatataaaaagacacatatatatgacacactagaacaatgctcattaatggtcataagccaaagtaaggggggtggtgctttgaatcgagtcagggaatatcggaagaagcagaagttatcccaatttagtttggcagaaaaagtgggtgttgcgagacaaacgattaatttgattgaaaatgataaatacaatccatctttgaatttatgtatcagtatcgccaaagtgttgggaacagatttaaatacattgttttgggaggttgaggataatgaaagttaaggaaacatttggtactaaaatattgaaacatttttatggcattccgggtgtactggatgaacatgctagacaggaggttagccgaattgggagcaacgcttatttaatgcttgtcagttatcttctgatatctacattgatcattttgcttatttcaatcaggcatcttgagaacgctttttggattctggtgttttcaaatttaattgtcccaatttatggtataaatgggtatgtgttagttgcgactaacagattacatcttgatgataaagaggtcagggcacagaattatgctgatgctgttaagaagagtgttaagcgtgggataggtatggcagtttattttggcactaccatgtttttatttacgtcaatcaccaactggtttattgatggaacccggccgattcgaacgttgacatccatccacgaaatcgttaaatggatattagccggtgcgctttttggattattaatgttcatctatgatttgtttcggattaagaaatttcgagagtaagagggggataaaatgactgctttattaatgataattggtatcctgttcttctgtcttctgggatttaatgattatagaaggagtcagttgaccggaaaaacaattttctttttaacgtttggaactgttatttgggttgcaggcaacattatcagtcagtattttcacgggataaattaattttattgaacttttcattaaagccgagcagataatcgatctgtttcggcttattatttccctcttttacatatgtagacatttctatttattcctagtggattgccaccttgattgtgtcctgcttctgttctatacttgataaactcatttttttgaaaggaagtcctgtcatgtctgaaaaagagttattcgctaatggtgaaattacggttcatggtgcccgccaaaacaatcttaagggagtcgacattcgaattcctaaaaaaaggacgaccgtttttgtcggtctatccggagccggaaaatcgtcattggtatttgatacgattgccgctcagtcacgacgggaattaaatgaaacattcccgagttttacacaacaatatctgcctaagtatggtcagccgaatgtgcaatcaattgatcatttacccgtggcaattgtgatcgagcaaaaaaagattgggcaaaatgcccggtcaacggtagcaacctataccggtatttactcattactgagattgctgttttcaagaattggtcaaccatttattggctattcggacactttttcatttaatatgcctcaagggatgtgtccaacctgtcaggggcttggttacgttgatgatattgatgagtcggctctggtcgataaaaacaaatcactgaatgaaggcgcaattaccttcgtcagtttcggtgttgatacttggcgctggcgccggtatgcggatagtggcctttttgataacgataagcctctaaaagattactcgacaaaagagtgggaattgctcatgcacgcaccacagcaacaattacacggagcgccggcagcgtggcataaaacagctttatatgaagggatcgtgccgaggattcgacgatcaattttacataaggccgaagctaagcatcatcgaacggaaattgccaaggttgttacgcacaaggcatgtcccgattgtcacggtacccggttgaatgagttggtcaggtccaatcacattgatggtcaaaatattgcggatgtgtgttccatgaccctttcggaagttgtgacttttttggaaaacatcaaagtgccgctggctgtttcaattattcgtgaattaacaacgatgctgaactcgttgattaatatcgggctgggttatctgtctttaaatagagggaccaacagcttatctggcggagaagcacagcgaattaaaattgcaaaatatttaaacagttcactttcggatctggtttacattctggatgaaccaagtgttgggcttcatccccacgacattcggctggtaaagcaggcgctgcgtcaattgcaatcacgtggcaacactattttaattgttgaacataacccattgatgatgacggatgcggattatgcggtcgaaattgggccggtggctggcaacggtggtggtcaggtgacatttaccgggtcctttcaggagctgctttcatccgataccttgacggggcgctatcttcgtcgaccttatcagttaaaaacgccacgaaaagtatctggtgaatggcttaaacggacgcacattcggacacataatttgaaagacgtctccgttaatatcccggtgggtgttatgaccgttttgaccggagttgccggatccggtaaaagttcgttggctcaagcgctaatggatgggattaaaacaccggttatcaatttgaatcaacatgctgccagcgttaaccttcgctcgacgccgttaacctacttggggatttttgataaaattcggcaacgttttgccaaagcaaaccatgtttcaagcagcctctttagttataacgggaaaggtgcctgtccaacttgcaaggggaaaggcgtgaccatcacgaatatggcgtttatggatcccgtcgttcaggtgtgcgaagcatgtcacggtcgaagatacagtccggaagccttatcctaccagtatcagggacacacaattgcggatgtccttgaaatgagtgtagataaggccagccaaaattttgtcgatgatgaggtcatcgggccgcgaatccatgatctgcagcgggttggtctcggataccttaaactaaaccagtcattaacaacgttgtccggcggtgaattgcagcgattatctttggccactcaattaaatggccagggaaatatgattttcttggatgagccgacagctggactgcacatgcaggatatcgataaattgttaggcttattcaatgaattgatcgatcaagggaatacactgattttgattgaacataacctgaccgttatgacccaggctgactggttgatagacgttggtccggatgcaggaagttttggcggccaaattttatatgagggcgttccatcaggcattttaaacgttaccaaatcctatacagctgcatctttagcacgggtattgaaacctcattagatagttcaaccgtgatttacaatgattatgaaagcgaatgaaagaatcgcttttgattgtcattgcaaacagaatggaatttgttataattgatttttaaattgtatttggagactttaaatgatgaagaaaaatacggcgacggctattatgagtgtggttgcaattgcggcgaatgcaacgattgcaattgttacagcatccttactatcaacacagaaaaatgatgattcaaagcatcatcataagcatcataagtagaaagaggatttaaatggaagacaacattaaattaggcaacccggtttttgacaacatgttatttgtacttgatcggccggttaccgaggaaaatcacaaggactatcgatttgaaaatgaagaactgcttcaaatcagtgagggtatttgggcaatgccggcttatatgaagaacgatgatgattttagtttgttctttattattaccgaaattgacaatgggcaaactgtacttgcattctcaaccggtgaaaaaaatggcagtgatttttctttaagtaatccgattttaaccggtaagggattaaatctgttaacagcctacgataaggaccgtgcagcttcgattttgcattttattaatcaaatatcaaaagcagccgagggcaattggcgaatggtcgaaaactaattgagcgaaaacggttgcaattattaaaaaagctgttaaactaatcttaaattttgaacttttcgaggtaaaattatggaactttcactagcagagtcagcaaagcaatttaacgtaacaccggaagtgatcgctgactatattacagaaggattggtccccagcaagacaagtttggctgatggatcgactttaaatgatcgtgatatgtattgggttgatatggttcattgttttattcaaaatggttcctcaattcaggaagttaagaaattgatagaacgttgcgatatctagacaaaacaattgtttattggtagagacgatgatattctaagtctagagaggaccgcacccttttttgtcgttaattagattctcgtttgtattgatgttagattacgcaggtaagatgacaacaaagagttccatcgtgcgattaagcactttgagtatccaatgataaaattggatcagtcttcgggtatggacgaagtaaaatttagttaaaaccaacagggatgtcggttctctctgaaaggctgttgtcaagcaatgcttggtgacagcttttttctgtacacctaacaattatttccccaaagatggaaattttggctcacaaatgcaataataatagtacatatagattggagtgattaactaatggaaggaaatggtcataatcacgacgtcttgagcggtagccgcttcttttttgttactgttttaaatgtcctaattacaattgctgaatttgttggtggtgcgttatccggaagtctttcgttgatttctgacgcttttcacaatttgggggattctttttcaattgcatttagttatgcagcccatcgaattagtaaaaaacgccaaaatgagcgaaacacctttggctataaacgtgctgaaatcattgcagcatttttaaattcgattgccttatgtttgatttgcgtttttttggtgattgaggcggtgaaacgactttcacatcctcagtcaattaacggtaatttaatgctaattgttgctataatagggttaattgccaattttgtttctgcttttttgctaaatgccggtgcaaagcataatttgaatatgcgggctacgtatcttcatattttaagtgatgctttgtcttcagttgccatcattattggtggtgtcttgatcgacatatttggctgggtcatgattgacccgattgtgacaattttggttgcggtatatatcttttacgagtcaatcccgattatccggcagacgtgtcgaattttaatgcagggtgccccggatattgattatcaagcaatcaagaatgatttgttgaagattaatggtgtttttggcgtccatcacgtccacgcatggtcgattgatgagcataatattattttttcggcccatgttaacatgcatgatatgaaaatcagtgaagcgcaacagatttatactgaaatcgatgatctgatggagaaaaaatatcatatgtgtcacgtgacgatccaagctgaaaccacccgtggtgaaaatgaagatatgatttacgatcgaggaaacgacatcccgtaattctgtcatctaaagaatagaatatataggagattttgatttaatgacaccgatgaaagaagactatttaaaaattatttttgaacttggtggtgcaaacaaactggtcagcaacaagcaaattgcgatcagtttggatattgcggcaggctcggttacggaaatggtcaacaaaatggtcgacgaaaagttggtcacccataagccatattccggggttcagttaaccaagacgggtacgcgctatgctgaagaattggttcgaaagcaccgaatttgggagacttttttaattaatgtgttgcattttgaccttcccgatgtgcatcgtgaggctgaacaactggaacatgttaccagcgataaaatgattaatcatttggatgactttttgggacatccaaagagatgccctcacggcggtattattcccgataaagatggtcattatgagaaggatcatgataaactgctaatggatgccaaagatggtgaagaggtggttgtcaatcgctttattgataatcacgatttgttgacgttactgggagatattaaattggatcttggcgatcgtttaaaaattatttcgcacgacccgtttgagggatccgttgttgcacaaaatttgacggataagaaacaattgacaattgggtacaagacggcgcattacgtatttgtgaaatgatgatgtgattggtttatgcgtttctgacagttatgacagcgcacttgataaatcaaattagtggcgtaagattgtcagttttaaatccggtgatttctggggtgtgtaagctaatggacgaagaacaacgtaaatatgaacaaaaaaggcaacacgatcagctggtattggatacttgtattcttgccggaaccattatgattgaatccggatcagaaatgaccagggtgaataatacgattttaaggattgctcgaaatgccggtttggcaaaggcccgagtctatgtgaccgtcacaggaattattatgtccggtggcgtgtcagacgttggtgcgcaggttggttcgattgacaagcgatcctttgatttggaaaaggttgccaaggttaatgagttgtcccggctttttgaagccaagcaaattgatatttccgacttttatgatcaactcattcacattgatgatgtggtcgggacgtttcccttgtgggttcaggaaatcggtgccgggattgtcagtggtgcgttaaccgtcgtttttcgaaataatattgctgatttctggattacttgtttggtcggaatggccggctgggctgttctgtattttttgaatatttatgttcagattcggtttttaagtgaatttttggcggctgcggttgttgcagccttggcgattatgtctgtacagctcggctttggacatcaagcggatgatattatcgttggtgcgatgatgcctctggtaccggggattccactgaccaatgctgtgagagatgctttgtccggtaatctgattagtggtcctgcccgtggtattgaagcattgatcagcgcctgtgctttgggctttggcgtggcgattgcactgcattttatgtgatgaggttgatgaaatgaatccaattgagttttttatcataaaatgtatttgtgtttacctgtcaggaatcggttttggcctgatcgtgaatctcccacataaagcactaaatatcgcaggcttcaatgcgctgctgggctggttggtttattacgtgatcatcaatacatggggcggcctgggatcgtccaacttttttggcggtctctgcatcggtgtgacatcagtcatcattgcacgttggaagaaaatgccgagtattttatttgatgttcccggattggtaccattagtacccggcggtcaggcctataacacaattaaaagttttgcgatggggaattatcaagcggcgttcagctatctatcagaggtgatttggattgctgggtcaattgcgcttggatttattgttgcggagctggttaataagatcaggataaaagttgaacgtgatttaaggaagttgaaacggtcacgaaaatcaaaaatttaagtaaagcgaggttgagacaagcgaaatttgtccaacctcgttttttgttgattgacgaaaatgacgataaccggtattgggaaatatctattaatcgctttctttaaactggatgattgacaaagcagctcatatcaattactatatttatgaaatcatattatatgacatatagtattgcagaggtgacgatatggcaatccaattaagttcggaacttttagatggatgtgtgcttggactgttgatgcatgatgattactatggttatgccttaacacagaaagttcaagagtcggtttccgtttcagaatcaacgatgtatccggttcttcgaagattaaaaaagaatcaactgttgaccacttatgatgaaccctaccagggacgtaaccggcgttattaccaaattactgcggaaggtaaacgacaatttagtgtgatccagtctgaatggcgggactttaaaaccgggattgataaaatgttaggagatgaagcggggcatgaatgattatattgaagaattaaaagcaatgctaacgcagctgggagctcaagaacaaagcgatgtgctggatttctatacagagtacttacaagatggccagtttgtcacatatactgactgtgtcagagaactaggcactccacggcagttggcacgtaaggtattggcggattattccattaaaaatttgaatacagcttctcaatcaggaagtcgtgctaataaacccaaagatgatgttaaaacaatttggctgattgtgctggcagttttgtcgacaccgattaccatcccgctagcgtttggggcggttggtttatttatcgccgcaattgcggttgccgtcggtatattagcggctatcttcggtgttggctttggcgttatttttggcggcctggtttctctggtaaccggattaggtgttgtcagcaacaacttttgggttggtattttctaccttggcgttggattaattgctgcaggcgcgattattatgctgataccggcttttcgaggactggtagacggtgtcattcatggcatcacggttttctcgaagtggatgtatagcaagattgtcaaaaaaaatcgagcagaaaaacacggaaggggacaacaaaaatgaaaaaaccggtcattattgggttggttacgatgattgttggattgattctcgccgtggttgctttgggccattcaggccttcaaacggtatattgggacagcggttttaaagttgagagtcaaaagaacaactcgaagacttatcaaaagacctttggcactaatgttaaacaaattgaatttacagctgataataccattgaaatcagaagtggtgatgtttccaaaacgcaagtgtcgtatacaaccggaacgaaggttcaaaaaaatggcgatattttaacggttgattcgcctaaccggcatcatatttggcgagttgggattaacattgattccgaagatgatgatcaggggcgtacaataattacacttccgcgaaaagcaaaactgacacgtattagtggtcgaaataatgatgagcttttcgtaagggatttatcacttaaagattttcaattgtcagggcaggccgatcttgacatgcaggatgtcaaagttgcgtcagacttgaacttaaaaggatcaggtggtgattcaacgcttaccagagtcagtgcaccgtctgtctctcaggacacattgggcggtgatatcgattatcagaactgtcgctttgttgacaaccacagctatctatcctcagccggtggcgatatttcgatttcaaataatcagttcaaggacgtttctataaatgttcagggcggtgatttttcattcagaaataatcgaattttgaagcggttatctgcaaagtcggcgggtggtgatatagacggtcaggttcttaaccggcaacaatcgcgagtcgctgtgagtgctgaaggcggagacgttgaattgtttggtcaatccaatcattcgtggaacatggataagaagaaagctgtttcatatcatctgtcttccgaaggtggggacgttacgattgaataaagagtagactgattactttcttgtatcgtttattaaagaaactgatcggtctatttttttgattattttatcagactttaagagattggaaaatttaatttgaataaaaaaaggcgttaatgaatgtgatatactcaaaactgagatttatttcgtagagaggattgttgaagatgtttgggaacgaaggttacatgatgatcgatagggatgtgaaccgggcttttaagctgctggttagtatcattattaccctgttattatcaatttcggtggcatttaatttcgactatttgcaatttttggattcaatttttactactgcaatccaaggaaaagcgccaagtgagcttttagaaaaaatatatttgctgatatcatttttggcaagtccaaagatggatatattgtgggtgtttgtcattgcctttttcttgtggggattcaaatataaagttccagcgttatgggcaatctttacgcttggcggtggggatatcattggttttgtggtgaagcaccttgttaagcgccatcggccgccgcttcatcttggcgtagacaatgggtacagttatcccagcggccatgtacttggctttttcctgattatggctgttttgtggatttctgtgatcccgttgattaagtatgcatcgatacgttgtattttacgaattctgatgggtattgcacttattctagtgatgttttccagggtttatctgaatgcgcattatcccacggatacactgggagccgcgttagttgcatatagctggctgttaatttcagaaatgttttatgttaaatttgccccacaggttgcccgattccgctttgtcgtgaatacaaaggtttaagttgattctatgtgatttgtttttcattagggccgttgctgatacttaacggagaacagttttgagaggttttaaaattgacgatttatacacagcggctggttattcggcatcttggcctggatgattatccccaatatgctgatttaacgtcccagccggaagttgaaagcggtgcgggctttaacttgatcaataacccccagatgattcaaagtgccttaaagcggcagctgcgagcacctggatcgtacggcatttttaagggatctcaattaattggtgcaattttattatttaaacgaatcggtaaaggcggccgtccggatgatcatcatttggaaatgagttatttcctcacaccgacctgttggcgacagggttatatgagcgaagcaattaccggactcatagctaatcttcggggacatcctttggttgagtcgattgttgcggaggtatttgttgataacaagcgttcgacggcccttttaaagcgtctaaagtttgcatttgtaacggagatgcgtgatccgattgttggccgtcaaaaggtgatttatgagttgaagctgacatgacgaaaccacgtttgttgtcatatgtcgtgaattgagttacaattcttagtgttaaaaagtaaataatcagacaaatcaatgtattcgagtagaggcgcattcattaagagtatatttcaggaacttgaaaagaagttgggactgaagtaaaaagggatgagtgccgaaatggacagttacttttctgactgtctgttgggacttaatttaacaaattaaggactgtcgtggtttgaccgccacggggagctatcaagatgttgaaaaacacttaccgtctctttcaatatatttttgaaagggactttttttgtagtctgattcggatcaaaaatttagagatgaggttttagataatggatgaaaatggaaacgacggcaatggccaggttaaaaggggccttaaggcgcgtcatgtgtcaatgattgcccttggtggctgtattggtaccggattatttgttgccagtgggtctgccatttctcaagcgggtcctttgggggcgttaacagcgtacttctttatggggatgatggtttatttcttaatgaccagcttaggtgaaatggcaaccaacatgccgatttccggatcgtttgctgcctattcagctaagtatgtagatcctgctttggggtttgcgatggggtggaattattggtttaactgggcgattaccgttgccgttgatatcagcacggctgcactggtaatggcattttggcttcctaatattcctcaatggatttggagtgcaattgcgttagtcattattttatcgattaatgcaatgtcggttagggcgtttggtgaaacggaattttggatgtccctgattaaagttgtgaccatcattattttcttgggtgttggttgtttaacaatttttggcattatgggtggccatttcattgggttaagaaatttttctatcaaacaagctccctttgttggtgggtttcctgctattttgagtgtcttcgtcgtcgctggattttcatttcaaggaacggagctggtcggtattacagccggtgaatctcaagatccgcaacacagtgttccaaaggcgattaatgaagtcttttggcgaattattttattctatatattgactattttcgtgattgcggcaattattccgtatacgagtcactcactgttgggatccagtacgacagatatcgccattagtccgtttacgttagtctttcaacgagccggtttagccgcggcagcaagtattatgaatgctgttattttaacctcggttatttcttcagccaattcgggaatgtatgcgtcaacacgaatgttgtactctctttcaaatagtggctatgcgcctaagcgatttggtaagactgctgcaaacggcatcccttactatgctttgattgcaacaacggttgtatcgcttctgacatttatttcaagtattgccggaccaaagatttacatgtggctggtagccgcgtccggattgaccggatttattgcctggtttggaattgctatttcgcattatcgatttagaagggcttttgttaagcaggggcacgatttgaaggaattgaagtaccatgccaaattgttcccgttcggcccaattctttgtttgattttatgtattttggttattgtgggacaaaatccaagtgcatttatgcattttgattggacacaaattttagtgacgtatattagtgtgccactggtactggttttgtattttggctataaactgaaaaagcatacgaaaatcatcccacttgaaaaggttgatatttccccatctcacgaagaggaagatctttcaaaactaaatgataattaatctcattttcaataattggactatcccatattggggtagtccaattatttttattgtacagaacaattgcggtagagtataataactaaatagaatctaataattggtatattaaaaatatgaggtgagatttatggcaaaaaagctcctttcaaagggcaaatatcaaagaatgttgaaattaaccaatgatgaaggaaaaattgatgcattggcgttagatcagcgtggatcgttagtcaaaatgatgaaaacagcttcagaaaaatacggaaaacttttcagtatgaagatggtttatgattttaaagaagtcgtttcccgcattttaagtccgttgagttctgccgttttactggatgagcaaatgggctttaagggtattgaagcgaaagatccagacactggtttgattatgtcttatgaaaagaccggctatgatgccaacgagcccggccgactaccaagcttgattcctgatcaatcggctcagattatggtttccaaaggtgcggacgcgttaaaagtattactttattttaatccggatgatcctgatgaaattaacgaccaaaagaaagccttcgcagaacggtatggtactgaaggactggctgccgaaacgccgacattttttgagattgtgacttatgatgatcgatataatagtaaatcattggaatttgccaaagaaaagccggattttgttcttcgggctatgaaagaatttacccaggataaatatcatatcgatgttttaaaaatggaggtaccattcaacccaacgtacatcgagggctgggaggcgagtgccggtgagtcggcctatactgagaatcaagcaaaaggatatctcaaacaattaagtgatgaagcaacccgaccgtttattttcctgagtgccggtgttccaacagatatcttccagcgtgaacttaaacttgcggggagtgcaggtgcccaatttaatggtgtattgagtgggcgcgcaacttggattgagggcgtcgatctgtttgtccgcgatggagaagatggtttggttgattggctgaaacgtaagggaactcggaatgttaccgatctaaccaagattctttcggaaaatgcaacgccatggtttgaagcatatggcggcaaagataacattcaggtaattgatatttctgatttaaaataattgatactagatgttgcacccattattcagaactagtacaatatattgtgctgttataaaaacgaataaggggatttaaacatgcttgttttagctggaacgatcggtgccgggaaaacgtcactgactcatatgctgtcaaaacatctcggaacgccggcctattatgaatcagttgatcataatcagattttgccgcttttttataaagacccgaaaaaatacgcgttcctattgcaaattgattttttgaatcgccgaatggctgatatcaaaaaggcatggaaaaatgaagaaagcgttttggaccgctctatttttgaagattcattgctatttcatttaaatgctgatcttggtcgggcaactgaaacagaagttaatatttacgattctttgctgcaaaatatgatgcaggagttgccacatacttcccatagtaagaatcccgatctgctgattcacattaacatatcgtttgagacgatgttggcgcgtattaagaaacgtggtcgaccgtttgaacaaattgataacgatcctagtttatatcagtattacaaggatcttaatcaacgctatcagcaatggtatgaaaattatgacaaatcagctaaaattcaaattaatggtgatcgatttgactttgttgaaaaggacactgatagacatgctgtctttgatttgatcgatcagaaaataaaccaattagcaatttgactgcttgtgatttggaaaaaaattcgttataatcgagacagattaaaacgttttgtgcctattaagtagattacagagagacaatggttggtgtgaattgttatcgaatattccagcacaagttaatgggcgggtaatgccgcacggttgtatgccgttaccatactttgagagcttgacaaaaatgtcgagaacttgggtggtaccgcgaaaagaatccttcgtcccagtgacgaaggattcttttttgtcggcattgaaactaattatgttggctgttgatttcaaaataacttgatgatactgaaaacctatgaggaggaacaatttacctatgcttgatattaaaaagattcgaaaagatcccgattacactaaggaaaaacttgcaaccagaggagtcaaagctgaaacaattgatgaactactgggatttgacgccaaaagacgtgatttgattgtaaaatccgaatcattgaaagcgactcgaaatgatgtttcagataaaatttctcaattaaaacgaaacaaggaagatgcttctgaagccattgccgaaatgaaaaaaaccggtcaaacaattaaggatttggatgagcagctgcaccaaattgagattgatgaaaatgatttggcagcccacttacctaatattcccgcggatgatgtgcctgtgtccttaacagaagatgggtcagtggaattacgaagagttggtgagacgccttccttcggatttaagccaaaacatcattgggatattggagagaatttggggatcttagatttcgagcgggcggcaaaagtttccggtagtcggtttgtttattatatgggtgatggtgcattgcttgagcgcgccgtttataacttttatttggatcaaaataccgaagccggttaccaagaggtgattcccccgtatatggtaaacggtgcctcgatgtatggaaccggacaatttccaaagttcctggaaagtaaagccggttacgaaatcaccggtactgatctgacgatgattccaactgctgaagtaccgcttgttaactattatagaaatgaaattattcctgaagaaaaattgccggtatcatttactgccttatcaccagcttttcgttcagaggccggtagcgctggtcgggatacaaaaggattgatccgattacatcaatttaataaggttgaaatggtgaaatttactaagtcggaggattcttgggatgcgttggagcaaattactcatcaggctgaagataatttgaagaagcttgggcttgcctaccatgtcatcacattgacaaccagcgatatgagtttcacggcggcgatgactcatgacttagaagtctggttccctgctcaggataagtatcgtgagatttcgagttgctccaatacaaccgatttccaggcccgcagagctcatattcaatatcgtgacgaagatggaaagcttcattatgttcatacgttaaatggttcgggattggctgttggtcggaccgttgcagctatcttggaaaattatcaaaatgaagatggatcagttacgattccagaagttttgcgaccatacatgcatggcaaaactaaaattgaaaaacaacattaaaaatgaaaaaaagttaaaattaaaaaagatagctgaatttttctaacgtatataactatgtaacccaaattaggaaccgactggttaatgacttgggctacaaattaattgcttcgagatccccctctcactgcagttagtttaatcgttatccccctaattcttgaaacgcgaaaacgatttgaccggattcgtcggagagataagttgagattggaactttgacttgttccaatctctttttttatccaaaggaaagacagaaacgagtccgtactttaagcaatttggtaatcagtacctatatctttaagcctatgtgataaaaggaatctggatttgttatttttaaaaaaatgcaggattcataaaaaaattcaagaaaattaaaaaatgttctggtaaagacggacagaatacgctataatatttcttgtcggaaattcgttaaacgctttcgataccggctcagacaactaactaaattaaaattacttcttgacttcgagtgagtaataatggtaaaatttaatagttgttttgatgttgtaactaccaacaacatatggattcatgaatgttttcatggaggattagctcagctgggagagcatctgccttacaagcaggaggtcacaggttcgatccctgtatcctccattgagccgttagctcagttggtagagcatctgacttttaatcagagggtcggcagttcgagactgccacggctcattgccagttttttacaatgcgggcgtggcggaactggcagacgcgctagatttaggttctagtgtcttatgacgtgggggttcgaatcccttcgcccgcatagaaccattatatatgccgacttagctcagttggttagagcgcttcactagtaatgaagaggtcgggcgttcgaatcgtctagtcggcattttgcggaagtagttcagtggtagaacatcaccttgccatggtgggggtcgcgggttcgaatcccgtcttccgcttcctcggtagtcctaatatcgggaagtatcgagatacttaaacttaatagttattttgcacccatagcgcaactggatagagtgtctgactacgaatcagaaggttgtaggttcgactcctactgggtgcattttttattgccatgaatttgacaactggcagtctcgggaagtagctcagcttggtagagcacctggtttgggaccagggggtcgcaggttcgaatcctgtcttcccgatttttttgtctcatagcagttatatgtgatatattgttattgttaattaaatatacttgattatcgggaaatagctcagcttggtagagcactacgttcgggacgtaggggtcgcaagttcaaatcttgttttcccgatttttttgtctctattttggctctttgtcaaacatcctaaagtaagaggtatcaagattgtgacgacaatcttgatacctcttttactatacttaaattgaggttgaggtcgtcaacatcagtggaatatacattccgagt

SEQ ID NO: 432 - DNA, 7482 bp, Unknown
  Metagenome-assembled genome
aaatcgaattgttgccgagaaatatcgctttggtaatgatgactaaaatgttgcatatgatcaccaacttttttgacagtagtttatcaaattattgggtcaaaatcaaagatactaaacagcttctaagagcgtcattgactggcttggcagacttatcatcaacttttatcataagttcaaagcgggttttacgttcggtcagcgtgagcagtgcctggtcatcacgagttcgtttgccagccaccgtgtcaatctcccagtgaccaaattctttgcgagtttgaatctcagcaggccgctgttcaatggattgtcctaaaaccttctgattctttcggcaacgagctgacttagtatttcggcgaaccttttccaagagatcaacgtttctggttcgcataaaatgacgatcaatccagttatacaaagtcgtcgtgcaaggaatttggtccaaagggaaacgaccgtttttttcgcccgaccgataatggcatccggagagtggtgggacactaacatctgttcatcggcgtagtcgataaacgccgtattttggctaaagagacacggacgatgggagtgctgccgggcctgatcatacttttcctgagcaacatcggctaaataaaccgagtgttcataagtgtagactttcccgttttgggtttgacgggagatttggattgtcgtgccccgtttaatctcattattgatggtttgggggactcgttggagtagcctggcgatttcccgattgggcaacggcttgggcaatcgtttataagcttcaatctggcagcgttccttaaaagataagtgttcccctttaatagtagatgtggtattctcaagaggcgtcatagcgattttccttttcattaaatgtgttagaactttaatgatacctgaaaatgcgctatggcgtattatttttttaaaatggctaacttcattttaaaatccaccgtaatctattagctgcaaatgactagacattttttataaaaataattctgtagacattttaagtttgagttcagaacaattttccctaaactcccagcatggcgatcggtagcacatgaacctgatcgttacttctagtgtaagcaaactggcccgtatttaataagactttggtaaccttgaattcatttttaaccaaatccgcaaaccagttaagatggcgaacgtagctgtcctttgcttcaggatcagccttgacctcaaataagattagagagctacccttctgcaagataaaatcaatttctctagtcccgcgttgatctcggaagtgaaagagtttcgcatcatcagcgtctgcataaacaatgaggctttgataaactagagattccaataattgaccgattaaattttgatttaatttaccaacatgtttagggacttgatatgtggttagctgttgacgattaacatctaataactttaacgcaatggccggatcgagcataaaatgtttcggggcccgagctaaattaggataaagttttcctactcccaaaaacggtgggacttcatcaataatgtagagaatttcaagagcttcccgataactattggctgttggtcgagtaggcgcttcactattgttcgccatcgcagcatcaatgattgtctgaaatttagttggtgtcccaaccgaagctgcataagccttcatccaagctaataaactggcaggtttcttaattttaaacccattctcttcgaaatcgtgatcaacaatgtttctaatgtagctgcgcagtaataagtcacgagcatgaggagctttatcgcgaattccaggaaaacctgacctaaagatctcatctaagtaatcattaatatcttttttggtttgaccactaatccggtcatctttggtcaaattaaatagcgtttgaatatgtatatagtcagttgccatgcctctttcttgaatggtaaaaggccgtaatttcattcgaataatacgaccggccccactgtgaattcgagaattaacccgaatactactgccagtaaataaaacactgccatctgacaatcccttatctacttcatgccggacaaaagaccacatttccggtgctaattgccattcgtctaataaaacgggcttctgaccacgtagaatagtatcgggagctccttttagcataagccgggtggcttcgttgtctaaattatagacggtctgagcaatttgagtacatgtttcagttttgccaaccgctttagcaccttcgactaagatggctggaagttcttgtaaatcacgtttcaaaggctcatcaataatccgtttctcgtaaattataatcccctactttacatttttgtataactgtattttacaaaaatgatactacgtattttacgtttttgcaaccttatattttgcgtttttgtaagttgttgtcgtttaattgttgcaaaggttggattctttccttgtttattaaaacgaacgtatgattggacttttgaggctaaaccatcaattataaccttatgtaacatctcaaagccaaatcaaaaaagtttctacctaacgcgttgtgctagttgtgtcacattcgtaacaattgaattagttttttgagctttaagcaacccaaagccccgcatacgcggtaacttcttaggtgactaaaccagaaagaaggaactgttatgcgaggcctcctcaaagttatcgtaaaaaccaatccaattcaagctaaatttcaacattttatcgaaattattgaaccgatttatgaaaccattaatccggctattcgtttccggccaaattaccgccagctgaaagccgatgatgtcattatcctggcctgcatgttaatgcggattgaagaacgggacggttccgaaacctattttcatcaaaaattggttagctggggaattactgtccctgaacgctcccggtataaccggcgttgtcgagatttagtattaataatgaaattcatgcgggtcactttattgagacagtgggtcccacccgttacctatgaaatcattgatagtgcgccgattactttggcagctactcgtcgaagcaatcaggccaaggttttaaccggtttcgccaacaaaggctataatgccaccaaacagacctattactatggctttaagttacatgccgtgatggccaaccaaggctactttctggcctgggaactgacgccggcgtcccttgatgatcgaaaagccgcggaagaactcttattaaccgcgcccgcgcgacaggtcttagccgatggcggttatttaagccaaccattaaaagatcggttggccaccacctttggcattcatctttggacgcccttgcgcaagaacatggctgcccagacaacggtcgataccggatttttgaaaaatcaacgtcggcatattgaaaccaattttaataatttagatacggtgggccactttgaacacccgggaattcgaaccatgtccggcttggagagccgcttagaagcgctgttactgtggcacacgattcgagttcatgaacaactcgccgctggcaaaagcgggttaagacttggccattactaaccaatatttcataactagcacaacgcgttaaattacaaaatacttgtaacatgtaaattgctacagaataattaaaaaagtgccctccctaccggttaaagacatgtcaatatcacaatgaaatgccattataccagtagatagggcgctttttcaaaaaaatagggaaatatagaaatagggaaaaggggaaaaagggaaataccgcaatttccctttttctatatttgtaaatactagttcaacagtttcataaatccaactgatactgtcttttaatgcttcttgaatttcctaatattttatcactagctacttagttttttatctgtgactaaaatcagatattaaaaagggatatttcgctattaagaaatatccctttagggaaatagggaaatatcgtaatttccctatttttgacttctaaatttaagcatggtttcatagatacttctttcttctggattcaattcgttcacatatgaatctagcaacaattgaattatttcataatcgaatttcattgattcaatttctttcaaaatatctaactgagtttttgtttcggtagaaattttaattgatttcttttgattcttaaactttgtttttaaggttttatgatcatttgaatttgaaaattcaaaactttgttgaggcttaaagtttttggtgtggtttctcaataggggattacctttcttcacaccctttaaaatgtcatcggttgaattatcacttgccattatttatcctccaattctccatagactactattctgcgaacaaattctgctgtaattctttcgtataaatctaaaacacgtttgtcaaatctatctttttcagtaatacctgttaatttaaatctcttaattcgttccatccgcggaataactgttgaaaaaatattttctcttccaaattcactagttgccgttgctaaaacagacttatcaactgtccctcttttattcattatcattggcaaaacgcccaagacttggacaggtaagtcatattccgttttcaacgaacttaaaagagaaagatactcttcagctccatttaaagaatcagcttctgtttgaagggcaatgagaacaaaatctgaaaaaacacaagctgctgttgaaatctctttgtttagcggtggtgtatcaattaaaataacatcatactgacttctaagtggttcaaataaattaggtattaaatgatctgcttcattatcattttttgtcgttttccaaagatactttggataatcagcaaaatctgtagagcacggtaacaaatacaagtcatctaaaactctcattggtaaatcttcaacatttccctgtgttacacccaccattaaagttttttgaattacaagaacatcatcattcctagcagaccgtgtaagtattagatgttgagataaattgttctgaggatccatgtcaattagtaaagtcttaataccatattttgctaattgataaccaattagttcggtattggttgttttacctgcaccgcctttttggttcccgctagttattacaatagcgcctttatgtttttttattgcttcaatatctcttacgagtattgcagaatccatacgctcatctccttgtttagattgtatcataaatagggaaattaggaaatagggatatttccctatttccctatatagaaatagggaaatattaaaaaacatttacactctgctatatatacgataaaatagagggcgttagcagttatcagagagttaacaaacaaactaaaactaatttaacaaccgaataaagagattaagctaaacagaaaaatccccgattcacgaggaatcagggattttgggtttagcaagtagctaacagacagctacttagattcagtcgatttagaccgccaagttaaaatcgactgaacattgttcttaatttgtagattaattataccgcaaaccagtcccaaaggacaagttaaggatagttaaaaacaaattaaagtcaatggactaagtagctaaccagagctatttggtccattttttgttgttaaaacttaaaaaagttgccgactgggcaactcacaaacagacacatgctggtaaattacaaagcctcaagtctaaatgaatgctttgtaattcagttagagcatatcagatttgtattgtaatgcaagtcgaatgttttagcaactctcttttgagacagcgtgtgtcagtcaagaaagggagtttttattatgacaaaatcaacagatttcaattactatgaagccgataacgtatatggagccttattcttccagtttcctaaggtattaatgtatggcgagcaatacagacatttaagcaatgacgctaaattagcctatatggtcttaaaagaccgactggagtattcattaaggaacaactgggttgatgaagataatcacatttactttatttttaccaaccaagaattgggaaacctatttaactgctccgaacacaaagtcatcaaaataaaagctgaacttgaatcaattggtttactcttccaaaaacaactaggtttcaacccgaaaactaaaaagaatgaaccgaaccgcctatacctgtccaagcttgatgttcaagctaccgacgtctatttgcgcggcgaatatggtcaaaaagacgcgcaatcccttggtacaagcggaactgcaaaaaatgcagttccgcataagactgctgaatcccttggtataagcggaactgcaaaaaatgcagttccgcataagaccgttgataaggacgcacaatcccttggtacaagcggaactgcaaaaaatgcagttaatctagatctagaacgaagtgatagagataaagatagatacttaatagatactccggagttagacttttccacagctaattactcacaagctgaaattgaacaacaaaaccgggacctgattgaaaacgcctatcactttctcacccactcagaaactaatgacattttcttagaacccgaagccgtccaactgatcagtttctgggcccgaaccccgcaacaaatgcggcggtttatcaaaattattctcaacgccaaatacaaagttgagaaggagcaccaagatatcggcgtctacatcatcttagatgatccggagttaaaacccctaatgacccaaaccctccgtcgctattttaacgtcctccgaagcaacgagaaacacgtcaaaaacgtggagaactacttgtacggcaccatgcaaaacctatttgggatttggtggaataaacaagcggctagagaatatgcggccaaacaccccgaagaacagaacactgacaatgagccttattggaattaaacgccgtataagctcatttaagccgttttaagtgttacatgcataattatattaaaatcgctttaaaatcgcttagaagcaaaaatagacaccttgagtggctgaattggcgcttggtggaataaacaagcggctagagaatacgtggccaaacaccctaacgatgagcgtgcttaaaactaaaaagctatataaggccatttaagctgttttaaacagatagagcataattatattaaacgagttttaaaatgcgcttacgggcattttaggaacgttgtataagtgccattgcggaaaggacagcaaacttaaattcacaacttttaaagaagcaggataattaagctagcactcaaaagctagtataatgtgagtagtgaataaaagggggcgagaaaatcatggcagttaaggaaaagaaacgcgtacaagtccagattgacaaagaattggctgataataccgaagcagttttaagcgagttgggtctaaacccaactaccgcaattaacatgttttataagc

SEQ ID NO: 433 - DNA, 17458 bp, Unknown
  Metagenome-assembled genome
cagccctccattattcatcttttttttttcctctttgattaaatattttcgtttccttatattgccggtagctgctgattgatcacgttcggctaagaacacaatagcagtttcggcatttggttttgaattccgaccttggtattacttagtttgtaaaactaatagattcgacgaagatgggatctattttaagagtgaggtagggacacaatgaatggatcatcaggctcaaattttacatgcatgtgttagcggcgaccatcgctaaaaactacgttttcaggaaatgaacttgcccggcatttaagattgtccgtttccgggctcaggtataacaatattttgaaactggaacgttgtggtcatcaaattgatacgaaaaaggtgttgggatattgctatgagcagtctggatgtttaaattccaagtcattaatcatattcgcacgacaacgtaatccggttgatgtccgacagttgacaccttacttcaacatgacctgtgcagttaaaactgttttttacggtagcgtcaagaatcttgtgtaatgaaacgccttcgtacatataatatatatctaacttaaataaatgatgcttccaggtgtcctggagtcctttgaacctcggtggagatccgcttcagagacttctcgttataaaacattaactgagaaaccagagaatgaccggcgacgtggtttacgttgataagggtgtgcatcttatttaaagagagtgatcaaatcagcggttagatcccagaatataagccagcccatctaatattctggttttgaatattagatggactggcttatatggccgggagctgctgatttgatcacgtttcggctaagaaacataggcgagctgtctaatattctggttttgaatattggatgggccggcttatatggccgggagctgctgatttgatcacgtttccgctaaggaacattggcaggctgtctaatattctggttttgaatattagatgggctggcttatatggccgggagctgctgatttgatcacgtttcggctaagaaacatcggcaggctgtctaatattctggttttgaatattggatgggctggcttatatggccgggagctgctgatttgatcacgtttcggctaagaaacatcggcaaggtctcggcattctggttttgaattccgaccggacttatcttatacgtaaaactaatagattatcgacgaagaatgggatcttgatttaagagtgaggtagggacaaatgatggatcatcaggctcaaattttacatgcattgttagcggccgaccatcgctacgtttcaggaaatgaacttgcccggcagtttaagattagtcgtccggcagtgtataacaatattttgaagctggaacgttgtggtcatcaaattgatacgaaaaaaggtttgggatattgctatgagcagtctggatgtttaaattctcaagtcattaatcattatcgcacgacaacgtatccggttgatgtccagacatttgacaccttaacttcaactaatgattttgctaagcaattttgcagttcccgagttgtgactcgtgcccaggcttttgtgactgacacgcaaactagtggtcatggccgcttggggcgtcatttttattcacctcgtcatagtggtatttacatgagtatacttgtgccaattcaaaatcgggataccattcattctggtttaattacaaccagcaccgccgtttgtgttgttcgggcattaaaacaattttttccccaagtcgattttcgggttaagtgggttaatgacattctagcccatgataaaaaatgtgggggcattttaaccgaaacgatttccagcttagaggatggatcccatgaaaatgtgattgttggtattggtttaaacattgattctaatcattatccagatgatattaaacataaagccggctcaattgtgagccaaagccaaattgatcgcaatcgaatcgttgccagtattattgataatttcttttatatgtatcagacttatcgaacgggcagctttttaaaagcctattctgaactatcggaaacgcttggccaaaagattgaggttgttatggggacaagaaccattaccggtgttgcacgtcgttttaatgatgaaggcgcattggtgattcaagaagaaaatggtaagttaatcacagtggctagtggtgaagtaactaaggtttatttaccggaaaatggctatcatggttagccattcttttttgatagcatggttaacccaaactcataatttggttaaccattaaaataataaatgatgggataattatcaatgaaaataaaagaaatcgttcaaacatcgttaattgctgcaacaatcattattttagggatgattccaccgttgccactaggaatcattccggtaccagtggtaatgcaaaatctgggaattatgctggctggagcgttgttgggatcaaaacgaggaaccatcgcagttgcacttgtcctgttacttgcattaattggttttccggtattaagcggtggttcagcggggccggctgtttttgttggaccaactggtggttatctgtttgggtggctaatggcaccttcaatcatgggatatggtctttcacagccctttgtcaatcgcgcatggtcaaagatggctgttatttggctggttggcgtcttatttgttgatttggttggctcaatttggttatggctagtcagcccgatttcattggctaattcactgatctcaaatttggcctttattcctggtgatacgttaaagtcgatcgctgtttatctggttgcggttcgggttcaggcattgacgcatgtttctacccgctagcctaataagattatgtttttgggcacttttttattaataataaaaggaggatgggataatagtcatttatcccatcctctgttcgtgtaaacacgattgttaccgagcgaaaacgcgggacaaaaggcaactcccggccgtttaactgaattatccaaatattcaagttcagaatattcggataatccaattacactctggaagttaaacgccttttgccccgctctgcttctttattattgaattaaattaattttaaataaatggcgaataattaatggaagaagacgttgagaatcataaccatgccaatcccgacaacggaaatgatcgattccaaaacggtccatgtttgtaatgtttgtttgatcgttaaatcaaaatattctctaaacatccagaaaccagcatcattaacatgtgatgcggcaagtgaaccagcaccaatggcaagaaccattaaggcaggatcaacacctgactgtgccatcaatggagccacaattccggcagcggttaatgatgcaacggttgctgatccaagggcaattcgaagcacaaccgcaattaaccagccaagaattaatggtgacattgacgagcctaagaaaattttggcaacttctttaccaacaccaccatcaatgaggacttgcttaaacgcaccaccaccaccaataactaatagcagcattgcgattgatttaacggcgttttcaagtgattccataatttgggcagttgttcgctttcgagcccaacccattgtccacattgcgaagaataatgaaattaacattgcgatacttggtgatccaatgaattcaatgattgaatcaagcatggatggattcttaggttcggcgccgccattaaccgtcattttgtaaattgtcgcaatggcaagtaagataacagggaacaaagcggttaaaactgataagccaaacgacggtgacttttcaggactgtattccttgacttcaccaattgaagaaaggtttccctttcgatcaaaagcagccggagcgaacttgcgggcgagctttgagaacaacggaccggcaatgtaggcagcgattaaagcaattacaaagccgaaaattaagacacgaccatcatttgcacccaagacttgcgcgatggcaactggtgctgggtgaggcggcaagaatccgtgggtaactgacaatgcggcagccattggaatccccaaataaagaattggaacgccagcctcaacagcaattgcgaagacgattggaaccagtaaaaccatcccaacttcaaagaataacgcaatccctaaaataaatgatgcgagcataacggcgatttgcagccgcttgcgaccaaatttattaatcaaggtgtgagcaatcatataagcaccaccggaatcggaaaccagtcggccaagcatggcaccaaacccaaagaccattgacagttcacctaattgacttccaatcccattagtgattgaatccgcgattttaccaagtggcatgcccagcataaccgcggtgattgcagcagttaataccaacgaaacgaaggtattaattttaaattgaataattagaaccagtaagataatgattccaattaaaagtgcaattaattgcatatcatcgatcccctttcaatttctataaattattttaaacgataaactaacgacccggttagcttagaattccccgtattgttggtcatagaaaatctaaccatagtctgctagccaaaaagattactgttctttgctggaggaagcatccttttgagcggcctcatcttcatgctcatgacgacgctgataatccgcgatgttcttgtattcgggttcaagtgaccggcttaaccggatataaatcggaatgagctcgcgataagcagtaaagttctttggatttggatggtggacaacggttgtcccgacaaatttggaaacatcggtcaaactgtcaatcaatcctaggctatacatacctaaagtggcagctcctaaagcggtactttcaaagctttctggaatggcaacgtcctgctcaaaaatatctgttaacatttgtcgccaaagtgcagaacgggcgaagccaccattggcctgaatactggttggccggccgacaacttcttcaagcgccagcataacggtgtacaagttataaacgattccttcaagaacagctcggatcatgtgtgcccgagtgtgagtccggtttaaaccaaagaatgatccccgagcattagcatcccaaattggggcacgttcaccacccaggaacgggaagaacagtaacccatcagaaccagcagggattttggctgcaatttgagttaacaagtcataaggatcaatgtgcatttgttctgcagttaccttttcaggggcacagagctgatcacgaacccaacggaagacaacaccaccattgttaaccggaccaccaattacccacatgtttttggccaagtagtaacagaatactcgggcctttggatcagtgtggggcttatcagtaacaaccctgacagcaccggaagtaccgattgtaacggcaacaacacctggttgaatggcgttaacgccaaggtttgctaatggaccgtcggaggctccgatgatgaatggcgtattgatatcaataccaagaaccttagcgtattcttcatgcatcccttttagttgatatgtggtgtcaaccaattccggaagttgatcgcgtgaaattccggcaagctttagggcttgatcgtcccaatccaaattatagatattaaacattccagttgcattggcaattgaatagtcctccttcaaaacgccgaatagtttatggaggatatattctttaatcccaacgaaccaacgagcctggttaaataagtcggcgtgatcgtttcgcagccaaattagcttagtcaacggtgtcattggatgaattggggttccggtatgttggtagatttccattccttccgggttggcttttaatgcatcagcatatttaacggcccggttatcgccccaagtaatggcgcgggtgaggggcttgtagtcatcatccaacaaaatgagactgtgcatggcacaggaaagtgcgaccccctttaactcacctggcttgagattggcttttcttaagagctcggtaatcccatcagacattgctgaaaagatttcttcgggatcttcttcggccatatccggcgtatcttggtacaatgggtaaccattattggcgtaaccatgaacttttcccttaacgtcgtagagaaccgttttcacactagtggttccgatatcaacacctagtgtataatccatttatatgacttcccttccatgattggtttagtaataaaagcagctggtcaacacattaattagttaaaaaaataatagctgatccatcgtttaaaataagcaaaactcagagctgacacggtaccgcttccaatttaatctagcatgttaactgatatacttcaaacaaatgcaacaattattttataatcaaatgtaaccgcccacaacgtttaactattatatgaaaaacagtttcacaatgcaactattttgttgtaaaatatttacatgaaaagaattcggcttctataggaaagatgaaaggtgatcaaaatgagctcgccagttcaattattaaaacaatcattcgatgaattaagtaggaccaataaaaagattgcaaaatatgtcattgagaattcgcaagctgcttcagaggcaaatattgaggatttggcagaagtaacggaaacatcaacggcttctgtttcaagattagttaaaacattaggctacaataatttccgagaatttactttagcccttgcatatacacagcttcgaccacagaacctgccaattttcaaagatatagacgctaacgacactttgtcgacaattgctgataagatctttaccagctcacaaagagcgctcagggacacgagagagggcattgaagagtcggagtttgcccgttccgtattaagaattattcattgtcgtcgattgggactgtttggcttgggaggatcgtcggtagttgctctggacggttatcacaagtttttacgaacttcaattgactgtttttattatccagactttgacgtacagctcatggaagctgtaaaattgggagagaacgactgcgcaattgtcatttcccattctggcaagaatcggcaaacgttgaagattgccgaaacgttgaagaaacgacgggtaccaattattgggattacgagttatcgagattcaccgctcgcaaaccatagtgatattacatttatttcttcaagtgatgaatcgaattatcgctctgaagggatgtattcattgcttgctcaaatgacgatcgtcgatacattatttatgatggcggcagttcgaatgggaccagcaactgaagacacaattcgcaacgttcaaaatattattgaaagtacccgtggctagtataagctgcgctaactgagatgaccatttagatgaagcgtaaagatatccaaccaatatatgctgaaacataccgaagacgtaaacgcacgcgtaaggttgtgttcggcatttttttgttgattctggtgctgggatcgataggttacgcctggcgatggcatcaaaaacaggttttagaaaaatacccaatccgtggtgttagtattaatcaaaataatggttatattgactttgaaagtttgaaaaatcggggggtccgctttgtatacatcaaagcgactcagggcgctgcctttaccgatgatagttttttaagcaattttcaacgcagccaaggctctcaattgccggttggcgtttatcactattttagttttagcagttcaccaactgctcaattcaaaaattttgtgcggcaggtaaagtttaataccggtagtttgccaatttgtattacgatccagtattatggcacttataacgaaggctcagtccattggcagtcggctcgtaagaatatgaggtccttagtacacaaaatgcgacgttattatcagcgtccagttgtcatttcagcaacgcgcagtattctttcacgtcttgaaattcaggcgagtgccaaacgtcaattttgggtaactgatggtcagctaggacgaccaaatggagatgcaacgtttctgcaggcaactaataagcaggattttcgcttggatcatcaggttgttttcttgccaatggctgtctttaacggaaatacgaaacagtggcatcagtatttggatgagcaagtgggaagttagtaaaagacagagggcgacacaaggcggttagcctccagaatttaaaggacttcccgcaatattctgggcttgagaatattgcgggaagtcctttaaatggccgggggctgccttgtgtcgcccgtttcaactaaggtaataatcagatgcgggcttgagaatattgcaggaagtcctttaaatggccaatggctgccttgtgtcatgtgtttttagttgagcagctctcccaaaattcgatttggaaatcatggggtaagggacttaacctggctagaattttaaaaagccagtttgattgaatactcataaaggcacctacattttagaaaagcgataaatttttgggcgtaaaaaaagattgaagcaaccttgttatttgtttcaatctttgtaatctcaaattagttattcgaataattggttttatttggccgggccggtcatcttggcctgattcttaccgttgtaaagatcataggtgtcattttctgattcatcgtaaaatttaattggccttgcttcatttccccgaatttcaagcttgtagccaaatttatcaatgtatgataattcatatctggtaagtgacgatactttagctgagaggttctcgccatcaatagttaactttaaatctgggccaatttgaattttgtgaactcgatttcgtcgatccgaaaagaaccatgttccggcgaagaacagcgggtcaacggttgacgggtcccgtttggttgacttaggcgcatgaaacagcccaatcaaaaaagaaattaaaaaaatgatgatacttcgctttcgcatgataaacatcccctagaatatattcgatactcattatagcggatttagttaaccatatggggtaattcaagtgttcatttggttaaaagcttgttacaattcagttaaaggaaaggtggtcgttaaaatgattgagttagggattattgggacgaattggattacgcagcagtttgttgacgcaatcaagctggctaagacttatgaactagtgagtgtgtattcccgaaaactggggactgcaaagtcctttgctaaaggtaatggtgccaaagagacttttgatgatttaaagaagttcttcaaggatggaaaatttgacactgtttatattgcatctccgaatagccttcattttgagcaggcaaaattagccattgaaagcggtaaaaatgtcattgttgaaaaaccggcatttagtaatcaaaagcaaatgactgaaattcaggaattactatccgatcacccctctgttttgttttttgagggagctagaaacgttcacacgcctaattttcaagcaatggaagatcaacttggaaaaatgaaaattgtccaaggtgctgaatttacttattcaaaatattcatcccgttatgataaagtactgggtggcgaagaaccaaatgtcttttcgttaaaatatgcgggcggtgcccttcaagacttgggcgtatatacggcctatgatgctgttgctttgtttggaatgccggaagaggttgcttactttccgcaattgattcgaacaggggttgatggcaagggaacggctattttgaaatatccagaatatacagtaacattgaatttttcaaagatttcgaattcaacgatgccatctgaaatttatggattaaaagattttattcagcttgacgatgccggtgaaattgaaaaggtaacttatactgatgctagtggggaacagcatttgcttagtggtgaaaaattagccaatccaatgttacctgaagcccaggattttgcccgcgtgattaatgatccaaacaatgaacaaaataaaaaagattatgcatattggtgtcaactgagtgtttatgtgaataaactccttttcaatcttcggcaggatgcacatatctcgtttgttggtgaccaagattaagaacggagaaagaattttgataactgaatttgaagaacatgccaaggcacttggatataaagattttaccgcaattcaaagggcagtttatcaacctttagctgagggtaaaagtgtgttgggattagcaccaaccggttcaggcaaaacggttgcctttgcgttgccgcttcttgaaaaaatcaaatcggaagatggtttgtcactattggtgttggaaccatctgcagagctggcaatgcaaacacaacgggtattgctggaatgggggcagctgattggcctttcggtggaagggatgattggcggtgtgaatattaaacgccagattgaccgtttaaaaagccatcctaatgtgattgtgggtacgactggccggattacgaatttgattgatctaggaaagctaaaattggattcagtgcagtcgattgtgatcgacgaggcggataatctcctcagtgaagaaacgttaccggaaattcgggctttggttgattcagcaccggaggcagcctcgttgggattcttttctgcgactaaaagtgatttgctttcacatattaaccgttggtttgttcaagatattttgacttttgatgttaccaaaattgatgatacgcagggaaatgttaagcatgggttattagaagtttcaaaccataagaaggaattaatgttgttgagattcctgcatatgaaagactttaaggcactagttttctttgatcagatgaatacgctacagaaagtgtctggctttttgattcatcatcacattcgtgaagctgccaagttgacgagtgagcagcggcaaacatcgcgacaaactgcattgaaggattttcggaagggaaaagttcgactgctattaacaaccgacgttgcggcccgtggcattgacatccctaaactaccggctgtgattaattttgatttacctaaggacccaaggacttatgtccatcgagtcggaagaaccggtcggatgcatcaagatgggttagtcattaatatgggtgatgatcatgatctgcgaaatttaaaacaattagttcgtggcgatggttatgagctaacaaagatttattttgatgagaatcagctttcagatacacgcccaagtcacccagtggaaacgggagattcggaagcgaaacaaaagaaacatgtcaagaaatcatctgatgatcatttaaatcatcgaaagccagtttctcataagtcgccgatcggccatgagggtaaacggaagcacaaacattccaagcgtaaggggatgcattacaaacggacccagaaataatttctctttacaggttaactaataaatgagaaaattaaattgtgtttgtttttggccccatagcacaactggatagggcacccgcctcctaagcggttgatcccggttcgagtccgggtggggtcagtaaagggaccatgcgggtttaagaatcattaatgatgacggactgcactaaaaaggagtcctctagagcaatataattttgttctggagggctcctttttgtagcgaggctcgcgaggaaactcggcacttcagtaccgagaggaaagcgtcttgcgctttctggtttccgagcgggcttttaaattaaaaatgcttgtatatgcaaaataaataatggtataatatgcttataaaatagtgatgaggtgtgttgattatgcaaggcaaatctaaagatttacattatgcgcgaaccagtgtctactcgctacaatatcatctaattatcgttactaaatatcgacgtggtgttttagttgggccagttaagcaggaattggaagaactacttcgcagcttagccagtcaatttggtatgaagattgagaaaatagaaattatgcctgatcatgttcacctgttagttgatgcagttcctaagtactcgatttcgtcaattatgaaagggttaaaaggggttactgctcggatgctatttatgcaccatccggaaattaaaaataagctttggggtggacacctgtggcaaccaagttactttgccgtaactgttagtgagcgttcagaagagcaaattagagaatacattcggcaccaaaaaccaaacccagccaaggaaagtaaggataatgatcaaattacctaaaaaaactgaatacttacgggtgcgtcgctatcgtttggttcctacttcgcagatgattgcccgttattgcaaaaaccttgaggttcttaacaaagcgcatcaatatgccgttaagtatctcgagaaaacttatggttgtaagcacttagggcgtccctatccatcaacaaagaaggctaagatttatgtcatcaaagataaaattttgcccggcttcttacacgatgtttatgggatcgacaagtgggatggtaaggtcgtcccaattcactcacaagcgttacgtgatgagtttttggttactgtgatgactaatttcggtgagtaccgtaaggtactcaaaaaagctgccaagatgaccgataaagagaagaacgcctaccggagcaattgtgatcgaaacaatccacagcaccggtcttggtatcgcaaagggtcactatcttatcttcgcagtggtgctagtcataaaaccgttgccttgcctgataacggtcaaattgaggtgcgatcaccgcactggattaagattcaagattatggcgaaattcaagtggttgagaatattaagcacttagcaacggctaagattacgacctcgaaaatcaaacgcaaagatgatgggacttacgaactgcaattagtactcaaagaccaaattgaacggaagaagcccattagcatgattggtgctgactggaatatgaaggacaacaaggtctttcacacttccgatgatgagaaaatctatctgggttatcttaaactcactaaccggcgtctgattaatgtcggtgctaaggcagatgaatacgaaacaatcattaacggactcaagcgtcgccgggctaaaaaggaaaaacaccttagcaccgatagtcaacaacttgagagattgagcattcaaatccgttactattctgcccgacgggtaggcttacttacggaacggtatcgccagattgcccggcagatgtttgatcattacgatttaatcgccattgagcagttagacgctaaggaaatgcgaaaagaaaaccgaaagtggtcaaaagccgctaaccatggtaagaatcggaaactggccaaagtcaaaccttacgaaatatccttactgctcaaacaagtagctgaccgtgaaggaaagacgctcttgaaagttgatagttacaagaccagccaagttgaattcggcactcagtaccaggagaaacacgatccaaatggcgaacgccaatgggtgtctaagtataccggaaagttaattgatcgtgatttaaacgccagtcgcaatattttgacttgggcgttagagcccaaaaaacacattaagtatttggaacggcaagcaaaaattaaagtcgcaaaaagggctggtatcactaaagacaaattgcctaaggcaattccggccaaggcattagtaacaatgaattagttgatttgatcaacgggcggggcagaacctagccgtccttaaggctccaagagttactgttggcgtatcaccctgagcgtgcaaaacgggtgcgaaacagtcattaagatctaattgatctcagcggcgttagccgttgcatagcttaaacgttttctaagatcaagaggcgcttagcagccctttgatccagaagctcggtcatttatgaccgagtagttcacctataaatgaataagtaatcgaggctactggttagtgtcgtcaactgcaaggcgatcaatcaccgatcgatgttgtgggtacctggttaataatttttctttagaaagtagttcgaaatcacgatagtcaaaaccgggtgcaaccatgcaactcacaaaaccgaagctatttgaatcgctgacttctgacgcaaaaattgtctctttgggaactttgaactgcagtcgctcacctgattgaatgttttgccccaatttaacggcttggtagtggccattcggcgaaatacaatgaattgtgatgccttggccggcgtgaaaataccacagttcatcatggttgagacgatgaaaatgggaagggctggtactatcgagtaaaaaataaatggatgtataacgatatcgttgaccaccactttcaaggtcaaaatatttgtcctcactgtggtaaatttgttgataccaaccaccctctggatgaggtgttagttgaaattgtctaatgtagtcttctttagtagtcatggttgaatggcctccgaagttatttttattagaatagcatatttattaagttagcacgacaactttgccaaaactatcaggatgatccaaagttgcctgagcattaggcgtatgtgcgaaatcaaatactttggtgggtttaacgttgatgtgatgatgagcaattagaccaatgagatcattaaatgttttttcgttcacagtgtctgaactgaagatggttaggtaggcaccagaagggatcttaaatggatcaaaattgttcatcgtccatttcggatcatccatcccacccaattcacctgtattacaaagaatgccgccagaattaagcagctgaagtgaattaactaatgttgccgggccaacaagttccaaaattgaatcaaagtgggatttagtttggagataccggttgctatccagaattgactgatcaaacccgactgcttttaattgagccaatttatttttgttacgagtgctgccggttgtgctgatagttgggttcatcgccttagctaatttcatagcagcaatgccaacaccacttgtggcagctctgatcaataatgaattggcctgttgaattttcattgccagcaatgagccataggcggtgaaataggtttcgggaatagctgccaattccggccatgacaaatgcgtggtaactgggtaaatattgttattcggtaaaagggcatattgggcataactgccatcaaattcccggcccatcccgtgcataagtgatactactttttgaccttgcggaagccgagtggggtcagttgattcagcaatcaccccaacaccttcaattcctaaaattcgtggaaaaatcactggtgagtaacccagtcgggtgaaaatttcagaacggttaattccaaatcctttaattttaacaagactccaaccagcccttacttttggagtggtaacatcttttagctgcagctgttccgggccaccagcatgactaattacaaatgctttcaaagcagcatcttcttccaattcatattaagttaagcttagtcctaaggttgatcatttgccaatgaaattttgatgaaaatggtcaagagacaagaacgttgtgggttgctgataacttttttgagtagcccattgattgtgaaacttggttcagaggattggtttttccaacctcacttgtgatgtcggttacaccaacatataatagtcttggtttctaaatttaaggaggatatcattaatgaaaaagtttaaatttcgttggttgggattacttgccgttgttggggcagctgctgtgattttaacggggtgtggtcaaaaatcatcatccggttcaaaagggccgctgatttgtgcgacttcgggaacattgtacccaacttcgtttcatgatgaaaagagtaataaattaactggatttgacgttgagattgttcgtgatgtagctaaaaaaatgggccggaaagttgaatttaaggaaatgagcgttgatggtcaattaacggctgttaagtctggtaaagctgacatggccgccaatgattttgcggtttcacctgctcgcaggaagcaatttaccttatcaactccatataaacattcatttgatagtctgattgttcgtaaaaaggataattcagggattcattcttgggctgacattaaaggaaagaaagcagctggagaagctggtaccaactatcaacgtttagctaaacaattgggtgccaagccggttaactatgataatgtttccaatgatatttatatgaaagatgtcaaaagtggtaaaactgatttaattatgaatgattattatctgcaaaaattggcgttggctgctgttccaaacaatgggttaaaaattttaccaaatatgtactttagaaccaatgaagatggtaaaggcagtggaattattatgaagaagggtaacactaagcttcagaagcaagttaacaaagctttggcatctttgaagaaggacgggactcttaagaaactatcagaaaaatattatcatgctgatgtttccaagcagcctaaagttcatatttcaaggactttcacgataaagtaggcgatgtggttggacgttcttaaatatttttcaattccaaattttttcaatgcgccattagctgttcactcaatccctaaaattatggccggatttccaatgtcgttatggttaacggtggttagttttggttgtgcgctagtcttgggcttatttttaaccttggctcagttaagtcattataaattacttcactggcctgcccgggcgtttatttcatttatgcggggcgttccaatgttggtactattgtttattatttactttggttttggcgcagatgcattaccagcagccattattgcctttacaattaattgtagtgcgttcgtttcagaagtttttcggtcgtcatttagtgctgtcgatcttggccagtgggaggcggcttattcgttgggattgccatatcgaaaagtaattgctaaagtgattttcccacaggcattccaaatagctattcctgctttgggcaatattttactcgacttattcaaaagtacgtcgctggcagcaatgatcacggttagtgaaatgtttatggatgcaaaaattgtagccggcgcttaccaagattacatgagtatttacattatgatggcagtaatctattggttcttttgctggttgatgacagttggccaaactcagttagaacactttttagctcgttagattatagcaggtgcaggggtggggtggctgttgcgctgttcggataaatagagtgggccagcaagcgtttagaccccagaatataagccccctgacttgatattcccgattttggaatattaagggtctaaaatttttggggttgataccgtaaggtatcaatctttttttgcatataaatagggcatcgccctactattgaattagccaataattcagatagaaagaagtaaaaacgatgtccc

SEQ ID NO: 434 - DNA, 82786 bp, Unknown
  Metagenome-assembled genome
acaaggtactgttaaatggttcaacgctgataaaggttatggcttcattactactgacgatggtgacgtatttgttcacttctcagctatcaacaaagacggcttcaagtcattagacgaaggccaacatgtaacccttgacgttgaagacagcgaccgtggcccacaagctgccaacgttactgttgttgacgactaattaaaaaattaaaaagttttttaaaaaccgacgagagatcgtcggtttttttgtgcttacagacacaagccctgcattaactaactcctcccgttaaccatatacccctaaaataattaatcgtgttcatttaatacaaaacgcggtatactaaatttggatattatataaaggggtatattagttatggaaataaataggtcaactgcttgcagaaaggtcattttaataacgagctttctggctactttgatattaggctttctggtcgttaccgatcatacatatgctgatgttcagtcacaaacaacatgcagcgaaacaacgtctcaatcctcatcctcggagcaaacaattgtctttaaggaatcggcttccaacagcgataatgtcgactcatcaactgacacgacgctcaataacacttcggatagtcaaagcaataatcaaaatgctaccacgtcaaatcaatcgtccacaagtggtgcaaccactcctgcaccttcggaaaacacggccgataccagtcagccaacgtcttcagtaaatggttcaagcacaccagaatcgacatcttcttcatcagaaagcgccaatgcaagttcttcaactaatgaatcgcaagttaacaatccatcatcacaagacgtgaccggtactgcatcatcgaaagatcaaggtcaaaccaacaccgattctacaagtaatgatgttgattcaacaactggttcaagtcctgtaacggatcaatcctcaagtaccgacaacacaacgaccggaggaaccgataaggatcagatcaccgttacgggtaccaatagttcaactgatcccgcaatcaaacagtccagttccaatcccttactcaattggttgacaaatatgaccagtgccggagctgctgccttgatttatccatttatcacttcccgccaagggtctcatttattatcagaatttcgaacattattatcccctacccgctacaacattgatcaaacctggtcggatttggatcaaaaatataatcctgactatacaaagcaattctacactgatgcccagaactggtatgataatgaggttaaaaaagaaacgttaacggttccgtttgcggacggcagcggaaatgcctcggcaacttatatcgctcatccgggttcaagcaaaacaattatttatggtcagggttggacaaccgagcccgagtggatgggatacatttcgaaaattttctatgacatgggttataacgttctaatgccttatacccgcgggcaaaacagcagtgatggcgagttcctgacatttggatacaaagataaggcagattggattaactggatcaataaaatcgaccaactaaacggtcccaacagcgaagtggtcctttatggccagtcacttggtgccgatgacgctttggaagccggtgcacaaaagaatctaccatcatcagttaaagccgtcattgccgactgtggctactcaacgatcccatctcttctttattcgctttatacaggggcagccaacaaactaaacggctatacgtcaaaaatcggctggaacctcaatggatcgatcccactagtgccgtatgatcaatttctaaacaatcttaataacgttaaccatcttttccaaggcttcaacttggatgatgcctcaggattgacagccgttcaaaattcaacactgccaacgttatttattgcgacggccgatgacaccttcattccggattcggaaaccaaagctttgtataatgccagcatttctaaggataagcagctatggatcctggatggcaatgttggtggccatgcctctgccaataatgcagtgctcgcctacacccagcacattcaagattttcttaacgctgttgataatgggcaaaccagttcaacaacttctacaaatcaactaacggttgacgacaatcaagcagtcgccgcttaaaaccgtttatatatcatgatgattaaaaagatcgacttccattttcggaagtcgatcttttattattgcaattcccttaatagtcgaacgacgctctcctgataaccaataccgaacttacctaagtgaagcattaaataataaagttggtagaatggcagtcgattttgatacccttcatctaaaggatattcatcttgatagccttgataaaactcggggtcaaaaccggcaaacacttgactgacaccaatatcaaactcgcgatctccgtagaaaactgccggatcaataataacgggctgcccattttcatcaaacataaagttgcccgaccaaaagtcaccatgcagtaaggatggtttagaatcatgagttcgcattaactgtttaaacctaaccagacacttttgatacattgcttccatacttcccgtccacaaatgcctcttgagaataatctttttccgatattccaaccgctcgttaataaagaatgacggccagtccgggtaccatgtaccaccatgatcagacttaccctcgggatcgtcgagattaaagccaaattgcccgttagcactcgttcttttatgcatttgagcaattacccgtcctaaggcatattggtcgccaaatgactgagaatcaatatagttaagaagtaaataggcattgctttcccaagtaccgtttgctaagacacttggaaccatggctgtttttgtcagcaacttcaagccaacaatctcttgcttataaaagtcttttgtatcgctgggatgcagaagcagaaaatactttttaccattttgaccgactagcttataagctgaattaacatcgccaccaccaactggctgagtgctgataatcggtccgatcggtaatgtcgccaaaagtgctttatccaatatatgtgtcccctttccaattctcattctttgatgtcaatcctagaaccaacttcgggaatttgtcaaagggatcaaaataaaactatgttagttaaaaaactatgctttggcttgaactgtggcttgctttgctgcctgcttcttatcctcgtccaaaaccgattgaatatagccatcaacatcgaatgtcccagagaattcagctagatgaaccaaatttctcaagaagtcatgagtcttggcttcataatgatacttcaatcccaaatcataaatataaccgttgatgtaatcaacttcggtctgccgattcttggagatatcttggtacatagatgggaaatgcaatggatttgagacacgactgacgtatgaaacagtctgccactcttcttcacgggtatttagcaaggtaatgcccgctcgttcacaaacatcaaatgcctcatcaattaattgaacacccaatttcttggccactggcgattgaatatattcacccatgcggattttaaacatggtgcaaagcgtattaataaccgagttgaaaataaccttagccattagtgttcccaagaagtttgttgtcaaattagggtttaagcctgcttgcgtaaactcatcaacgatttgatgtgtcatttgatccggcttttcggtttcattggcaacattcattgaaccggcgcctttaggaccgataaaatcaacatcacccgccttattcaaaaccgttccgattaaagcagtgccgccaagaacacgctctttaggaaaatattgatttagtttttcaatatgtcccataccgttcatacaagtcacgacgtattgtttatcgttaaagaaacgggcacttcgtttcaagaagtcgtctaattgatactgtttcgtaaagacaatcaagacatccggatcacccttgtattcttcgggataataaacatttaccggtaccaaatgccggttctgaccatctcgggaaacgtagacccctttttgctgacgaattttctcaacctggtcctcccaagtatcaacaaaatcaacatcgaatcctgcttcctgaagcaaaacaccataacgcaaccccattgcacctgcacctaaaactgtatatttcatatttataactccctttcatgtcatcgctatgtaacaactattcaatcgtcaacgagtcaaccaaataaaaagtcgcccttctgtcactaagacaaaaggacgacaattggccgcggtaccaccttcatagatacgctgttcgtatccactcgttgacatgctttaacggacaagtccgaaaccggctaactgctaaaaacagctcaccaatctagttaaagaaagcatgaaagtcacgatccgcaaattcaatgtcatctctcagccgccgaatgacttttctggtaattgaataggacgaatgcttctttcaaattgatacttcgcattatgagatttaaataacaaaatgtcaagcatactttaataaaaagtgataaaaatgtgaacgctagtgtcttgtaaaaccaagaaaaagaagcgccgtaattgacttttggcgcttcctttttctttaaaaattattttttatcaaacccgtttcttataataaaccatgccgccaattgcagccatcagcaataccaatcccaaaataatcagttgctggttaatatcttctcctgtttgtggcagggctgctttaccggtatatccttgcgaaggaatcccggacggtgcgtctgttgaagaccctgatccactcacaccattgctgccgctaatcccatcagcaccactcgtgttatctgaagtgttaccaggcagtccttgcgctccttcaagcgtcgcgctgccgtcatcactatcttcttgtccaggaagcggtgcggttccttcaagatcatctttaatatcgttatgatagataagatggtctgtgcctgccgttaccgttcccgttacggtggtacttggcattgcaacacggttcttcgtcgttgttgttacatatcccatcgactgataatcctgttcggaaatgttatacgctgttccaagcggcatgcttaacttaattgtctgtccatgcgttaattggaaggttcctttgccgtcaactaaggcaatttgcccaatctctgaaacaccgtttttaactttttctacttggaaaataccattcagataaccgccagcaccatccttcatctcaatgttaaaagtaaaggattgttttggattaccaaggttgttcacaaatttgtcaataatgagcgtcccctcggcaggaaccatatctttggtgttagtaaatgtgacctttcccgcttgatctttcaccaacttaacgacgtcagtcatcatcccatcgtatttacctgcactattaacttgataactcgcagcaaacccttcagcgaatgcctcaccaatctgataagtgctgcttattggcagatctttaatcagaattgattcgtcaccttttagataaataggtgtcgactgtccattacgaattgaaaccgttacttcttcgctatgaccatttctggcgatcttggttgctttaaaatcaccataagcatttgtataaatcacaaacttgaaattgcgattcttatcagcttcggaaagtcccgttccagccaagcgcttggcaatttccatagaagcagtttctgatttttccttatggttgacaaaattaaccagtccgtttttcccatttaccattttaaaactttcagttgcgttaccagccgttatttgtccaccattcacctgataggatgtactgaaatcggcaacctttgtttccgttacctggtaatgatagtcaatcggaagtcccatgacacttaaatattccgaagatttcaacgtcaaatcggcaataccgtttttaaattcgagtccaacttcttccatgtgaccattctggcttcgcatagttgccgtgaacgtttcatttaaggcaatatccgatttgattcggaaactgaacgatctctgtaaatccaggttactaatgccgtccccatctacctttttatgaatttcaaggtttgtggtttccggtgagtttttggcattatagaatgtgacatgtccaaccttatcatgctcaaggccaagatattctgtgacttctttttgatgctcggctcctttatcgattctgtaggacacgttatagtccgcctgcatatcctgcgcaatgatttcgcgaaccgaatacttgacgttagttggcaagccctggaatgccatagattcgccatcttttaataggacttgctcggaacggccatcagtaaacttgattcttagattttccttatttccatgctgatctctcttaactgcttgataggctttatccgccaattcgggagtcgttgtgacatagaattcaaattgacgatccctatctgcaggtgttaactgatcacctataaccctcttggttatctttaatcctcctgccagtttttcattcatgaattggaccacggtcttttcatcttcgtgaagtgtccaattaatcgtttcattaccggttacctctgcgttcgtattgatcgcatggctggtcttaaagtcggcttgcgatgtctcaataactttgacctttgcgccgtctggtaaccctgtaatcacagccctttcatccccgcgtaattttaaagtactcagttttcccttatcaagggtaatcattttgatattgccatctactaaggtgacagttcccgattgtttatgattttcccgatcaataatggtgatatcaaactctccgtctaatttgcggtcttccttatctaccacatttagcttgaactcgaattctgtctcaaaatccgtttcagaaagggctccctttaagacctttctgatttccagtgatgttccaggacgatggtttttgaagacaagcggcggtaggcagtttgttccacaatcatcggctgaaccggttgtcacttgggcttctttgccatcattccagttgtcgccaccatattgatgactgacatgatagtcatcaccaatgtcctcagtgattgtcatcttcaaccctttaatcataaagaaggtgattgtttggccaactttgaatgatactttggcatgataaacattgcctgcggcttttgagaacacgatctcctgctcatctgtttcaccactcttgatagccttaaacgtttttttgtcaccccattcggaatttggatttgtaatcgttaagtcaaattcaaatgccttgtcctttggaatatcaagtccacttgctactttcttaagcgtaaacggtacacaatccggtggtgtatttcggaacataaccgagtttcttcccttttctctgttcaggttcaaagtaacgtcatcaccggcacgctcgaattctccatcgatgtggttgtaaacggtccaatcacccttttgatagtcaatttctttaattttaaattgtcccgcatccgttggtaatcctttaacaatcaacttctgattattttgaagattaatcggttgtacgttgggttggtcaccaaatcgcaacccggttgctttaccttgatcattaaacacaatcttaaccgttaaatgaccatgaaccgattctcccgttgcggcattaacaattgcaaccacatagtcgttgctcttaaccgcattccgggtttcttcgttgccggctgttacatcaaaagtaaaagtatcattggtatcccggccggaaactattttctcgaactcgaattgattttctttgtgttcgttaataaatttgacatgactgcctatggaaatcggacccactacatgaaatccgtcatgatcaacttcgaccgctttttcatcaccgttatttagcttgtaaaatgttttgctgtagacatcatcgtgtttttcccgaacaacaagctgaacatttcccggaagcttaattttacgataactttcgccatcctttagcagaatgtctttgtcgccaagtaactgggtgcttttaccgttttcaaacctaaactgaacgtctgtatcttggccattgttatgcttaattcctgaaactaacgaattaaactcttcgtacaacttgccatctttatatacttggagttcaaatttgaattcccgatctttatcacgatccttattttcgccccgaatcgcttttgaaaattcaaactcaccggaatccaaggtattcgtgaaagtcacaattccgggagatcccgaatcgtcaaatgccaagacatcggttttcttcgatccgtcacctgccggatgggtaacgttaagttgcctaatactatgagtcgttttatatccatccccgttggtttcaataacccggtaataggcattgaccggcaatcctttaatcttaaggatttcaccattcttgatcccagggaggccttggctcacaccttcgataaaggtcacttgagtggattgcatttcaccattaagttctacatcaaagcgaccgttaacactttcatctatctttccgtctttgtcggtaaactgaacctcaaacttaaattgatcatttcgtgaagctgggtcgctggattgaacgtttttcttaatgatcagctcattcatcgtcggattttcaaccttaagcacgtgtactgtttggccattagtcaaatcactcatcctaaattccggagacgtgtaatttgcatagtatccactcagtccctgtgtttcaacgattcgatagacggctttatcgccaagattgttgaaggacgccattccatactcatccgttgtctcaaccatatcctgtttctcgttattgccatccagatactgggccggtacccatttttgagtggctttatcataccgttcaagcataaacatgacgccttccaaacgtttgcctgtcttggcatccaatttaaccacgttaaccgcaaatctttcataagatccccacgcactggtatcggacttaactttttcttcctcaataatcttttcgtcaccatattccaaggtcactttattttcaaaagaactattggcagttgaagtctctctaaccgtgtagtattggaccaatatcggttgaccatcgatcacgtctttatcaaatgtgatggtcatattatccagcgaatcggaataatccagcttatacgagtcccgttgaattttgtctcccgcagtgtacgttactttaccatcgtcgccaattgatcgatttgctttgaataaagtcaattggtaggttggatcatgtgtaatcaaatgatggtgggtttgattggcaattgagtcggtcactttaatttgtttggaatcaatatttcgaccatcaccgttaagaaccacctgccattttatggctggtaaagtccgttcttccggggccggtgaaatatccattgactgaccgctcttatctaaaaggtgaccattgtctgtataggaaacagtagcctcagttgtccttttaccattctcatcaccatactgtcccaaacctgaaagcgtaattttattacggaaaagccattttttaaaatgctcatgcttatcatcactaaaatcgagagatggtacttgagcttgaaaattaagaacaaagaccgttttcccggctctgtattttgctagcccactttctgttagttttaagttgaatgttactttatgattctcgttttcactttcgtctttgtcctcaacaattttataatcatttttctccaaaagttcggcttcaccataaccggaaccgtcattcgctaatttagcaagcgaaatctttagacttcctaataggtttgaaatatcttggagtgttttatcattcgacacatcgtcattaccggtcatttgatcggtaccgacaatatcagtaatgtctatcccgtcttctgtaagaagctttgccagtgcctcgccctcacctaaataacccatgtgattaaatgacactttccagtcaatgtgacgaccgtttttttcatggaagttttcactcaatcttccagttttggttaagtgctgacgcataaaggcgggaacgcctctccacgattcaacgatattgtctccaccgttataactgacctgcgctcggttaacaaacgagaatggtggtttttttgcaatagcttctttatccagaggaacattatagtaaccgattccgaatctataatttgtctgattctcaccgggaagttttttaaccgtcagcttgatggccttcgtagtgtcgttaaattcaatctcaaatgcttcgtcgcttgttccttcccaataaaatttgccattcttgtattcatactgatattctttccctgaaacattattttcaaagaatcttagatagtttttagcatcttggtatccgttactcgaaagttcatgataaaattttccaaaatcaagatagtcaacatcaccgtgaggctccgtaatcacaaagtcgcctgtcactttccgattaatctgattaacgttaatgccccaatcagtggtcatttttgaccaatcggccccgagactttgcttggtatcaatcctcgggttttgaattgttgaatatttttcctgcccatcccactgaacaaagttttttaaatctttatagtcagtgctcgtagcttcatccttgggaatgatatcgtaataaagataatgggtaccctgaggaatattcggcttaaacttaattgtcagtgtggcaggagagccctcttcaccagaaatttccgttgcttcaacccaatcctgataaacgtttcccccttcaccctttattttgagttcataggaatcggagccgacagctgcaaaggcaaacttctcactgcctaacctatctgtcatcgtgaaattcttcgtgtcttcatccaccgtaaatctcacttcatatcgaacatttccacccgattgaacagttgctttcttatccaattgagtctttgcccgtgtaatgctggcatccgcctgtgcgctggtaatctgatggccaccgatttggctatccgttacttgaatcgtattgacaaattcattttgagcagccctcgtaactgttccaattgtttccaaaacaattgattcaatcttttcgccttcttcaagaatccctttttttaccaattctgctgcttcaaaggtaaaatcaatttgtcgaccacttgatgcatgactaatatcacttagtttcacctgtttagcggtagttcctttattaccggtaacgtgaatgatatagtctgccggatctttgtcaattccgtattggtatccttcaccaaatgtatcggttaaaacaactttatcagcggcagccccgtctttttccactttgaaagttgatttccaatgaagtttattgtagtcaacaactccctcgtcattataaaagtcgccatccttttttagactaatagtagccttctcaacttcaatttttgcatcttccccggcaatttcaccaaaggaaatttctgaggcttctttgttaaacgtagtcgttaaactcgccccataggagatggtggaatgccccggcgccttagccgttagaaaagtaatccgaatatcgtgtttgtcagagacggtggttcccgcaccatttttgtgtgggctaacggtaaattcaccaattttaacaccgtcggcaacaatttcctgtgtcactttgtctttgccgtcgtagtcaaatttaaaaccgcttaacacaaagtcataataatcgccgtcttcaatttcaaattccggtgaattcatttcttcaatactggttgtatcccagtgccaagtaatcacgttcttggaactgccgtgaatctgttcaggaatcgtaaccgtttggccatcgccaagcttagctggaatatcaatggtttgattatccattcctaaggtaatctttgaaaagaactgtgtatcaattttatcattcagactttgaccggtcctagcggcaaatatttgggcattctttacctcatttcgaatattcgcccccttactcggaacatcaccatccgcatcgccggcatcttcagcatccgcctgcttcaacgcttcacttgtggttgtgacatctcgatcaattgctacgcttttagcagccttggatgaaccgggggttgtcgctgcattatccacgactgacgaagaagattccgccacttttccaccattgtcatcattttcggcaatcgcttttttattattaacggctgcttttttctgatcatttttccgcttttcttcaagatagctttggctctttgtctgattggattgagatatactccccgaagacttctcactttcatcggtagtcgattcagacccttttgactgtgactcctgagattgtgcctgagccttttgaacctgtttttgggtttccttcatcctttcctgttgcaacatgttgttaaccttgtcttccgactttaggttgccactcgatgaacctgcttgattttgtttcggcttattttctttcgaaacaattgtcaaaaatggtaatttaaccagtttatggtcaaccgcaaccgtcaaccgatgttgattcatagctcttctaaatttaacgggcagctttacttccatatttgttcgaccaacagcgtttcgccagtgaatagttgaatctttaccatccacatcgacaacaaccaccgtttggccatttgtatacttgtaccgtttcttttttatcgttaaactttcttcatcgtacccgaatgttacagcaccgcttttcgatattgccccaaccgttaaatcaaatgatagctgggctctgtctccaactttcgaattagaaacaaattgctgatgctgattaacaaactttgcattttccacggcaatttcatctgtcgaaactgcatccgccaaggcttggccagcagtgaaaaaattaccaatcaacagagtcaaaacgccaatgacttgaataatgactcctctttttttaatccacatttccaggtcctcctaatggttttaattagcagtatctaatcaacactataagagtaacaagaaagtttggctttttttaaaagaaattgtgacttttatatattgtttccaataggccaacttttaatttatgacttaaaactattcaccaatggccgttgaagcaacagacctggcctcattaatgcatattcctagcgtattttaagaaaatgaatcagtcatcatttgaacataatattgaagaatttgtgaagaattattcaactatgaatatgtacaaaaaaattgcggcaacgttatttatttgccacaactttttaaattttatctgtttcccatatttcgaccacacaacacatcgtttttaactacggctgatcgctatttcggataaactgccaaccggtttccggagatcgtcaccgtttgaatcggcttactataaaaagccgataaactggtttcattcagtacgtccttccgcttacctgcttgaataacctgcccctggcgcaaaagtaacacattattaaagcacggtaaaagctcttcagtataatgagaaaccaaaagcagcaccggtcgattaggcatccgggaaatttgcgcgacccgtttcagcaattcttcccttgcgaacaaatccagcccgttacacggttcatctaagattaataatttaggatgagccatcattgcccgagcgatcaataccaattgacgttctccctgagacaacactgcatattgttttcccaatagcttttgaccacccatgtcaattaaggtttggcgggcttcgtctaaatccgcttgagaaaattcttgatagataccaatgctggcaaactttcctgatagaacgataaaatctaccaaatcacccgtatgaagctgatcttggagagcgttactgacccagccaattttggttttcaattccggaatattaatatggccgaataccccaccgagcacctccaaattcccagaagttggccacaaatctccatgaatcatttttaacatagttgttttgccggcaccgttcaatcctaaaatcgcccaattttcgccttgattgacctgccaattaatatgatgtaaaattttctttttgcctcgggtaaccgagacatcgtcaaagcgtaaaattctttccataagcggcctcctaaatgtatatgtattcaaaaggactgaataaaccggagcggtttttattcagtcctttcgtttaattgcttagttaagcgtgagttgtgatgctcacaatcgatccgcaactttttccgagttagttagcggaagttcatttatcatttcattcaatcaatgcacaaagccagctatgcctaatgatcagttagcaaacttgtagttaggcaatcttacttttcagcttctgctttttcttcagtaggtgtactgtacttgtcggcttcaccaacaaatgacatgtgatcacgaagatcagcaccaacacgtgaaagaagtgagttagctgaacgttcacgcatcttgtaaagcttcttgaagccgttacggtagtcatccatgaattctttagcaaatgaaccgtcttgaatccgcttcaaagcgtctttcatagcttgcttggattccttaccaacgacctttggaccaactacatatgaaccatattcagaagtgttcgagcagtcagcatacatcttgttgaacccaccttcgtagataaggtcacagatcaatttcatttcatgatctacttcaaagtatgccaactgtggtgagtatcctgcttcggttaagacttcataaccggtttcaatgagcgcggtaacaccacccataaggacgttttgctcaccaaacaaatcttcttcagtttcttctttgaaggttgtcttcaatagtccggcacgtgctgcaccatttcctttggcgaattccttggataaatcttcggcatggcctgaatagtcttggaaataaccatataatgctggaacaccggagccttcaacgtatgtacgacgacaaagattacctgggcctttaggtgccatcataacaacatcaacgtttgctggtggtacgatttctttataatgaatgttgaagccatgtgaaaagcctaatacattgccttcctcaaggttaggtgcaatttcatttttataaacatcacccataacttcatcaggcgttaacatttgaatccagtctgcacgacgagctgcttcggctggtgtgtaaacatcgaatccatcgattttggcattttcaaatgattgtcctgggcgaacaccaacgataacgtcataacctgaatctcttaagttgttagcttgggcatggccttgagatccataaccgataaaagcaattttctttccttgaagataattggtggtaacatccttgtcatacaacatttctacactcatactgattcctccattttttatgttaagtattttttctgaaacaattgtcgtaggaacttaaactcaatttagtaatgaaaggcctcacctcctaaaatgtggtcatccttagaatccaatcatgtcattattcttgtgaccaggtgctaccattgggtaaacctgctcatcaaccggtacttgaacttctaccaaagttgatttgggatcatcgaagacatcattgagttgttgctccaacggttcttccggatttaactgctgataattaatgtcgtaggcatcagcaagtttcttaaagtccggttgatgatcaaataacgacttggagcgatgatttgaatagaaagcatcctgccactgtctaatcattcctaatgcatgattattcaaaaggaagattttaacattcaagtcctcagcggccaaaacttccagctcttcactagtcatttgaaagccaccatcccccacaaacagaacaacgtctctgtcacggtttcctaatttagcgccaatggcggctggcagaccataccccatcgtccctaaaccacctgaagtgacaagttgtcgggcatgcttgaatggatatgattgagctgcccacatttgatgttggccaacgtcggtcacaacaattgcatcaccattggtcgcttttccgacggcctcaatgacttcatgagggttaaactgtcccgcagccggtttggcatcctcgggattttcatctttccggtcttccaccagctgattccaagcaggcgtctgcgttttggctgctgtactgcggttcatttctgttaatgctgcttttgcatcggcctcaatcgaataatccgcctttaagattttgtttaactcatgcgtatcaatatcgatatgaacaatcgtcttattatccgcaaaatctgaagcttttggcaccatccgatcatcgaatctggaaccgatattaagtatataatcgctttcggtcagtgccatgttggcagcatagcttccatgcataccacccattcccaagaataacggatccttgcttgggagtataccaagtcctaacaatgtagccacaaccggaatgttccagtcatgaacaaattgattgaatgctttggttgctccggcggcagccactcccgccccaacaatgacgactggtttggaagcactactcaaggcatgaagtgcggcttcaatggtcgcttcttgggttttccccaattgttgtggttgctttgcccgtttcgtcggcgcattttgttcaaaaatagcagattcagaagtaacatcctttggtaaatccaccaaaacgggacctttacgaccactttgagcaatttcaaatgctttagtcacaacactatgtaagtcgttcacatcctgaacttggaaattggctttggtgatcggcttggtcacactcacaatatccaactcctgaaaggcattggttccaattgcggagcgagtaacctggcccgtgaaaacaaccaacggaaccgaatccatttgagcatccgcaattcctgtgacaacatttccggcacccggaccactggttacacaaacaactcccgtcttaccggttgttttggcgtaaccttctgcagcgtgaacggcaccttgttcatgacgggttagtacgttactaaacgattttgtataaagtgcgtcatataaaggcagaaccgcaccacccggatatccgaacaaaaaatcaacgttttgttctgctaatgcatcaaccaagatttcagcaccggtttcagtcgcggttgctggctttgactcttctgcaagcatatctgattcacatcctttcaaaacaacatgtgtctaacaacatcacgtcaagctcacaattgtttaatcggtgaataactttttcgtgatggttgaaatttaacacggaagttataaatttgtcaacacccaaattaaatattttctaatctgtttctcacgaattgctttgaaaacggtgtcacagtcgtgatctgacgctcgtaaaattatttttaaggattaaatttcgataggattcatgtgagaacttagcgaaatttaattcttgcctattgacaatactagctttttgaaacaagtcaagacttaattttaactttttttacatggtgatacatcaccttttggcgcattatatgaagaaaacaattcaaactttttcaaattaaatttatttgataaaatttgttgcattcttcacaacctgtggtatagttagcgaaaagttaaaaaatgagaatttgattcaggaaaaagtaacttgtccgactgttagcaagagagtcccggtatgctggaacgggataacaatcaacgagtgaaagtagatccactcttataatcaaaaccggcactgcccgttacccagccgtgtataaacatcgcacgatttgagacagttagttccttaaccgtgaacaaaggtggtaccgcgttaaaaacgccctttgaaaaactttcagagggcgtttttatttttgacttttttactttgactaaacttttagattttgatttcagaaaggaatgatgaccatgacgactagcataatcccagctgcagcaaatgcgccaatgctgaaatacttcgaatcacaaggatttaacgaactttatatcgataaggactcggtggaaaaccaattaatgggtggggataccaaccgagtgttaagtttatcggattacgcgcaatacttacgttgcatgagaaatgctaccagtgctcacttattggctgacacttcttttggtggcgacgatgcgacgaattgggctgacactgccgacgaactggttcgttgtggtgccaacacaattttgattagtgattaccagagtaaaacgaccagtcaccaaccaaacctactttctgacgaagattttgaggctaagatccgaactatgaaaacagaattaacggacaccaacacgaatgcaattgttaaccttggtggtttttcagtatacggtttggaaggtttgacaacccgtatcgatattgcccgttcccaaaatattgcaaagatttcaatcagcaacgtcactgcaaaggatctttcaatcattggggccattatggagccaaaccaagagattggtttggcgatcgataacccaaagatgacatttggcagtgcgcaacaggttaaccctgcatttgtccttgacacctatcatcccaaaaaagccacgcagcaatgggtacagaaagctggtccttcagttgttctgcgcctttacatgggtaattgagaaatatgatgatctaagaggatgaaaaccgggaccactgtcaatttaacagtggtcccggttttttattttgagaaaggaaagtgattttatgcaaacaagaaccgtcaaactaacagaaacagatgtgaaaaatgcgtatcaggtgttaaagcccatcgtcaaacataccgcattggagtatagccgctatttatcggaccgttatcatgccaacgtgtatctcaaacgggaagatcaacaactggtccgctcattcaagcttcgaggtgcctattacgcgatctctcaaacccctgaaggaaccagaaaagccggtgtcgtttgtgcaagtgccggcaaccatgcccaaggcgttgcatggacctgcaacaaaatgaaaattcccgcaacaatcttcatgccaacgactacccccgcccaaaaggtcaatcaagtcagatacttcggcggtgattacgccaccatcaagttaattggggatacattcgacgaatcggcaaacgcggcactcaccttctgccaagataacggtcagacttttatcgccccgttcgataatttaaatacaatggcaggccagggatccattgcggtagaaatatttgaagatgccaaaaaacaaggattaacaattgacagcctctttgctgcaatcggtggcggcggcttactaagcggcatcagtacatacgccaagtacacaagtccgaatacagaaattattggtgttgaacccaatggtgccgcctcaatgaaagccgcctttgatgctggtaagcctgttgaactggaggcccttgacgcctttgttgatggcgcagctgttagaaaggtcggtgagttaacttatgcaacctgccgggcaaatgttgatcgattatgccaggtaccggaaggccaggtttgcaacacgattttagatctttacagtaaaaccgccattgttgccgaacccgccggtgccctgagtgttgccgcgttggaagcaaacaaagatcggttggtcggcaaaacagtcgtatgcgtcatttccggaggcaacaatgatatcaaccgaatgcaggaaattgaagaacgctcattgctctataatcagcagcaacactacttcatcgttaattttgcacaacgagccggtgcacttcgcgaattcgttagccatgtcttaaaccccgatgacgacatcacgaaattcgaatataccaagaaagtcaatagtaccatggggccttgtctgataggtattcgcttgggaaatgttaataatctggatcagctcctaaaaagaattaagcagtttgatccccactacatcaatttacaagaaaacaaaaccctataccgcatgctagtgtaatgttctaataatcatcaatcagtttctcataaaaaggcacggcagtgaaatgattaaattcactgccgtgccttagttttgtcaattaatcacatcaggcgaaatgcttgacaatgaaaaataaatgagaataaacgtaggggaattcccctattttatccaatcactgtttacaagtgagattaattataataagcttaatgcaattcttagacaagtgaaaggaaatcccaacaatgaaaaaaacgaatgccttattattacaaattattgttctcgtcgtgattattattagttagacgggctaatttgtaatgagcccgtctaaccaggcgggcggcattggtggatttcaagccaagagctgttcaacacagctcttggcttttattttatccctatatcaagtcaagaatcaaattttggtgtcaaacacaccactacatatcagagaggatgatagttaatggcaaatacacttgattttaacgcagaaggagaaggtatccataaacgatccgacaagatcaaagttggtgttgatgaagcgccctcaaaaagcttactttacgcaacaggccgagtaaaaaacgaacacgacatgaagaagccgtttatcgcaatttgtaattcctatattgaaattgtgccaggccacattcatttacgcgcgttagccgatgttgccaaacgagccattcgtgaagccggtggcatcccatttgaattcaatacaattggggttgatgacggtatcgcaatgggacacgttggtatgcgttactcccttccaagtcgagagattatcgccgactcagcagaaactgttattaacgcccattggtttgacggtgttttgttcatgccaaactgtgacaaaatcacacccgggatgttaatggcggctgcccgaacgaatgtcccatcagtctttgtttctggcggtcctatgagagccggtgttgatcccaaaggccgtgcgacaacactgtcaaccatgtttgaagccgttggtgctttcaaaagtggcaagctttcaaagaaaaacctgctggaatatgaaaagaatgcctgtcccggttgtggttcatgtgccggtatgtttaccgccaattccatgaattccctaatggaagccttgggagttgcacttccatataacggaaccgcattagccgattccgaagaacgaaaggaactcgttcgaaaagccgcaaaacaggtcatgtacatggttaaaaatgatatcaagcctcgcgacttaatgaccaaagaagcattcgatgatgcttacgcgcttgatatggcaatgggtggttcaaccaataccattcttcatggattagcgatcgctcacgaagccggtatcaaatataacttggacgatatcaacaagatcagccgaaaagttccgtacttagctaaaatcgcaccatcttctcactggaccatgcaagatgttcatgctgccggtgggattccagccatcttaaacgaattaattgaaaagggtggcattttacatcctgatcgaatgaccgttaccggaaaaaccttgcgtgaaaacgttgaaggtgctaaaaccaagaatccggaagttattcataccgttgataacgcctactccaacgttggcggactatcagttcttcacggcaatctggcccaagacggcgccgttatcaaggttggtggggttgatcctgacattcgtgataaaggcaagtttgtcggtaaagcaatttgctacgattcacatgatgaagccgttcatgggatcgattcaggcgaagttcagccaggtcacgttgttgtcattcgctttgaaggccccaagggtggtcctggtatgccggaaatgttgaacccaacttcaagtatcgttggccgtggtttgggtcgagacgttggtttaatcactgatggccgtttctcaggtgctactcgggggatcgccgttggtcacatttcaccggaagctgccgagggtggtaatattgctctggttaaaaacggtgacacaatcaccatcgacttaaagaaccacgacatttcagttgacgtttcagatgaggaacttgctgaacgtcgaactcacttacctaagttcgagccaaaagttcgttcaggttacttggcccgttatcaagccttggttacttcagcaaataccggtggtgttatgaaaggttacgacgaattattttaagcgcctattaatatagtagagaaaacttttagagaattgaactttttggaggaatgcttatgcaaactgtatctaaaattggtaactggatgagtaagtggtttacgttactcgttatcttatgggccgccgttaattatttcttaccacaagcgagcttatggatcgcacctaatacgtcctatcttttaggaatcattttgtttggaatggggctcactttaagcaaagatgacttcgcaagaattttcaaacgaccggttccagttattctcgggactgttgctcattatgtaatcatgccatttatcgcctttctactttgccaaattttccatttaaccggtgcaactgccgttggtgtcattctggtaggttcctgcccaagcggaacgtcatcaagtgtgatggcctatctggcaaagggtgatgtggcgcttgatgtttcgatcgaagctctttcgacattattagcaccaatcatgctgccgctaatgctacaattctacgctggccggtacgttgcaatcccgacaacgcaattattcctgagtactttaaaaatcgttgttatccccatcatcctaggggttgttgttcacacactcttcagcaagcaagccgccaaagtaaatatgattctgccgcttatttcacagttagcaattcttgccattgtcggtgccgtatttgcagctaaccacgatgatttattcaccgcccaaaccgctctggttatcccggtggttatgcttcacaacttgagtggatacgcacttggctacctgtttggccacttgattcgattgcatcagccacaacgaaaagccattactttcgaagttggcatgcaggattcaagtcttggtgcaactttagccatgaagtacttcgttccagctgctgctattccatcgaccatcttctcgatctggcacaacgtttccggttctgttctctcctcgtggtggcgtcaacacacaaccgaatccgtcaaagaatcgattcgtgcaactgcctcaaataacgttcccaataactgatgtttaaaagattaactatataatagtagaaaaagatcatttccgaaaaaataatccggaaatgatcttttctatgttcacttctcttcaaaacttttatccaagaattcagcaagtgcgtcattatcaatattattaatgtttccccttttaatagccttttttatcgttctcgaagacatttttcttccgattaaatattgttctacttcgtttaaatcaccgtcgactttaaaaaacggattgaatttaaggtgtaccattttaccatccgtaatggtccaattaatacccatttttccggccgcaaagagctgatcttgataatcataatagcccggattatgaccaaagttccattcatcagttccataagtctctgccaaacgttgatcggcctttttccaatcctcgtcagtcatatggtaagtttcaatatcatctaatgacttgacttgaaacatttccttcagcaaataagctcgaaattccgccattgtcatgccatcaggtaaataatccttcaaattgacaattggacttcgtttggaaagaacgcccaaacgtttttgcttttcaatttgattctcagtcaaaaccttcttggcattttcaatattcaaatcatacataatcgtgccacctgcagcaatgcccttaccgcttttaaacattgtcatcccggaccatttcttaccatccagaatcagatcactactattgggcttcattttaacatcaatgccaagcttttgaagtgccttcaaaaccggttcagcaaaatgaccgtaatcgccaaagtcagaaacatcatcaacgagaatattttcaaaaataaagtttcccatatcatgataaacagcaccgccaccggatgttcgccgaaccaattcaatatcatgttcatgtagataatcaacgtcaacttccgcccatacattttgatttcgaccgatgatcaccgagggtttgttaatataaaacattagtccatgccccggcagctttaaatcattcacaaaataattgtccaaagattggttgactctggcatcataacttggttgaccatttctggaaatatcgataagatacatgaaacattcctccccatctgcatttatgtaataacatcaattaagctttatcaaatagccttatactccgggtgtaaccgctttgtttcgcacactgataattatacgttataattaagataaataatatcgaggcggtgtcattatggctaaaatttcattctggatgcgaattaaaaacttttttaccggcaaaaagcaaccaaccttgtctgatgtacaggtaaaagatggtatttggtatgccaagcaaagtgatggcaattatttgttgggaattgacgagtcagtttatcaactaatgggcaagattacatttgctgactttccaacccaactcaaggacattcaagttgatgacgatcttttagatattgagggcgacaaatcagtcgaaacattaaaatctcccattgccggaaccgtcattgaacaaaatgccgatatcggaaaaaacatcgacacactgaatgaacccaatccacaagttaactggatcgtaaaagtaaagccattatcataaaacgtgatttattgaaacaatttttgtgccaaatttcaaatttgaactataatgggtatagatacaaataaggaggtagttatctatggcagaagatattgaagaagaaccaggtgcagaatccccattacttaacaaaaaaatgagtgaggctttcgactggagcgatagtaaacttccagtacgagatgctttatgggattattacatggagaacaacgatcacgataccatgaagactggtaaagacatggaaaaatacatggacatgtcttccgatgatctaaaagcagaagctgaaaagttactcaaaaagtaattcttgacgcttttctaacaaaaacagctcggcacatatggtgtcaagctgtttttgtatctttaagttcactttgagcttcatttaaaacactgtctgaaacgaactcagtggtaaaccgctgtaatggtgtaaatgtatgccggtctttaaaagctacaggaatggcctttacaatcacaaccatcatattattttcagtcataaaaatctgaccgagttttttaaactttcccttggtatgtttacccgttcgccaactatggagtttgaaatgaccattttcatcgtattttattttataatgaccagagtcatccgtttccagtggtgcaccaatatattgattaacctcatacttgcccttcatcaaacccatccttccaatcaaattatttatcaaaatcggttaataatggtatcttaaagttataaagaataaattgtatcatacaaagaggtgatcttatgcataacatcaaaattgtgactgattcagcagctcacttatctcctaatgatatcaatcactatcatatcacagtcatgaactcccctatcctcattaacggaaaagtttttggctatgttaacaaaatcagtagtgaaaaattcatgcaaatgtttgatgatgatggaagagcaccgataatcggtgaaattagtgttgaagccttaacgcatacttatgatgaacttggtgccgatggtagtcaaatactctcaattcacttaagtgacaccctttcaaatacctataagaatgctaaatcagctgctgcaaaatccacaagtcaggtcaccgtcattaacagtagagtaacagcagcaggattagcatatcaagtcatgaccgccgcagaggccatcgccaagggtcaacgtatgattgatgttttagcatcaatggaacaggtgcgtgataaaacaaaaatcttcttttctgcacctaataattctcaactggttaacagacgtgtcatcggaaaaatcagaggaacaattgaaaaaagattaaacgtctcttacgtaattgagtttaaaaataatgatttttcatttgtcacacgaagccgacaagatgaacttgttaatcaattttggcatgatcaattaaccatcatgcatcacgaaccgatcgttcaactatctatccttcattccggtaatcctgatcgggcaaatttcctttaccaaatgttaagtaaagaatttcctttcgttccgatttcaaagattccaactaatcctgaaatggcttgctttattggaaatgaagcaactggggtgacttatctattagggtagaaccatttactttaaacgggccaagcaatttcataaccaccagaaataaaataaaaatgtggattagaaagcatcgatgctttctaatccacgttttttattttgaagttaccttatttttcacttttggaatcggtccgtcgatgcctaaatctaagttgtttaaaattaaatccttcataggttaatctcatcaacccaggcataattgatggtacaacaataccaaagataattaatccgaaaataacggcaatggcaacctgaattaacgtcaatacacctgatgacatcaatgaagcaaagatgacactaatcacaacaatggcaaaaataaccaccgttccaattaaaatcgatgcattaatcattcgttccgcagatttaccttttccatccgtctgcttgtatttcattaaaaggtaaatactataatcaacgccaaatgccagtaacatcatgaacgttaggaatggcatgtttgctgtcaaccatttctgtcccaagaattgagcactaaaccattttgtaaatccaagtgacatcagataggttattcccagcgatccaaccaaataaactggttgcagaatcgagcctgcaacaatcatcaagattaacgcagcggctatactcaacaggatagcaactcgtttaaagctggtacgggctgcctgttggttatcgacaaccattgagttgtaaccaccgactgcaactgtagcacccttcagttgagtgcctctcaaatcataattgacctgattctctaaatcctgaaccagttcaattgatttctttgatcctggcgtcgcattcaagacaacatcaagtcgggttgttttttcgttagtggacaaatattccccgattaatgtcttaaagtagtccgcattaatcacgttatccggaatataaatggtgtttccaaccgatgatttagccaaggcttttaagaagttatttgaattagttaacgagttattgaggttatccaaggttgaagcatatccacgaacctgattctggacgttctgaagttcagatttaaatgaattggtgcttgaattaatggagtcggttttaagaccgataccggataacgcactgttcatttgcgtctgctgctgttgatcgttaagtgcccgacttaacgcctcggtcacaacagtccgctgcatgctcgtcaaccgtctcctgtgttcacttcttaacttctgttgaagctcatcgaccatttgagcaggcgtcgcaaaaaccccactattattgaactcattttgaatagttgaaaccattgacgtaattgactgagcatcgccagtgactgaatccaagccatctgtttgaatcgaggtactcttcagcttcttggacgtatcactcatcccgcttgaaacagcatcattatctccggtcaacgtatttaactgctgattaacatagagttgtttcaatggttggccatgaggttccgtagccgaatttacgctatgaatacctttttgatccctgagctgcctggtgattgtttcaatctgttgtaaatcggtttgatcacgtaagctgtggtcagatttgatatagattgacaccggcgcattcattccgttggcgtagtgttgattcacgatttggtaaccctttttggatgggtatttcagagtaatttcagctgcatcattatgatttaaatgcttctggtttagaaaaacaaatggcgttgccacaattaatgcaatgatcaatgcaattaatggatgagcggccgactttgttgaaagaaagccccatgaacgactgtagttgtgggcttccaagttagaagacggccaaaagatagtttctcccatgaagaataggaagaaaggcgtgaacgacattaaaacaagtaataaaaccaagatgccaattgccacacctaccaaggattcatacaacgaatagttggcaaaccccagtaagctgaaaagaacaatcagcgttaagcttgaaatcaaaatcgttttgccggcgtttcttcgagcagccagtgttgcttccaactggtcttttcctgcacgaagctgctttttaaactcattaattaataagatactgaagtcggtcccaaggcccagcaacaagatgagcattgaaatctgagtaaagtttgaaaacgggaagtggtaacgagaaaccaaattcagaacaattgcgagtgaaataatatacgcgataccagttgaaatcagggaaacaagcggaataagcaaggatcggaacaagagaattaacacaagtagaataatgacaattgcaattatttcagttttccccagccctgcttcagtcgcgtgctgagtatcattgatgagactgtcggggctggttatgtacgttttaacgcttgcagtacgaacagccgccttcaacttggtatccatctgacgcacagttaaatcccgtttaccgacatttaactgtgcgatcattgtggtaccgtctttggagttcaactccgctgaaaccgacggatcattatttaacattgcgtctgatccggatgaggctgcactactttgcgaagaactcggagcagccgccgtactttgggcatttgacggctggctaacggccgcggccgaatcaacgcttggcttaacaatgttcttaatatcaaattggtctttcttattctcaagcgttgttaacgttgtattaatttgatttcgctgaatatcatttaattttgccttgccgttactaaaaacaaccaaaacctgtcgtgtgtgactaagcttaggtccccaattattcttgagtgtgtttgccacttgactttgggcagatttaggcaggcttgtctgaccatgactggctactaaattaaatgagttgggcatcataaaaatagctgcaattgcaacaactacccaagcgatgatgacaccgatgtattttttgaagaacttattcatgtttttctccttatcttcccatatattcatattccatgataaccgtaagcgattcccccaacggtatcattggtaaagagttttctattatatgtaaaaaccataacgcaatctataacaaattcatcaccatcgcgcaggttaaattgcagatgcgtcgtcgtgctatgtgcaacaccggcaaaaattagtgatagtcatacatatataaattataattgtaataatcaataagtcaatgatagatgtagcctaagtgccgatataacaacaaaaaacgcgccttgaaataaattgaacaatcatttcaaaacgtgttatagttacaagcttgattctcgtttaatgagtcggtttccaacaatcactttttgaggtgtatgatgatcatcatcgtcatcctcaatcgtatcaacaagtgaaacggccacttcccccattttccccgtatcaacttttacggaacttaacgaaggaatgacatatttggcaactgccgtgtcgttaaaactaacaacactgacatcttctggaacgttcaccttattttcatgaaacgcctttaatgcgccgaccgccattgcatcgttggcaacatacagtgcattggggaaatccttgcgattggttttcaatgcattgttcaccaagtcaaacgccgactgcatggtaaaatcaccaacaaacacattagccgggtcgtaaagtgattggttttccaaataatctttaaaaacatcgaatcgcggatcaacaatttttaatttgtgatcgctcgaatattccactccggatagcatacctattcgctttaaaccactctcaataaaatatgtcaaaactgattcagtcgaattatcaaaatcggtcacaacacaatcatagcccttggctaaggtatcaaaatccacaaatatgacattggcagttacttttaacatcgccttaatttgagcatcactaaatttaccaatggcaacaatcgcttttacatctttgatttttgataatgaatcgttggcaaaaaaacgatgaactttataatgaagccgctcagctcgcttctcagcccccattctaatagatagataatacaaatcatctaattcctgttgctcggtataccattgaacaattgcaatattatcttttatattgccggcctttttctttttagtataggccagatcttcagcgaccctgaatattttctttcttgtcgtgtcactcactgaaagtgtcttatcataatttaaaacccgcgaaacggtcgtaatcgacacgcctgcttttttagcaatatctttaattgtcgccaaaaataatccacctctaatttctaaaaattttacttataaatgatctttagctagtttactaaaataaatatattttgttttacttgataagtcaaggatgttgcgacatattagtgtttctggctagtaaacatgttgacgagaagctcgtaaatttctataatgaagctgaactaataaagggaggtccatctcgtgaacgacaatattgaacacgcttatcaagaatggtctaaacagccaaacttaccagaaaacattgtacttgatctaaaacaattaaaaaacgaccccgataaacaagaagatgcattcggcacattcctttcatttggaactgccggcatgcggggcatcatgggtgccggaacaaatcgaatgaacatttatacggtccgtcaagccgctgaaggactcgcttcgtttatggacacgctggatgaagccaccagaaagcgcggcgttgcgattagttttgactcccgttatcattcaaaagaatttgctcatgaatctgctaaagtattgggataccacgatattccaactttcgtgtttgatgatattcggccaacaccggaattgtcatttgcagttcgtcacttacacacctatgccggtatcatgattaccgcaagccataatcctaaacagtataacggctttaaaatctatggtgaagatggtggtcaaatgccgcctaaggaatctgatttaatcacttcttatattagaaaaaacagcgacctgtttgccattcatgttaaaccggaacaggcattacgcgaagccaaaatcatgaacctgattggtgaagatgttgatatcgattacctcgacaatgttaaaacagtcaacattgatcacaacttgatcaacactgtcggtaaggacatgaagtttgtttattcaccacttcatggaaccggtaaagtcatcgcacggcgggcacttgaagaagccggttttagcaactatgttgttgttcccgaacaaacaattgccgatcccgaattcccgacaaccccatttccaaaccctgaattcccacaagcttttgatttagccagaaagctgggtaaaaaggtttccgctgacgtcttgattgccagcgatccggatgctgatcgattgggagcagctgttcgacaacccgatggcagttatcaattattaagtggtaatcaaattgccagtgtattactcaattatatcctatctgcccagaaaaaggcgggttcattgccagataatggcacaattgtcaaatcaattgtctcgacggatttagccgttaaaatcgcagcggactatggtgtcgcaaccaataacgttttaaccggcttcaaatttattgccgaagccattcatcattatgagaccaagcatgaccatacttttctgtttgggttcgaagaaagctttggttacctgatcaagccatttgttcgcgacaaagatgccattcagaccgttttgttattggctgaagttgctgcttattacaagagtcagggcaagaccttatatgacggtgttcaggaaatgttcaagaagtacggctattacgctgaaaagactatcgccaaggaatttgacggtcttgacggtaaggacaagatggctcacatcatgtctgaacttcgcgacaatccactaaccgaattcaacggtcataaagttatcagccatgccgactacgctagctctaccctaactgatagagatggtcaacagaagccaattgacctgccgaaatccaacgttcttaagtattggctggatgatgagacctggctggctgttcgaccttccgggaccgaaccaaaagtgaagttctatttggaagttgtcgataagaatcaggaagctgtcgatgccaagctggctagtgacgttgatgccttggacaaagtgattgaacaactggttaaaaactaatcagtcattttaaaaataaaatcttataaatcagcacattcttgattttaattttgattatcttcaagaatcactactaaaagagccggtcggaagtaaacaacttttccgatcggctttttcaattcaatatatgcttcaatattaatccgttaattttgaggcataccggcactatcactcgcatcctgcagttcattcgaataaatcaataagcgctgcgcatagcttggatgatcaaacgttgtttcaatattaacctgtagttcatgaagatcatcagtaataatcccatcaacatttagaaacatcattcgggtcatatcatcgtcatcatcgactgtccaagcaaaaacctgttgttttcgggcgtgggcctcgttcacaaagtcctgattcaacgttgtctcttccatagtataggcattagctttggtttcaggaaatgaaaaattaaacggcaaaatgtaactgacaaataactttgatgcgcgcttctttaagccggtaattacatgataatcaagtgagtgaatccgatcatggtcacgcagcagccggttttcataccgtttgataaataacgccaacatattggcactatcgtacttagttgttttaatttcaaccaacaatttttgatgatcatgttcggcagccgtcaaatactggtcgaaactggcaatgtgcgccgtatggccattttcatgcacctttaattttgtcagctgtttaagtgtcaattgatggggcgctttattaacacccgccaaatttttcagattttcgtcatgcatcaacacaaattgatggtcctttgtctcgtggatatccatttcgacataatcaggcttttcccggctggttttgtttaaagcgggaatggtattctgtacgccgttaccattatcaacaccccgatgggagatggtcagtggtcgcgttaataatgcaccctgtaaataaatggcattaaacgtcatttgaaggctcagaaaaagcaggaccaatatggccgcaaagattcggcggcgataacgatggcgcgttggtcgactgactacggttcccactggttgatttatcccacggtcatccaaattaaaaatcagtaccaacatgaagacaaccaaactaaaggcgccaataatgtattgccaaatcgatagaaggcccatgttaataacagcaccgctaaaggcaaccaggttggacttttgatcaaaataaagttgagccaaataaagtaatcccgaaagtaacgtcgtcgttaagaaactgattgtacctaataccatcattcgccaaagataacgccatccattatgatgggtcatctgccagctctttttggctgcggcaaatccgggctgccgattcagaatcattaacggcaacacttgaactaatcgaatgcccagataaaatagcagtagataaaataatgcaaccaatcccatcagccaccagctctgatcaatcgtttcaaaaataaaggccggcagttgaacttttgataataatggggagttcaggtaaatatccgaaagcggtaagaccagaataaaatagcctaaaaagaatagaaagcttcctgctcgaagatggcctaaattttttaaagccgtcaatgccactcgtggcagtcgttgattttgcctttcagcaatattttgaataccaaacatcaaaaacgcaaactgccaaaaaatcaatgccaaaatgatgataagtagaaccaataattcacctaccgctgccggtcgcttggttaacaaccaaacgacgttggtatacgagagatatgggacaccgttcaattttaaaatcaggctggtcgaaaaagtcgtcagaggtacaacgattcccaacatcaaaaaattgataacgatgaccagtatcgtataggcgccccagtttttaaaaaacgtcttaaatgcctgccgtaagagcggtttccctttcattttatctatctcctcactttggaaagattgttaactgcacaatcgaatattttaccattattaaagcacaaaaacactctaccgtagcgatagagtgcctttgatttgatgcatgccaataattcaaaaaattaagatcatctatttgggctttctaatgacgcgtacgtttactcgtcatagttaacccaaagcctatgatcaaaaataccatagctaggatcaagacaagatccgctccaatcccagagccagttatttcaaaagcatgtcctcgctgtgaaatattaagacccatgccttgatacttagctaaaaaggttcctaaaatcagtaatataaaaccaatgatcaattgaatttttcctgtcaaaatcatcaaccctctttgtgttctttaataaccatagaagcaagataaaaatcaaagacaatgcttagcagcactcatctctttaaattaaggttctactcattgaccttattttccatcgactaaataataaagagaattgaaatgcaaacataagtctctgcagaatgatgctttgcaattatatcaacaccctgtaactttagtgcagagctcatcgcattcataattagtgccttttctttcacgtacaaaattaacctgtttaactttgcacgtgttaacaattcttgcatatgttttgtatttttatactgttctctttaaaatagtaagaattttttctccttctcaattttaattaaatgataacattctaagttttgatgtaaagcttttgtactaattattttaacaaatggtgttgtttcagcatactgacggctgctttttgctttactgcgcaaatgattgtctttgatatcatgagagtcaatctttttttaccttttatctaaaaaaattatttgttattcccaaattctatgtttaaactatattttgtatagtaagtgtttatgcctttttggaaatcaattcttattttctatcaaaggttcttaaccagggagttaaaaataataataatcgttactgaagctatgtaaaaaagccgcctagtataactttagtagttacaggacagcgttcatattctttaattaatttgtcaccgcctttgaaatggtttgctaaggaaattctactagaacaggggttatttttgaatcttcactaaatcacgacacataatgccaatctaggcaaagcatcaaattatatagtatcaatatcttgataaaagttagatttcatcgatattatcaagccaaaacatattcaagtcgttttataaaaaacaaatatcccctttcctgagttgccaaaacaaagctgctatacttttgagctacaccatctcgaactgaatttctcaaattcaaaaaagttaaatttaaaagtaccaagcattttttactatttttgtgtgggcatggcatagaaatagaacagaccaataattaacatcaaaatcgtcacaactagaatggctatcaccgatatcacaacaaatttcttcatattattccccttcattaagatattccccctcgagacaatatccctaaatccgttatagttcagcatcctttacccgtcaatacacttttgtaatagtgctatacatagacaattaatgacatattatttttaatgcctagtttgtataaatcacagtaattgcacaaaactaaataactatgcataacaaatttgagcttataggtatttaaatgatgatttccttaattaaaagccattagaaaatattttgatcaaggtgacaaaaaatgtgtctaaattttcagcaggatacattgacaaaaaatccaaaaccattctttcaaaattacgcatcagcaaggcattatcagtcatcctttgacaaataaaattatgattttatccgtttttaacttctgcataaaagaactattttatccaagtctaaattatgataatcatcggtttactgctcaaaacaaagcggagtaccttttaaatttcttcttgcatacacaaaccaattagttatccaaggttatattaaaagaataggcaggaatttttttatttccttttctactttattttccttcaagccaaaattcttgtaacatagaattgatcatatcaaaaagctgtcgactactactttttgccttatatctcaaaaacactagtccactttataatcatcaaaggaggccatgacatgagtaaaggcacattttatcagggtgacgctttatttgttgttctaactttcataatcgatatcgcaattattgctgctgttatctactttggaatcaaacttttccgcgcaattacaaatcgcaacaaaaaatagtcatcaacacctttttcagcaataatcagccattgaaatctttcggcttataaccttattaaacctgtgacatcccctttgattcgggttaaacttaatgaggtaccagaaactacttaggagaaccgttatgggggaaacaattcatgaaaactgcagtcattacagacagcgccagctatttggataaaaaacttgctgctcaatacaacattaaagtactgccaatcacggttatttttggaacggagcagtatcaagacggtgttaatatcacgtctcatgagtttctcgagaaattagctaatgcggataaactgccaacgactgctcaggtcaccatgcaacagatgcaggatgcgttcgatgaattaagcgccgccggctatgatgaggtcatttgtgtcaacctctcatccggaattaccagtttctacgaaaatctggttgcgtatagcaaaaccgtcaaaaatattcgcgtttatccgttcgactccaagattgccagtgccggagaagctgatttggcacttttagcaggaacaatggctcaaaatggtgaaaatgcgaaaacgattttgccgcggctgatcgacctacgggattcaattcacgtgtcattggtcgtcgacagtttggatcacctgatgcgaaccggccgaatttccagcacttccgcctttgttggcaacctactgagaataaaaccaatgttaacgtttgacgataatggcaagatcgttccgcttggaaaggcgcgcacaatgaagcaggcgttggctaaaatcctcgatgaaattgaaaattcgctttcagatatcgacggtcaactcagaatttcagtggctgacgccgataatcccaaattaagcaaacagtgggtgaccgaaatcaaagaaaggttccccaatgccgctatcagtacctatcaaatcagtccggcaattactgttcataccggtgaaaaagcaatgggtgtcgtgtgggattgcgattgggaagcaatgtaatttagtcactttcttgtttagaataactaaccgggccgaggcaaaagctaaaatttgcttccggccctttattatcattttcaaaatttaatttgtttggagtggagatttttggaagaaaaaattagtcggcagacgttactttcactgctagcagctgccctattatcatttacgggtattttaacggaaacatcaatgaacgtcacattcccggaactttcacgtctttttaatataacgcttgataccattcagtggctgacaaccggttatctgttgatggtcacaattgtcatggcaacgactgcctacctgcttaaaaaatttcaagcaaaaagtatctacgtatttgccgcatccgccttcatcgttggggatcttctatgtgcggttgcaccaagcttttcgattttactggttggtcggattattcaggcaattgcgactgggctttctaccccactcatgtttcatattattttcactcagatccccaagggtagaatcggctccatgaccggtcttgctggaatggtcatttctctggcaccggcacttggtcctacctatggcggtgtaatctcctcaatcacaacttggcgcctaatcttttggttgatcttaccgattgtcctcattgggttatttctaggtattcgatatatcaatattgccccgttcggtacggacaactcatttgacgttttgagcctgctatttctagccgggacactaaccgcttttgtttatgctgttagtaaagccgcttcgtttaaattaaccaacctatcagtggtactcccgattatagttggcctcatctgcttggtcttatttatcatggcaaacagtcacggtgaaagcggactgttggatctcagcatcctcaagcaggcaactacttccctttccgcatttacttattttagtctgcaatttatcaacatcggcatttcattcgttatcccggtatattgccaatatgttcttcatacatctgcgatggtggcaggtttaacactattgccaggttcaatcatcggcgcactcacgtctccttttgccggcaatattgccgattcccacggatatgcactgccaatcacaatcggcctgagctgtctaacacttgggagcttggtctttttggttgcacagcagtggttgaccgcattgttggttgtcttcgcgttttgtatactaagattcggctttaacatgggcttttcaaattcgatctcaaatgcttccattaatgttccaaaggaaaataccgccgatatcaactcgttttttaacatgcttcagcagtttgcggggtcaatcggggtcggtattatggccgctatcatggcttcaagccaaaacagcggccatggctcctttgttcaacggtcatacattggtggtcactatgattatttgtttgtgaccattttaagtatctgcgcattaattgccgcagtcattaattttcgacttcaaaaacgggctcaagtttaaatcaagcctgtcttctgacacatctgtcgactgaataatcattttgataacaaaataagcagcgctgtgaaaacaaccttattttttgctttcacagcgctgtttaacgatattgcctaccgcctaccctaacttataaaataaccgcaacttattttaatgatttacagccataggataacggtgttaccttataaacatcaaggaggggattaatatagtaggaaaaaccaacaacaccaaaaacgatattgttaccttaaccattcgcaaaatcaaagaaaccggttatcagggaatttcgttacgaaagttattagcagaattacacttgacaaccggttcattttataaacattttgatagtaaggatgatctcttccggacagtgaccgccacgctctccgaacgactcagccagcaagcacggcagacggctacgaaagaaaaagacccactcgtccagctcattgatctcggtgagtttatcatcatccaattcaagaagcagcccaacctgatgggtttcctatttttcaacaatagcattctcgatctctaccaacataatggtaccagtcatttccctttgctggacgatacccatcaactaatcaaaaaaatcatggcggtttatccgactcatgattccgaaaaaacattatttgtcaaagtctgggcctttattcaagggtacgccatgttgattcaaaataacgcggctgactatgatcgggtcttgttaactaacactgctaaagaaatgattggagtgaaatcatgatgaaaaaaatcgttgtcgtctattgtcatccctataatcaaagtttcaatcacgccgttttggaacaggtattaaccaacttgcatcaccagaatatgaccccggaattaattgatctatatgcggaacaattcactcccgtttacgatgccgaggaacttcgattatttcatcagggaaaaacgcatgatccattggttaccaagtacttgaacatgctgcgaaacgctgatgggatcatctttatcacaccggtatggtggaatgatcttccggggatgcttaagggatttattgataaagtcatgaaggagggtgaaggcttgtctcacaccgtcactaaaaccggtgttcatggtgaattaacgaatctcaagcacgcctatgttttcacaacttcaacttcgccaaccttttaccttcggatgtggtgtgggaatgcgattaggaagatttttattaaagtaacgctgaaacagttaggcattaaatctggaacgtggcttaattttggcagtatttcgacttctaaaccagaaaagagacagacctacctgaaaaaatgtggggaaatgacacttgattttagttaaaagtcaatcgtcatatttagtgaattcattcactaataaagttataataaatccaaacagttcgtttggaggcgatcatgatgcaaaaaacaaaaggattattattcccagtcgtctttttagcacttgtactaaccggttgcagctcttccagccaacagaaagataacaaacccgccaatcaaaagacgggagattgggcagttgtttacaatgcatcgaacaaaaaagtgacaaccttacgcagtaaaagtgcaattgattatatttccgataaaaccggtgacgatggcggtaatcatccgaacggtatcaataaagacgtccctgccggttccaaactgcgttatcggtatgacttgtatcagagtaagccgcgggtaaagatttcattatatgtttattcgaataaatatgccaagttaaccaatcttccggttatttccaagatttcttggaagatgagcaatcaggaatttcaaaaattcaatcatccaaaagaaatcgaataaccaattaaaaaagcaattcaaaagtcgaattgcttttttgctggaaagaatttctattcatcactgacagtgacatccgctgctttaacaaatccgatccgatgattgaattggatttggacgtattgatcatttcctttaatgacatttttagcactgttcgagttgaaatgggaattaaagtaatctgatgtcatctcgccgccataaacatacttttgccctggtgcaatagtatatattggcgatggtttggttcccgttaccttgtttttcttcaaaattgagctggttggataggcactcccataaaccggaatggtactggatcccttcggtgtgaccagctttccagtcgcattcgtggtattggcatcgttagggttatagaaccaggcaggttgtccaccatagtcaatttcagtccagtcccctgattgaccgactttataaaactgctggccatcaacagctttatctgtccagtcatctttttcggttgtaccaacagaactggttgaaaagtccttatctgaaataagactgctatcgaaacccggctgttgatacagataaacaaagttagagcccttcaatggcagatcaacgccatcatccgttaccttttggcctgaatcagctgttaagttatgatctgggtcaggcgtgatcgtcacgatactgccggttccctgactatccttaaaattaacacccaacaaatcaaagtaatgctgccagttccaataagtcccagggtcccaatgcattgtcttctgagctgcaggggttagccccggcacgttgtcatggccgataatgtgctggcggtctaatggaatattatatttagcggccaagtatttgaccagcgctgctgatgattgatacatcgcttcagtataccaatagccaccaacggccgcgtatccttcatgttcaattccgattgaatgtgaattaatgtaccaattgccggcatgccaagcaacattttgcggacgaaccatctcagctaccgtcccctgttccgaactaatcacgtaattagcagaggtgtaactaggagttgaagcaaataaattggttgcctcatcaaaagttgtctctgtgttatgaatgacaatataattgattttcagcccgtcacttggtcgattggctaaatcatagttaccgtagtcacctttattatcaaattccttataaagagccggcacccattcaaccggcagcccgtccggcccatcagtcgtactgggaacggaggccaaatcaagtttctccgattggtccttcaatggcttcaccttctgtgcagtcagtataacgccggattttgtgacaccctttttgattgttttgtaaacattatccgaaaaaaatgccgctgcctgtttagttgtgtcctgactgtatttttcaactgcaccataccaagaattagcatgactagtcaacgaatggccaagcttcttttgataatatgctagaagtgctgcaccaccgttaatattggttcgtgtatcttccttaagccttttagttgaatagcctgtcaacccagcggctttatttagcgtgtgaagtgctgccgaatcaggcaatgccttcgatgtattgtcggtgcccgttatcgttgaaccattcacatctgttaggtgcatgacaccataacccccagccacactgggtttgccattatgtgcatcaaaccgggtctcgttgtacgaaaccgcctctaaaaccttaaccggtacacgatattttttagcagcctgctgaaaatcaacttgaagtgtctccttagctttcgcattaacgccggttgccatacatatcgaaaacaagccaactgctgcacccattaataaccaacgcccaattttatataccctgtattgtttcaaagttgcgtccctctttctgcatagatatccgttaaccgattataaatcgtttaaaactagaatacactgaatgcatttaaaaagatattataaatgataattattttaatttttaaaagttatctttaataatcatctgacacatcggcgtcacaaatagatgattacaaacttccatccagttaaattttattttccattcccagtaatgttatcatcgttttctaatttttatgtttgactttagcggtcattaaggtaaaatcagtgtatactttcggtataattataattcaatgtggaggggattcttttgaccttatatttaaagcacaaattgtcgttactgctcatggcaattgtctctgttacctttatcaatttagcaatcaacgtacgcgcaagtacaaccgatgccccaacagtgacattaaacgagcctctgcaaaccgatcccaatactcgaaattacctaccgacaggcacagaggcgctttataccaagatccccaaccagaaagatgcaaaaatcagcgttaaggcaactgatttaaagtccgtcgcaacaacggccgaccaaggacaaacctatttccggggttatcgggtcgctcaaaccagtgacggtaagttctatttaaaagttgtgtcgtttaataaagcctatagggggtggatttatgtcggcaacaataatccaagcagtgacaccacttccgtcacgaatggcctaacatcggttcaaacgttcaaagaagaaaccccatccgacacggttgccaagacaactttctattttacgacacccaaagcgtcaacacttacttacaccgccccggattggacacaatataaggtcggtcgaaatcttaacgccacaaccgcatatgtgaacgatgcccttaaagttactcaaatcggcactaagcaaaataatcgggacaataacgctacttactattacgttgaagacagtgccaatccacaagtaaacggctggatcaaatcatctgaagtttccgcagtgaagcaaacttttaactattaaccataactaaaaagtcaatatcgttttggatacgcaaaattgtattggctttttagtttgctcatgacgattgttaccactctgttattctcaatagtgatgagccacttatcaacgccgaccttttgagatcatgtgatcctcatcgagctgctgaccagtcatctatataacaccataaagaaactcaacagaccgagttatacttataccgtagttatctttattgtttggaaggacgtaatcaaatggataacaagaagttgactaagcgaataagtaacttttcttagtcggctatcatcttaattatgatatttgtttagtttgttgttggaaaagccaaattctatattggagaataatgacagttagtttatttattccaattttcttttcgccaggatactctctaaacaagctcataacaaatgatataaaacatcgaaaacagaattgacttgattttaagttccgagcataaagatacaatgacggctattccccactgaaatcaaccaatataatactgtatgcgttattacttaaagggggaaattggattgaacatcaagataactgaaaccggaattagtgattttgtaagattcctggggattgtatgtatggcatctgttctatggattactaaacaaatgggtatggccttttggggttcaggcgttattgtcggcattgtttccatattcttttctccgggatactttttaaataaaatcgtttttaattatttcaaaaggttgcaaaagaaggagaaatagattttcttactgtatcttgaaatatttattgccgtagccttccctgatcataaaccacatgagtagggctcctggaagtttttaaataacggcttaactgctgagatgtcattgagttaagttgtcagcttaatccataattatcttttcatctcatcctaccttctaattgtataaccagtttctgttataatgcatgtagtggaggtatttaatatgctaaaaaagagtttgtcgtttctgttactgttaggggctatttttcttagtctagcaagtgttggctcggtatctgccaacaccattccaagcaactattcttttgatggctccaaatttacagggccgattccgtattattcaagtaccaaaagtcagaaagcttatatttggaataatacccaaaccaaacgaattcataatttaaaaaactatcctaacactgtctggttggtttccaaggcattcgtgaaacccgttaaaggcaaaaacgaagtgtattacaagttatattcggcatacaaaaaaaagttaaagggattgcctggtacggttatttcaaaaaaagcattattaagttgccggttctctttaatagccaacaggcctaccttaacgacctaaatagcaataaagcgctaaagttaactcgactggttgctaagctgtttcctaattccaaaattaatctaaatctgtctaagagcctgtacctcactcagcctcaaaacgcttatctactaaatagttttacaaatactaaagaactggatttaaataagcaaactggtaagtggtccgttagtgaatatgagcgtatggcgtcctctaaagccattaaattaattgaccaacggcttacggagttggggtatgatcagaataaaagaaatagtatgtctgattacgacattggcttaaatattgttggctatgcgcaatccttttataagcaaagtgacttaaagacagccaatcagtaccgatatccagtcactctgccaggctttcgcgacatggaagattatcaagcttgtgccattcagcttggaattcccaaataaagtaaataatatgtaccccttccttactcaggaagggctttttcctttttaatcctgtaatttaactttgatatacttaaaataataaggaggaaaaacatgaaaaaatatttaatcatcattttatctgtatatagtttgatcaccggtttaacatgcttaattggagatcaggcgaatgctaaaagcaattccaactatcaaataatcgccagtaagcatgttaatacctataaagcgcttaattcattcaataacaacagtattctccatgttaaaaatcagtataaaaacaagaatgtgtatgtttggaataaagagcacaccaaggtcctttacaatttgaaagatttccctaattcctatctttcggctttaaccaagcaaacttaccttcatggtggccataaaagtctgtattatgccgcatacattgtaaccccaaagggtaattcctcaagatacggtcgtatctggcaaggttatttaaccaaaggatataatcgtcattatcaaaaattaaattatttaagtacagttggcttcactaatgatcaagactatctaaactacatcaaaaaatcaccatcgcaagttgttgcacgtgcagttttgaaactctttccaaacagcaaactttcactgagattatcaaaccttggtcaatttaattcagacgtagattcaactaacaaaccttttgaagaatacttcacgaatcgaatcaatttacaaaaagtcgctgcctacttgggaccaaccaagtcaaagctaacaagttcgcaaagaatcacaaaaattaaacaaacattggtttcagagggctacacaaccagtaagcgacatgcgatgagtcactatgtcattggtatttatgatcctaatccaaatatggcgtgggaagaatttgtctggagtattaatttagctaagccactataaatcagtcaacccgctgttacccattaagcattaattattttgcaaacctttttacaacattagataataaggttatcgaaaggagaatcgtgatgaataaaaaaatcgtacaattcttatctatcggcttattaacgctaggaatcagtatgattgcccaaccagtgatttctcatgcttggacatttacaataagtacacctggacctctggaaaagccgatgctgcaatttattacactaacacaaataagaacgcgtatatttggaactcccgttttaacaaaaaactgcataatttaaaaaactatccatataccacttggtacatcagtcgctcatttgtccggaagaacaaagtctactactcaattagtaacggtggcaaagttaaaggagttgtttggcacggttacgtgaccccagccgttgttaaaaaccttaacagctttaatagtgatagcgattatctcagctacttgaataccgacaagtctcaaaagctttcacgggcattactaaaactaattcccaacgcaaatgtaagcctcaatttatctcagcaagcttccatgaacaaaattacggattatcaaaatataatcaatctgggaactgtaagtggtactgtaaccgaaggagcaatcactcacaaaacaattgttcatgatttcttgatgggcttcagtgcaactaacgccgctaaagcaaaaactgctgggaagatgctggcggcaaagggatatacaagtgataaattagcttcattgatgagtcagggctaccaagttggtatttacgttaatgatggcgccgcaacttcagttggtaaatctggatatcccagcaccattagttttaaatcgtcagttcaaaataacatggcatttgtgattgcaaaaccaaaagaaaactgaacccggatgtctaaaatcctctgatcaaaaaaggacttgtcttcttaaaattttatgctaggatagctgataaatggtttttaaaaccgcctacaaaggaaatgagccaattgagatattcaatcatcatcacaaaggttttgaataaactagtaacttttaattggggcataacacttttatcgttcattacggcaattattttatatccacaattaccgggacaggttccggatcatattaacgttgtcggcgctgctgacggctatggcaataagctaacaatctttataatgccgattggactactggtaatcggctttttatcgtctagcaaattaatagacagtcggtacgcagatcttacaatacaaaatactttcttaaaaacattgatgctggcgatattgatcttgctatggtacggaaccgggctttttttctttacttacgcccaactactgaggtaaatttccctgtcgctagctatccagcctgccttgcaggacgaatctgcgggctaactacatcagcagccaactgttctgttcggctacctgctttaaagtaactaactgctatatcttcataagctgcaatgacctgatagaagccgcttagtgtcgtgtattcgtcaacttgatgagaaacggccttttcatccgggcccagaataacaaccggcattgtcggatttcccttgataaagacactggcatcagttgcaccgtttgttatttccagtgccacattccgatcaacaaacgcatcggctgctgctcgttgtaccagtcttacaaaaggattatcgggagtggtttcaaccggaggaaaactatgaattaggtcaaattccagatgatagtccgtttgttgattgatttgtgaaatggcagtctgaatcaatgcaatgacttgctggttatcaaaacgttgcgttggtcggacgttccctgacaattccgcataatcgggaattgtattaacctgctcaccgccaccaatgactgtaatactgtgttttaccgcacctaaaatcgaatccaacggtgcttgttgaaatagtgttgcttccgctgtagcaaactgcagtaatccggaaattgcgttaattccctgtgttgcccgcgcactatgagcagactgcccataactcttaatacggtaattcaaacttccggaatgggcataaacaatctgaccatcggtcgcttcgccaaccagcaaagctgaaagatcgtcaaccacaccttgtttcaataaacgattggcacccggtgttccgtattcttcgcctgcagtcgcaataaacctcaatgttcctttaacagcccgttgttcatgcaattcgataagggtgataatttgagctgccaagccacttttcatatcggcagccccacggccatacaacttatcgcccaccacttcggcagcaaacggttcatgggtccaagccctttggtcactgacattaacggtatcctgatggccggtaattcccagcacttcatcggtctctttcaaaccaacctcggcaaccaaattagcccgattaccatcaaagcggtcaatacggtacggaacatgatgaagcttgaacaaaccgccaatgtattcagccgtttcaagttcattgccattttcagtattgattttaattaagtcttttagaatttggagctgttcatcttttctcattaccgttaacctccagaatttttattgttattatcaatttttagtttgatgttactgttttgataaagacaaaaaagtccgtccctgtattttaatgaatacagggacggactttccgtgttaccaccctttatcacgattattttgcaataatcgcctcaacaactcacacttaagtcgtgtaagttcgggatcgtaacgtgtcctcacgtaggtatcgcttccacttacctaatgctcagagctcatcttcgttaacgtttcaaagccgccctttcaccaactgacggtcgcttactcaattactcggttaactactcttctcttcatcgcaattttatgttaatgaaaacatacgccatggtgaagattttgtcaacttaattgtgctgacaaagtttgaattgcgtctacattcagttcatgctacgctttgattgtcagaaaaaacacagtccggttggtagtccggatgcggtaagctttcttaccgtcagtatccttccctcctgggtcgtccatctgatgatcacaataaaaggagggctaacaatgactaatattgttagtggtacgttaaccgttatttttgatccaccattttataagggcatttttgaatgtcattttgcggagacctatcaaattgctcaagttattctcggtacttcagcgccaacatcgcggcaaatcgaagaatttttaatccatcgttggaagtcattggatttctttcagtctgatcaggtgccaataccccttattcgaaagattagtccgaagcgactttcacgcctcgccaataaaagtatccgaaccaccggggttggaacaaaagcccaacaggcactgcaaaagcagcgtgaaagtaaaaaagcggctcataagaaacagtataaaatgttcagggatcaacaaaaacagttaatttaccaaaagaaacgcaagaaacatcaggaaaaacataagggacattaatataaagccgactcgtcaataaatgatgagtcggctttatactataaaaaatcaaatttatcgtctaatttttaattggataaatttttggaaaaaacagcagtgataaagatcccagaccaatcaccaaataaatgaccgttggcagtgtcagaccggattggtcaaacggaagtaacggggcaccattaatatagaggtaaaagaaaaggactatcactaattgaaccggtcgcttgctgcctgttaggcgacctaagagttgacaaaccaacggtaattgaacggcccaaataaacaatgccaccatcataaaggctggtaccttactcaaagcggggagcacaaggaaaattgataacgcgatcccagcgagacactccctgagtgtttggcgtctttgaccatttggtatcgtccgcagccactgataaacatcgttttgaaccccgccggcaccaagttccgcaaataacggaataaccgctaaaaataaaattggaaacgccgaatgaatgagtccgctatacgtactgccccaattccacaaccaaataatcataatgattaaaacccaatagtttgtaacgccacccgttaataatctggacgatatatagaattgtgagtgtttgataccattcatttccatggctggtagccgtttggccggtaatcggaatgcaggtaaccgcatttcccacctacccatatgataagcgctgataggtcgacgctctaaaagcagggcggctaacacgaccagtccaattcccaataatacaagcagtcccatattcaaaaaatccaatcccgttaacttcaacgtcggaaaaacaaggttatgcgcgcccgtataccgagttgaggtactggcgccaatgacttttagtaacgttaacggcttcccggaggattgcaccacggcttgtttaatatttgtaattaagtagccgctgccggataagttgaataaacgcaggagatgaccgggggtgtgctgataattcgcccctgccgcatacaaaatagccaagaaagccactaagccggcagtaccaagtctaccgcgtaatcccggaatgaactccgtaaaaattgttaacgcagaaacaaaaatcaaaccaggtaataatatcaaaaacggcatcaagaattgacccagattaaaggttgtctgcccaaatttaagtaaggtgccaattagtgaaaagattaaaataattaaccagaaaatcaacatgagacataaattgcttaaaaatttccccatgatatagttcaactttgaaaatttagtggttaaaaacaatgtcatcgtgccattatcacgatccattcgaatcgtatttcggagaaaagttgccccgattaacggcaaaaagaatcccatcataaaactgacactgatcgatgcccagctggcattattggcttgttgatatgtatccggattgacaataattgcccgcatcacaccggatcctctgggaatcatcagtgagaccgaaaagatcagggcaatgcataacgcgacaaacgacatccgccgatacttttcccgaaaagtagcctgaaaactatctttcataaagaaatcacccctttaagggcacccaagtatgcttcttctaaactgggtaacacttggcgggcttgtggctgcctaggcgtcttcgcaatttctctaatttgaatgccgtccggccgctgaatcagtgaatttgtcggttcttccaactgtttggcagtcagcggagaagtgtcggccgtggtaaccggatactcccaaacatgaccgatacttcgttttattaaatcactgggtgtcccctgatataagaaatgaccttccttaattaacaaaatttgaccagcgatcgcttccacatcggaaacgatatgtgtggacagcaaaaccaaatgatcatttgccaactcacccaaaatatttcttaacgttacccgttcctcaggatcaagtccggtcgatggctcatcagcaataatgattttcgggtcattcagcaaagtggccgcaatgccgacacgctgccgcatgcctccggagaaatcttttaatcgcttatgacctgtatctgccaaatgcaatctttctagaagtgactcggtctctcgtctcgcctctttagctttcatccctttcatcccagcgatatagtttaaatattcacccgccgttaaattaggaaaatacgggacctgctgaggcaagtaacccaacagatttttcattacattgggatgggcaatcatgcttgtcccatcaatcaagacatctcccttggtcggtttctgcaacgtggttaatatcttcaatagtgttgtctttcccgcaccattcggaccaagcagcccgattaaaccaccatcgtgaagtgtcgcgtttagatcagaaaaaatctttgttttaccataactcatgctcagattttgtattaataattccatttgtctctcatcaacctcttttccggcattaaccaaagattcgtggttaaaatgccttatcacctatttattatcattaacctatttatcaatatataataacaatatgctttacgaaattatttgtccaacatagttttataatatctcgtttaaattttatcgttatagccgttagtatctaatcattgccttacttttaatggttaataatcgcaaaaaagcacccctttttaagagtgcttctgactatgcatttaatttttcctgtaacgcattcgttaatgtctcactaaaattaatgccgcgcttctttgcttcatcggcaagtgcaacaggaatcgtgacatttttatgaacagtccttttcttcatttgcttcagtttcgacttcatgtcaaccccgactaagctaacaactaagttaggatttttagcctgtatcttttttatatctgacggcttaggatatattggatagtctggcaatgcaaccgcaatcgcgtcaggtgcttctttcagcgcttcggtcaatgtttttccttgagataccgtatcgggaatatccggaaaggttactgtgtagtagccatcattacccgtattatcaaagatcgccggatatacaacataatctggatttttcatttgcttggagtgcttgaaattgtaactttattttagccccgcctgttttaagattgactgataagttcccggtgcaataactgtttttttgcttgcgaacggaatcgtgactttatgcccacgatcatccacaaatctatgatgatcgcctgattgccgactcttaagttcacgaaatccgtttctctttaacagttttaacacctcagaggcttttacttgaggcactcccttgactcctttctataggttattatacacccgtgtgtattgatttcatgtaaacatgagtgatgttcgaacaccactcatattgttatttacgttatttctttggctttttttcgaaaaaaaaagaagcaagatgaaaaatcatcttgattccgtttttcaatcagttattaaattttcaatcgtacagatcagccaactttttctgaacatccggatgattgataaactcatcatacgttgtgtcagccttatcaatgatcccgttattcgagacttcaataatatgattggcaattgtctgaatgaattcgtgatcatgtgacgtaaagataatggatcccgggaagccaaccaaaccctcattcagtgaggtaattgattccaaatccaaatgatttgtcggatcgtccattaacaaggtatttcccttttccaacatcatcttggacaacatgcagcgtactttctcaccaccggaaaggactttaacctttttatcaacgtcatccccggagaacagcattcttcccaagaattgacgaagaaaagcatcatcatcgcttcccttaggcgcatattgacgcagccagtcaataattcgtaaatcattgtcattaaattctgaagcaaagtcctttggcatggaagacattttaactgtttgaccccaagtaaactcaccggcgtcaggctgactttttccggctaagatctgcatcaacgtggtcgttgccaaatcatttcgactcacaattgcagtcttatcaccgggacgcaacgtaaacgtcacatcgtccaaaatcttaaccccgtcgattgtcttcgagattttatccactctcagcaaatcatttcccaatgggcgctcttcctcgaacttaatgaacggatattttcttgacgacggtttaatatcgtcaagtgtgatcttttcaagctgcttctttctggaagtagcttgttttgatttggaagcatttgcactaaatctggcgataaattcctgaagctctttgaccttttcagccttcttggcattagagtccgttttcatcttagcagctaactggctggattgaagccaaaagtcatagttgccaacgtacattctgatttctccaaagtcaacgtcacacatcatcgtacacgtttggtttaagaaatggcggtcatgagaaacgataatcgtaatctttggataatcagccagaaaattttccagccattcaatcgtataaacgtccaatccgttggttggctcatccaataataaaatatccggttcgccaaacaacgcccgggccaacagtactttcactttttgaccttccgtcaattcactcattaattgttcatgaaggtcttccggaatttccaaagactgcaatagctgcgacgcatcagcttcagcattccaaccatccatttcagcaaattcagcctccaaattggccgctttaatgccgtcctcatcggagaaatcagctttggcatacagagcatccttttcctgcatcacatcataaagatgcttatatccctgaatcaccgtctgcatgaccgtctgatcttcgaatccgtaatggtcctggctcaagcttgagattcgttcatttttatcaacgtgaacgttgccggtagtgggcgttaatttaccttccaataatttgagaaaagtggatttacccgcaccatttgcaccgataacgccataacagttacccggtgtaaattttaaattcacattttcatatagttttttacctgagagttgtaatcccatttctgaaattgtaatcattaacttcttttcctcgcgtttctgtatttccctgaaatcatagtgaaacaatttgattcaatctgtttgtatcgacagccgactttaacatcacatagtcacttgttattaacgctattattatcatcgttcggtccgcattgtttcacaaatcatttctataatcaaacaaagaggctgtggcaaactcctttgtcccagcctcaaacacatctcatgtaaatctatcatatatagaacaggttagcaatcccattcatccattatataaacaaattccaatctaattgagcaaaaaacgacctaccgatcaatggcatccagtttgtttgcccattcaactttaatatcatcatctgaaatgaccaatttcgtaattgccccattagcaatcggcacaccggtatccaagtccggcgcatagcggtcaacaatagaacggatcgtcataccgtgagaaacgatcaagattgtctgattgtcttcggtactctcccgaatcttatcaaaaccgaagttgagtcgttcccaaaacatcgcattattttcagcattattatacagatctgctcgatgaatcaaatctctggcacgctcaaggccaaaatctttaagcacttctttttccgaagtcttttgaacctgagcccccacaaactgccacatctggtttaaatcattaccctcgaaataaccgtgaaactgttcccgcaattccggatattgataactgacaatatttatattgtgaggatttgcccgcaatataatccgtgccgtatcaatagccctgcctgaatcactggaaaatgcagcattgaaattaatgtccttcagccgttcaccagcactctttgcatcttgaatccccttttcggttaatggtgaatcaatccatccctggaccttgttatacaaattcatgtacgtttgtccgtgtcggacgagatatgcagtgacttttttcacgagaatcagcctcatttcatattttttcaatcatatacactctaagtatagcgaatcgcgaagaaagaatcacttaaaaacaatcgcaacccacaaaaatgatttaaatcacaaattattttgccattattttttcagaatcaaattatcaaataaagcaacatattttgttatacttattgtgaaggaacaaactaagtgagtactattcgtcttacgcatgaaaggacagaaatccaatgacctatttgttaaattttgcgccttggcaacaggcactcttcgccacactttttacatggggcgtcaccgcccttggttctgctcttgtctttgcatttaagaccattcgaagtcacgcacttgccatgatgtatgggtttgcggctggtgtcatgattgctgcttctttttggtcactactggatccggcaatcagcctggctgaggagttggataaaacgccatggctggttgtctcaagtggctttatactcggtggtcttttcttatacgtggccgataaaattattccggcactctacatcagacacaacgagaacgaagaaccaccgcataaagttaaacaggcaattctactggtcttttcaattacccttcataatattccggaaggattagccgtcggcgtagcttttggtgctatccaagcagccagcagcgcccagcatgccactatggtgctggcggcggtaacggttgcaatcggaatcggcctgcaaaacttccccgaaggtgctgccgtgtcaatcccactgcgacaaaatgggatgagccggccgcgggctttcatgtacgggcaggcaagtgggatggttgaaccaattgccggcattttgggtgccctattagtttcctatgtcagtcaaattttaccatacgcactggcatttgcggctggcgcaatgatttacgttgcttgtaaagagttaattccggaagctcatgcccgaaccaaatccgaatcacattgggccatttttggtattatggctggttttactttaatgatgattctggatgtagcactaggctaaaaaaccgttcggagaaagatcctccaaacggctttttaatgactaaagcatgatcttaatgatgcggatattgatggccgatttcataaaccatttcaggttcctgactaattcgtgtgttacggttcaagccatcaacctggttcatttcatcatcgctcaactcaaaatcatagatatcggcattttgctgaatccgttgcgggtgaacggatttcggaataaacgcgtctcctcgttgtaaatgccaacgtaaaataacttgagctgctgacttaccgtgggattcagcaatcttaacaatcaccggatcatcaaaaatccgtccccgtcccaacggtgcccatgcttgggtgacaatgtggttatcgcgatcaaaatcaaccattgcctgttgagatagatatggatgaacttccaattggttaacaaccggcatgtcatttgccttggtcgctaagtattgtaaatgaagcatgccgtaattactcgttccgattgatttaacaagtccctgctctttcaaggcttcaaaggcacgccaagtctcaaaaaaatgggtatgaattggccaatgaaccaaaagcaggtcaacataatccagttgaagtttcttcaaagaatcctcaaacgaagacatcaccttatcatatccctggttttcttcagcaattttagtggtgataaagatctcatcgcgtttaacgttcaaatccttaattgctttaccaacagctgcctcatttccatacatctgggcggtatcgaataaccgatagccatcgctataggcggacttaaccgagttaatcagctgatcctcatccgtcatacgatagacacccaacccctggacgggcattttattgccatctgctaattcaattctggaaccgatattttgcttagacattaaattcctccgttttactttaattctttaataacatgggcagggtttccgccaattaaaacgttgtcaccaaatgactttgtgacaacagcacctgcagcaatgatcacattgtttccaagtgtgacatttggggtaatgacaacactgccaccagcccaaagattatcaccaattgtcactttacccggaatttcaatgccacggtttcgctcctcaacatcaaaggcatgatccaccgtatagatttggcaatttggaccaagcaaacaattatcaccaaatgtaatggaggcaacgtcaataaacgtgcagccataattagcaaagaaattattgcccaccgtaatgccatatccgtaatcgcattgaaaaggtgccatcacctcaaagtttttccctgttttttgaaaaatattacttaaaattttcattgcttcatccggggcttctttggacaaatcgttaaactcattaattcgttttcgagttttccaacggtcttctgataattccttatctgtattcaaatacttcttacccgcgagcattttttgcttttcagtcatcgccattgattattttcctccggttccgtttttattaaccactaatgacattatagcaaatgcccgcagtttattttttgaatgacatattaaaacgaggttgagacaacatttaaattgtcttaacctcgtttttttagtgcgttacattcttcctagaataaggtcactattttaagattagcttcacacactattttaggactgttccgctaaccataaacctgcatgtaagctgacagccatcaaattccaaggacaggaatttgttacctgccagcttacactccggtttatcccagattagcttcacacactatttgatatcgttaaatggaagatcaaacattgttgcaagatcagcgatttgttgttcactggcagcaaatgtcaatacggtatggtgaccgccaccatcgtggatccattgagtagcgccggccttcaagccaacttttggtgtccacatttgttttgcaactggaagatgtggtgttggctttggagctttatgtccttcaacagcgtaaccaatcatgcgatattcattaccaaagtctgagatggtaacatcgaatgcgtcaccttcacggccggtaaataccaaacgtgcaggatctgctttaccaccgatgtccaatggatgaacttcaacccgaggcttgtcactggcaatgcttggatcaacttcaagcatatgtgagccaaggattgcttctttgcccttttgtaattcaagggtgtagtcttccatgaaagcagttgattggttatgagtcaagactttgagcaaacgatccaaagcggctgtcttccagtcaccttcagcaccgaagccgtaaccgtcagccatcaacaattgtgctgcaagacctggtaattgttccaaaccataaaggtcttcgaagttagttgtgaaagcagtgtaattttctttatccaagaagttcttgataccgaagtattcacgaatttgataacgtactgaatgttcgtacttatctttatcgttgtctccttgaacaaattcatacttatcttgtaattctttgtatttagcatcaatgtcgctttcagaaacggcgttaactgcttgtaccaaatcgcctaaggcatagtaatcaacagtccagccaaattgaatttgtgcttcaaccttgtcaccttcagtaacagcaacgttacgcatgttatcaccgaaacgggcaaccttgatcttgaagctttcattataagcaactgcgacgtcttcccagtcggcaatttcttgttgaacgtcttcgtcaccccaccagccgtaaacaatcttgttgttcttacgaaggcgggcattgataaagccgtattcacgatcaccatgagcactttggttaaggttcatgtaatcaaagtcaatggtgtcatatgggatgtggttcaagtattgggtagctaaatgaagcaaaggcttctgaagtaatttagtacctctaatccagttcttggcaggtgaaaatgtgtgcatccaagtgatcacaccggctacgttatcgttgtagttggcatccttcattaattgagtgatgctgtcagcagtagtggcaaccaacttaaacttgattgggtagggaagcttgttggtagcgtttaatttgtcaacgatatcacgcgcatccttctcaactgatttcagttgttcttcaccataaagatgttgactaccggtaacaaaccaaaattcataatcaggaacttgtaacatagtattttctctcctctttggttaaatattaatgaaacatttttattaatatttgagatcaaagtctcaaatattgataactatttaatagctgaagtatcggattccttgattccagcacgtttgtgaaggtcaagttcgatctcttcaagcgatttaccacgagtttcaatgaacttagcgtgaacgaagaagatcgcaattccgcagacgactgcgtagaacaggaaggcattatcaagtccccatgcactaagcatcattgggaatgttaatgaaacaaccatatcggccaaccagttggtagctgagcaaagtgatgttcccaaaccacgaatgttgagtgggaagacttcaccaatcagaacccaggtaattggagcccaagtacatgcataaaaagcaatgtaaacggtcaaggcaatcgcactaaccattgcggcagtttgagaaccactatcgaacttaagaattgtgtacatcacaattaaggacaagcccatgccgctggcaccaaaaattaacatctttttacggtcaactttatccatcagcaacattgcaacaaccgtaacggcaacgttaatcacaccaattccgatatgggcaagtaaggcagcgataacgccccagccaacatcggtaaagatcgttggtgcatagaagataacactgtttgaaccgataacttgctggaaaacggctgcgccaagaccagtaatcaaagccggacgaactgctttaccaaataattctttccaaccaccggtcttctgtgaagctgtttcttcaatttcactcattgccttgttaacggcaccttcgtcacccttgtttgtgttcatcaaaacagaacgagcttcgtcttttttaccgactttaacaaggaatcgaggactttctggcaagaacaacgcaccaacatataggatggcagctggtaatgcggcaaatcctaacatccaacgccagccagtatacatatgagcgaatgtgtagttcaaaatgtaggctaataagataccaatcatgatcattaactggaacattgttgcaaccgcaccgtgcatactctttggtgcaagttcatgcagatacgcaggaatcaatgctgatgtaataccaacaccaacacccaagacaatacgggtaattaacaatacccagaagtctggtgcaaatccagatgtaatggcaccaatgaagaaaatgatcgaggcccaaacaagtaacttacgacggccatacgtatccaaaaacttactggttgccaaagcaccaataatggcaccgattaaaacagaactaacaaccataccctgttgccatggtcctaagtgaagttgtttttcaataaatagaattgcacctgagatagacgcaatatcgtaaccaaaaagcaatccgcctaaggcaccgaaactatatataaatccgtttgaaactttcttcaaaacgagcaccccattcgactttttaaaataaaatcaacaaaacaattgcaaaaactttgtgcgcacactgtaaacggtttctgacatcgcttacaaaagcagtataaaatatttatccgcataaatcaatacatattttatttgttagcataacaattttttgtaaaaaaagtcgaaaggggttcgcatgcctgtaacatcaccacctttcgtgattcgttcctttccaaaaaaatcagacggtcttggttgtatcgatagctttggtagaatctcgtacaaccaattcagcatcaaagaccttagaacgatgctcttttttattaatcatatcaatcagcatttttgcggccgtttcacccaataaacgcttaggatgaatcattgtcgtaatccctggattaatatattttgaaatttcgtaatcatcaaaaccggcaaccgaaatatcaccgggaatatcaaacccttctttgcccaacatcccgatcacttccattgccaactgatcgttataacaaacaatcgctgttggccgcgcattatccggtacttctacacgattcttgatctttcgaaggacatcattaatgtcatcaccggaacgatacatcataatatcaccggaagacgcaacgttggggtgtgtctgataagaacgaatgtaaccgttcatccggttaactccctgcatatcatcaacctgaaagacacccaatacccgttcatgcccgtgatccaacaaataatccattaatttcttctcgctggcagtgtccgccacttcaacatatggaaaatccaattctggataatgtgcattaatgaaaacggcaggtttaccggactgaataatcatctgataaacatccaaattgggattttccaatgtgcttcgcgtcggttcgataataaatcccaggacatcgttatccaacatatttaataaattatgccgttcattatcgtgttcatcatgggtatttcctaaaagaagagagtacccggcatcagaaatgacctgatcaattccactgataatatttggaaaaatataatccgcaatgtgggttgtgatcacgccgatgctttgatttgaacgttccgaacgaactttattgttgatccaatcattaacgtacataccaccgccctggacacgataaatgtatccctcatgttcaagatcacctaccgctcgtctgatggtatatctactgactgaataaattgccattaattcggattcggtggggattttttcgttaatcttatattttccattaataatatggtgtttaaggctctttttgaccatgacatactttgtttccattttgttaacccccactcgtttaaaattgaaagtctgcaagactatcttttgtgcacttatcgagatcattactatcatttgacgtactcatcgagctgtttgtagataaaaaagccactttgcttaacccgattattttccagcaccggccgcaaacattagaaccaccgttaatgctaacgttgccaatgtccaaagcccgaaatgatggttatgctttggtttctcttttcgggcatagtcaaagccccatagaaaaattagaacaattaaagacacgtctgatatgcccgataaaatgtacagtatattttgcataataaacctctcactttttcccttagaatatccctaccaataaaatatcatacttctaaggtaaataacatagaattgtacggataaatgttaaatattggattggacctccgtacaaaaaaacattataatacatataaaagcggtttcaaagcttaaatttattatttttaaggagcggttcataaaaatgcaagcaaaaaaagaattattcgataaatataacgatcaagatattcaaaagttcacgttaacgaatgacaacggcgtttctatttctgttatctcacttggcgcaacttggcaggcatttaattttccggataaaaatggtaaaacagccaatgtcttacttagccaagcatccagcaaggaaattatggcaaaccaatacttctgccaagccattggccgaactgccggtcgaattaccaacggtactttctccattaaaggaaaagaataccatgttgaccaaaatgaaggcaatacgacacttcacggtggccctcacggtttcaatactcaagtatggaacgggtcaatcgaagataataagattgtacttgaaaaacacattgattcatccgaagattcattcccgggaaatatcgacgttaaaattacttggacattagacgatgataatactgctactgttacctatagtgccaaaagcgatgctgatacactgttcaatccaactcaacatgcttactttaatttaagtgatgctaataacgtttacggtcaatccctcacaattgatgcggacaactatttggaattaaataaagataaaacaccatccggaaagatgatcagtgttgccggatccgcctacgatttccgctcaggtcaaaacatcaagaatggtattgacgacatgaaagccagcgttggtcatacttacgatgaagtttatgtcattaataatcataaagctgaagatccgatcgctactttatccgatccggattccggtcgtcaagtttcaatcttctccaaccgaaatgcgttggttgtctttaccccagacgatttggatggggttaaattcgaacgtggtgcaggtgttcctcatatgggaattgcaacggaagctcaaaccttacccgatacgccaaatcacaagggctttggtgatatcgtactgccagccggtgaagaaaagagctactcaatcagctataaagccgaattctaatttagcacgactacaagaccatttttattcaatcaacatacgatgacattgaggtccaattaatgaactgactgcgctcagtcttaattggatctttttgtgtgacaggcaacataagataatatccaaattcctaaaagggtccttgccgaatcgatgttcaatcggcttgtgaaatcggtttcacaaatttataataatggagacccataaaaattttaggaggatcagactatgagaacatttaagtttcgttggttggggttactagggacgattggtatcgtcctgattttactaaccggctgtggcaagagcaattcttcatccaattcaaagggaccgctgatctgtgcgacttccggaacactttatccaagttcatttcacaatgaaaaaggtaataagctaaccggttttgatgttgaaattgttcgtgccgttgctaaaaagatggggcgaaaagttgaattcaaagaaatgaacgttgatggtcagttgaccgccgttaaaaccggtaaggccgatatcgccgcaaacgacttttctgtttcacctgcccgagaaaagcaattcgctctatctacgccttataaacattcgtttaacagtcttatcgttcgtcaaaaagatgattcaagtattcattcctgggctgatattaaaggcaaacgggcggccggtgaagccggaaccagttatcagcgacttgcaaaacaactaggtgccaaaccggtcaactatgataacgtctcaaatgatatttacatgaaagatgttaaaaatggtaaaaccgatctgattatgaatgactattacctgcaaaagctagccctggatgcggttccaaataacggattaaaaattttaagcaatatgtatttcaaaactaatgaagacggcaaagggaccggcattattatgaagaagggaaacacgaagttacaaaagcaaattaataaggcactggctgaattaaagagtgacggtactttaaggaaattatcagagaaatattatcacgccgacgtttccaaacagccgaaagtccatatttcaaaagctttcacaatcaagtaggtgatgcacttgagcatactcaattatttctcaattccaaactttttcaacgcccctttggcattccactcaatcccaaaaattttggctggatttccaatgtcactatatttaacagccattagttttattggggctttgatactgggtttgtttttaacactagctcaaatgagccattttaaattacttcactggcctgccagagcgtttatttcctttatgaggggcgttccgatgctggtattattattcatcatttactttggctttggtgcaaatgcattgccagccgctgtgattgcctttacgattaattgcagtgcatttgtttccgaggtctttcgttcctcatttagtgccgtggaccgcggtcagtgggaagccgcgtattctttggggcttccctatcgaacagtcatcgccaaggtgatttttccacaggcctttagaatcgcaatcccggcattgggaaacattctgctggacctatttaaaagtacctcgctggctgccatgatcacggttagtgaaatgtttatggatgcaaaaatcattgcaggtgcctatcaggactatatgagtatttatattgtcatggctatcatctactggttcttctgctggctgatgacagtggggcaaacccaactggaacatgctcttacctaaacattttccataaaaagttttcaattccgcttctcgatcagcgttgatttggaaacttttttacggtttccaatcccccgctcccgtcattattaaaacgctaacaactgattgggcatcgatttcaaacggttgcatcactttatctaaatgttataatcgacactaatttctcaatcaatttgaaaactcgaaaggaagcgttggatgataagtaacaccaaagaagattcttcagatagtgatccggccaatattaataaatttgcagatgtggggttaagaacactaatggctttcgttggcattgccattctttcatcggggaccacccttcttcgtgaaggaaatgttggtttggatccattcactgcaatgaatacgggcttggctgccaaaatcaacaccggcctcggaaacgcacagttaatggtcaacctgatcatttttgttttaattctgatccttgatcgaaaaaagattggtattggcactattttaaatatgacattggtcggctacgagattcaatggttgtcctcggcatacaaaatgattctgcccaatagtattaatatttttacaacggtcgccaacttaatcgttggtctgttactctttacccttggctcatccctttacatgggtgctaatctaggggttgccccctatgatgccattgcaccaattgcgtctacacggttacacatcaagtaccgttctgccagaattacacaggacgttttatttatggcaactgccttctttattggcggagcagtcggctttgccactatcattgtggccttctttaccggacctttaatcacttactgggatacccatgtaagtgaaaaagtaaagcagggcattaccaatttcagctccacacccagcttttcaactgccggaaagcagctggccagtgtgggtaaaagcagctattacaccgttcggcgagcctacgaactcactgaacaaacacagcgccaattatcaaactattcgaatcaggaactaaatgaccgaattgaaagaaccagaaatcgctctaaacaactcggccaagtatacgaaaatactcaaaaacaactcagactcttgcagggtgaagcagacaaacggagaaacaactaatggtcgtctgcctcactttacaacggtctaacgacaaattcacggaggattaatcatgtgtaccagtgtgacctttttatcagaaaccggagataattttcttgccagaaccatggattttgatttcgatttagacggtcggccagttgtcattccacgtcaccagcatttcaacagcgatgccggaaaagatggatatgacaccaagcttgcctttgtcggtgccggccgaaacatcggtaattatattcttgtcgacggcgtcaatgaacgtggtctaagtggtgccgccctttatttcagcaatgaagccagttacgccaaccaaatcaaatcggatcaaacaaacattgcttctcacgaagtgcttaattggcttttgggaaacgcagacagttgtgaagatgcggcggacttaattaaaaagctcaatgttgtcaacgtcccgattaagctgctgggtaaagtagtcccattgcactggatcctttcagaccggtatggtgactgtcgcgtccttgaaatcagagcagacggtgttcactatcttaaaaatccggttggcgttatgaccaattcaccggattttgattggcacttaaaaaatctgaacaattatacggaattgcagcccaatccccacccggaccgtgattatagtggctatcacatctcgtctttcggaccgggaaacggtgctttgggaatgcctggtgattatacatcggtttcccgatttgtcagaacggcttttatgcgtcaatacacaatcagcgcccaaagtaaggatgccgttaatgtattgagccatatcttgaattcggtcgaaattcccaagggcgttaagctcaaggaaaatggcgattctgattacacgcaatatcggggttacatggattccagtcgcttaacatattatatgcagccatacgataatcaaaccatttcaaaagtaacgttgaccgacacattaatgaacaacgatcgccctgttgagttcccgctgacacatgaacaaacttatcaaacattaaattaattttaaagacagcattctctaatgattgctgggattaccttctttttacatgaacatcttaagtgaacaatcatcaaataaaaatcacacttcacctgttattgggaagcgtgatttttttagattaaagccacttattttactatttaatcgccttttgatccgtttccggtccgaataaaccgataataatcgctgcaataacagccaatccggcaatggcataatagataaacgatggtgatacccgggtgatcataacggcgacaaaagtgggcatcaaaacatttaataatttagatgtgccgtttgcaatccctgcaccccgaaaacgatgtgcggtttcgaacagttcatttgtataaatactaacaaccgacgcaactaaaatatagagtgtcattgttaatagaaaaccatttatcaaaataccgcttgtactgcgctcataggcataagcaattcctaaaacagcagttgcaataaaagccgttaagatcagcttttttcgtccggttcgatcaatcagtaatgcgcctattgcagctccgattggtgcaccaatcatcatgatagccgagaagctgattgaatctacgatgttaataccctgcttcaaaagtaaggttggtacccatgacgtaaaggtgtattgacataataaggtggcactcactgcaacaatggcaataaacaaccctttagcaaatgaaatatggctaaccggttcatcggcgtctttcagctcatctttttcgtataggccattaacagttaatttttcaataatctgattagcttcctgggttcggcctttggataatagccagcgcggagattccggaaaatgcctgcgtgccaaccaaaggattaatgccaatacgcccattgtcataaacattgaccgccagccaaatcggggaatcataaaggaagcaatcaataacgttataggtgcaccggtatttgcaacaatcgcagtcattcccgaccagtgaccccggcgtttaatcggcgcaaattcattaacaaccgcatagccggtcacaatttctgcccctaaaccaatagcggcaaaaaaccttaaagcaattaaaattgtcatatttggcgtaaacgctgaaagtaacgtgaaaatgccaaacagcaataagttaaaatgatatgacagctttctaccataaaaatcaccgatgtatccagcaagaatggagccgataaagagtcctaaaaacccacttgataagaaaaacgagccttgggaaatactcgcaaatttatcttggatcagggtactgttaattgcaccggccatgtacacatcagccgcatccaaaatcataccggcaccagccaacgcgaaaactttataaaaaagtggcgtttctctggcatcgttcaaccgggtttctaaagaatccttatgatattcagtatatatgttatcagccattggcaaatcctccgtttatgtgtttgttctatgtgaaattgaactatgtgatatgtgtttttagcttactatgttgacttctatgtgttttaaaatcactcattcatatagacttttttcatcttttccggtgaataaccggcattccttgcattaactttatccaacccaacaaactcgttgaacttggggaacgtaatcattcgatccttataggcttttgttgtgccatcccgacgcaaagtttcaatcagtgtcttttcagcaaatgcctgtgtataggtcatcgcatttggatgaacgacaatgttaaatcccaggcgttccaaatctgccgtttttgtcagtggtgttttgccatcttcaatcatattggccattaacggcgtgttcggaaaggcttcatgaattttttccagttcggcaacactttgaggagcttcaataaagattaaatctgcacccgcttcccgataacgcttgcttctggcaatcgcgtcatccaagccataaactgctcgggcgtcggttcttgacatgatcaaaaagttgtcatgctttcgggctgctttagcggcccgaattttggcttccagaacttcagtgggttccactttcttaccgtccatgtggccacaacgcttcggccaaacctgatcttcgataaacatgccggccgccccgattgcttcatagttttcaaccgttcgcctgatattatcaatatcaccgtaaccggtatccgcatcagcaaatacaggaatgtcaaccgcatttacaatctgccgacaacgttccagtgatagtccaaagtcggcaatccctctgtccggcattgccagtgctgatgcacttgtagcatatcccgccgaaaagaccgcttgggcaccctctgattcagcaattttagccgctaacgcatccggtgccaccatcattcgcacaatgtggccactcataacttcatctttaaattgggttctcattcgttcatttttcagcataggcaagtcctccctgtttaataaaattaatagcttgattttgagctttctgaataacagtcgataaatagcctttatcaagccaaccggtaatcccatcaatttgctcggtaccaggctgccaagtcgccagcaacggcaatggcagcttcatttgtgttagctctcgaagttgctgaccatcgtaatggtcgatagcaatggcatccgcacctgcttttgcaagatactgaatccgttcaataatcccttcaatgccataggaatggatgccctccaatttaatccaaatccgggtgtcaggattttcaaagctatccttggccgccctcaacttaccaatcaaatcctcgggcgttgttgtcaacggtttggctgtggtgtgagccggataagtttgatcattcaataacagaatgtcgccgccagacctttcaagttctttggccgcgtaataggtgttcaaaggattaccaaaaccggattgaaggtcggcaattaatactcctgtcttcttgagtcgcatatcgcgcaaaaatttagcatattcagacaatgtcagcattccctgtgagtcttcagcaatcaaattcctgcttgtcaatgttgcatccagcaacattgccggaaatgattgtgcgcttagtgctttaaatgtgttaccgtcccctgaagcgggaataattgtttcgggccgattgtccaagtaatctagtaaagttgttttagtcatatagattcctccattctcataatcgttaaaaaattgccataaaaaaatgcacccttcaacgtatatcaatatatactcgaagggcgcattcagatgcacggtaccaccttgatttcattagattcaaaaaataaaaacctaatcttagcgaacacaactttatcaattgtagtcgttggccttgtaatggtggcatccagtaaacactcagttaatcgcatctacagctcaaagcctactttcgcttacttcccacggtttcctctcaccaaccggaaactctcttaacatgggttataagctactcccgcttttcattgcttttcttaacgttttctaattgttaagtataataactcattaatttctaattgtaaaccttttttattttcacagaactactttaatccgtgtggtccccacgagtccaccaactcatagttcccaagacaccaattccggcaacaacaatgacggctagccaactaaacagattaacaacaccgggtttaccgctcaaaagcatcggaatcgaccatggaaaataatgaccaatcgattcagcagccattatcttcccaatcaacaaagccgcaaatgacatactgattggcatcaacaatcccttcgacaggctggccagtaaaggaaacaggtaggtcagaccaattgctgcaatcatcgacatcgcgaatcgttccagtaagactaagatgactgttgcgtgaaaggcgctcaggtgaagaatcaaaccaagaataaacagccaaccaatggacaccaacgcaagcaacacttctgtgatggttagcgaaatcaacttcgccccaacaatctgattccgggaaacgggcaatgccaacaggtctttaaacgtttgatcctgatattcccggccaaatacccaactgctgagaatgccaaatcccatcatgcccatcactaaggtgaaccagtttaatttttcagaaataaaaccggaccatgtatgggaatcaatatggaaaaacagcagaatcgcaaatgccaggaaaagataaattggcagacgaccgcgccaaattttttttagttcaacttcaatcattaaccacatgttttctacctcctatctgtcgcaaaaagaacgactccaaatcttccttcaccgggttaaaactggttggtcgaaagccctgtccttcaattgtgtgcagcaatgacgcatagtcggcaatcggtaccccggatatcgccagttcatgttcatttaaagccattgtctcaagccctttgccattcaagaagtcagccaataggtcaatctttgactcactttgaacagtcaattcggtctctcgctcctgatcaaattgatcaaagcttaattctctcaataagtgaccgtgtgccaaaataccgattcgattaaccatctcctccatctccgccaataaatgacttgagataaaaatggttgtcccattttcagcgagccgtttcaatatggttcgaaccgccaccaagctttcaggatccaggccgtttgtcggttcgtccaataataaaatagccggttgatgaatcaacgttttgaccagtcctactttttgattatttcccaaagataaatctttcacttttacattcaagtaaggtgtcaacaataactgatcagccaatgtttcaattcgtttcatcatttgatttggctggatcagccgttgtttggcatacatgaccagattttctttgacggtaaaatttggataagcgtgtggcgtttcaatcatataaccaacatgattccagaatgtggccggtaaagacgaagcatctcttccctcaatcatgattgacccggaagtcggatgaatcattttcagtaataagcgcatcgttgtcgacttccccgcaccatttagacccaggaaaccataaatatcaccctgatcaacgtttaaattaacatctgaaataacctgtttttttccaaatcgttttgataaggctttagtttcaatcattttcatataagacacctcatttaaaattaggtactttaagtaccttataaagaaacatcctaacatcctcatttaataaaagcaagtactgaaactagccttaatcatctttcgtcattcaaatcattaagaaacgcaaaaacgacttgctttaaatggcatccacttaaagcaagtcgtttatcgacagatccaaaagattaatggtcattgcgcgttgaacaccggcaacaaaatcttatctaccaagaaaacaaccgtctgcaaattatagtcactttcactaatcacccgcgacagtatgagtaaaataggcagattcataatagtgacatcaaatgtttgcggatcggaagcgagctcgcctcgcttatacgcccggtttaataatgccatgacatactgaacaaccaaattatccgttgacagctgcttggccttttccgttgatttctttggtgaatattgcctggcattttgaacggcagatagtctatcgcgggcaatttccttgatattcttcatgccgattaatttaactatcggcacaccagcagcgagaagctcaataagatctccccgtaaactgccggtatcaggagctgtaaatttcttgactgggacattttttcgaagtgctgctgttgtcacatcaaatttagttttccatcttcgataaatcgtatttttattagtatgcgctgttttagcaatatcatccatcgtcatatttgcatagccggtttcatgaatcacctgccacgttgcatccaatatcgcatcttcaagggctttaccccgtcgacgatgcgttttatttgttttttccattttaaacacccttatgtgtatttttataggactgtttcttaaattggctccgcacactttttaggactgctcctctaatcataaacctgcatataaaccaacagccatcaaattccaaaaaaggaattcgctgcctgccggcttacactccggtttatcccagattagatccgcacactttcttattgacatcctaaaaaaaggtagtattatctttagcgtacgttaagtaccttaaaggagaggattgagaaatgaatgaatcaatgattaaagaaaagaaagagccctcaattgctacaattggcattgtactcgttttaggcgccattgtgccaatgctggacacaaccatgaccaacgtcggtattaacactattctgaaagatttaagctcaactgtcaatgtgatgcagtgggtagctactgcttatgtgctggcattagggttagccgttccacttgccggttggttattggatcaagtctccggccgactactgcaagaagtttcgctgattatttttatgatcggctcattagtttccggaaccgccaactcaattccggcattaattatcggtcgaattatccaaggcgccggcgctggcgtcatcattaccggtatgagtgccctggccattcgagccgcccatggacaaaaccttggtaaattaatgtcagtcattggattgccaattgtctttgcaccaattctgggtccgaccgtcggaggggcattgatcaaatatttaaattggcactggttgttttacattaacataccatttgttgtggcagctttaattgcaacttttgcacttctgcctaaattcaccccatccgccaagggaaaagccttcgattttcttggcttccttttaatcaccggcacattttccgggatcgtcattggtattacgaattatagtgccgataacatttttggcaaactctccgttctacttccagtatttttaggcattgattgcttacttgtctatatcatttatgccttcaaacagccaaataaagttctcgtccctcttggtctttttagtagcgccaacttttcagcttcaacagcgttactttttctatccggtttaatggtcaatggtgtcatgttcgttttgccactgtatctacaaaacatccgccatttgagcgttatctgggttggcatttacctaattgctcaaggtgtaggaatgttggcaacccgatcaatcaccggtaccttaactgacaaatacggtgccaggtggattgtgatcacttcaatggttggagcagcaatcacaacacttcccttcgccttctttacggctaaaacttccgaatggttagtcttgtttgttttattcttaatgggactcacccgaagtggcattacaatacccgtcatgtcggatgcttatacgggattggatccaaaattaattccccaagcaactgttgcaaccagaatggcacaaaatattggcggttcgattgccactgcagtcctggcaggcgttattcaaagcatcgtcggaaataatgttgccgcagatgtgacattaaacaatgcctatcaaacagcctttatttggacaagtatcggtacacttctaggcgttattccggcaatgttcctaagcaatcgcatcggaaagaaggcaaactaatgttaatcctgatagtgattattttatgcattgtagctggagtcagtttttataagcatcataacctcttgggaagtataacaatcgtccttctgatcatggctcaagcactactggtgatggactcgcaataccactatgccactaaagttaacgacgacatccatatctcacaggtaaaaccgattaccagtatccacgacaaccacgtcatggtgacaaaaggaattaaggagggcaaaacaacctatcaggcctttgtgaccaaaaataaaaccaattcaaaaaaccatatcattttaaataaagataaaaaggttctcgttaatcgagaaaagaatcaccaaaaccaacttgtgacaaacaatcatcaataccaatatacaaatcaatttgccaatctattgtttgccggaattaccaatcaaaaccaattgaagcaacaagtcgtcacttataatctcggcaatgactggtatctcttaagtaaaggacagttaaaatcagtcgctaaaaaactaaaatccaagagcttccaaaacaaattgacaaataccgtcaagataagtgttcagaaaaaaataaagcggaatccgaaattgcttaagcagcctcaaaaactaaaaataatccaaaaccaattgataaaaagtaagatcgggtcactgttaaaagactctgaggcttcaaactaaaagtcatatgatcattaaatcaactcaaaaacgagacaggtgcaaacgtcatgtttacactaatctcgtttttttagacaataaaatcaattcatccaattctacatgacgacaaactcactttatttatacgtctcctatttatcaaagagaaaaaattcagacttatttaaaacattggccgatcaccatcagtgttgggctttgaaatacctaaactactgttttcatgccgaccgggatctttgatcacttttttagttagccccttgtgcaattacagtataaaactgtttaccaccaacggtataaatgctggaagccgcgtgatcatcaccgtacgccaggtcttcgtaagcaacgggtgtatggtgattatgaatggtcagtcggtatttataagggccggacgaccggacctttttctgggcaatcccctttacttttttaccggtatagagataagtattagcgcccttttttaaggtacgattaatttttgcggcactttctggcttggtaaaataactggaagtagccgtgccacgtacgccatccatgtcaatgctaggatagctttgaagatgatattgatagtattccagccaaccatcggaagtgatttttaaggcatcactttttcgtgaaggaagttcggtaattgcctttaacccaccgctcaacatggttccacttccgtacggtaacacatacgccggtcgtttaactcgagtcagtttggatgttggtagtttaaactcaaacattaaattgccattcccataaagtgccttactaactgtcttgcgctttaaataatagctaatatccgttgtcataccaggttccgaaattgcatgcttcttaaacaatccactggcagtgatagtcgtcccctttggtaatattgtggccttcacgatcgttcgagaatcctttttggatgaataatgaatattaaccttcatttttttattaattcgataaaaacggtttgtaaataatcccggatcatctttaagggaactttttgaaacgtgaatataagttgttttagcctgtaccggttgatgattggaaatggctatccccataaatgcccccaagaacaatagtaataattgtttcttcatcttaaactccttatctaatcggtgaacgactatccaacagtagcaattgagtacatcggagtaccaccaaaggtatacaaactggcatataaacgataatggacagttgggtcaattctcgaatacggcgtatgcaaattatgaatggttaaccgataccgataattaccaccccgatgaatatgtttatcactaacacccttcagtttggatttgaaatacagataggtattagcaccctttttaatagtttttctaattttaacatatgaattcggcttctgacggtaatcaaatgtcacctgctgatgcttttcagtgaatgtgattggatgataacgatagtattccatgtatccatcagtcgtgattttaaccagatctgcatgatagtttttatctccaaaagcctttaatccaccagtataaaaataattaacctgatttggaaatagatatgccggtcttttaacccgagtcaacccactttttttgaaggtgaacattgccggcaggaagccggtcccgtacgtcccctttgtataagctcgacgtttgacatagtaactgagatccggtgtataattcatcaccggattatcattaacactgccatcagtcacaatcgttccctttggcagcgttatgtgtcgaacaacgagattcggacccgcgcttccactaaaacgaatagcaactctcttagcttgattcaaccgataatatgcggtcgcaaattgtttgctcattgcattaacggtcgttgctgtctcccgtacaggcttggtgttgacggttgaagcaccgactgttatgccggaaataccaaataacaagccgacacaaatgattgctgagttccaaccgtttaaatattttgtcaaaacaccagccatgttaaaaagccattttctgatttgtttcatcaatcatcctacctccaaaaaatatatgcttgaattaaatcagccaacctaacttaaagatggtgatcggtcattgaaagctaccaataacccgatcaccatctttttatcttaattggcgttgattttgtctgccacatcccgaaccattgccaactcctcatcggctggaatcaacaaaattcttgccgcagaatctttagtgcttaaatctccgggggcttgtttttcgttcaacatgccatccaacttaataccaaagatttccagcttcttgcagacctgttctcggacccatttgtcatgttcaccaatcccaccggaaaagacgattgcgtcaacaccaccgagttccgtgatgtagctggctgcatatttaaccgttcgattgacaaagatatccagtgctaatttggcacggtcatcatcagagctttccaaatcccgcatatcggaggagacccctgaaatacccagcaatccggagcgatcattaaacatttcaatcacttcttcagccgaagcacccattcgtttcataaagaacggtaccaatgccggatcaacatcaccggaacgtgtgcccatggttagtccgttcattggcgtgaagcccattgacgtatcaacgcacttgccatccttttcagcagcgaccgaagcgccggaacccaaatgaagtgtcacaagtttagctgtcttatagcctaacaactcctgggctttctgggtaatatagccgtgattaatgccatgctcaccatatcgacggattgtaaactttttggttagttcatacggaataccataaatcgcattaacttccggcacatccttgaaaaaggcactgtcaaacaccgcatattgatccgtttcaggaagaattcggcgaataatcttgatatattcagattcaaccggattatgaatgggcgcaatttcgcttaattcgtcaatccaattcaaggctttatcatcaatcttagcaaccttgtcaaatacggtactgccggcaacaacccggttacccactgcatcgatgtcgtgaagatggtcaatgacgccaagatcctttaaattgttcaacatgatcgccgcagaacgttcataatcaacgttatcctcaacacgtttgaacgtttcgccatccccgtacttaatcttaataattgagcccggcatattgattcgttcaacttggccatccgcaagaacggtctcctttggcatatcaaataacttaaattttaaagaagaacttcctgcattaacaattaatactttggacataacactaacccccgacatttatgatttgtattcgttgtgaaaccgtatccatgcatacagtatactatttattgagggattgtgatatgattagctatttaattttcgctgtcagtgtctatcgcttaatgatcccaaaggtaaaaaacaactatctgtccgtcaaatccgtcttattcatattcagcacagagcttctaacgataatttccggatcaataatcttttgctcaatatcgtcctgttgaccattttccataatttccaccaatcgggaaacgcccataccgataatggtcgaagtcggtttacgaacagtcgtcaatggtggtactaaatatttggaatagcccatatcatcaaaaccgataaacgaaatatcccgaggcacctgataccccaactctatgcaggcattgattgcgccaaccgccatatcatcattttcacagatgacacaggttggaatattaccacttgataaaatctgtctcattaagacatttccgcttttcggccgataatccccctgtttaatcagtaccggattaagcttaatgccgtgtgctttaatggcacccataaagccctttgtccgttgggtagatgactcaaaagcatccacacctgtaatcagggcaaactttcgatgtcccattcgaatagcgtactccgttgcaatcttgccgccaagttcatccccaaccgcataattattaatatcatcccgatcaatcacccggttgagaacgaccaatggtaagccggttttatgcagatagtcaataaaatcatcatccgaatcagactgactaatcacaataatgccatcgaaattattgacggaaacactctgcccgtccatcgcattatcaacactgttaattgacagtgaataacttttgggaagcattccctgcgcctgctcaataacatccgttaaaaaactggcggaagttcctgtatccaaatttgtaaagaaaataccaatcatataggaacgattagtcaccaaacttttagcgttaagattgggtacataaccaatttggcgggcaatatccgcaattttatcccgagttgccggtttcaccagggaactgccgttaagcgctctggaaaccgtagtatgagaaacgtttgccattttagcgatggttcgaatagtcacggcattctcatttttatcaatatttttcacttccagcgcttccttccctatactatgattagtcatatcaaaattattatgggtgccacaggcgaaaaggtcaaggcacaaaagacacccggagttcttctgatagggtccctgtcaagtgcaccgatgaaaaacaaaaatctcagaagttctatttagacgttttatgcggcttgattccgaagttccttcggagtcaggccgttattttttacagttcttcgtt

SEQ ID NO: 435 - DNA, 81041 bp, Unknown
  Metagenome-assembled genome
aaccacttttaatggtccggtgcacagctttactgtggaccgtggcactgagtttagtgggctagtatcacttgaatcacaatatggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgaccaatttgtcaaaaaattcggattaaatttgcaatctaccacatacgcaataattatggctttttttctaaaaatgtaagaaataagacatttttaatcattttggcagtatgaaacctcatttttccatggtacaattttatttgtgtacagatttttacacaaatataacatttagtgaagcagggaataaaatatgatgactaatcggcacagcaatatgtggcggatcggatactttgcccttggcagcatcatctttattgcgattgggctttttctttggcacgatcatcaagaccaggaacgtcttgctgaagaaaattacattaattcaaataccccaaccctattcatccacggttggggcggtactctgcgctccgaaaagaaaatggcttcggatgcagaagccagtgacgctgctcaacgacggatgatcattcgcgttcgtccaaacggcaagatcgatgtgaccgggacaatcgaaaaatggatgcgcaatccgatcatttttcttcgaatggataacaatcgtgcaggtgaatttcaatacgcccgctggctgaccaaagtctgcaaactacttaaatccaagtatcatattgataatttgaattttgtcggtcactcaatgggttcctacgccaccgtttactataatatgatgaacggcaatcgccaggatcttcccagggcaaataagctctgcctacttgccggcccctacaacgggattattaataacggcaagcaaaaccagccgattaccggaccactggcaaaattatgggacgatcagcctaacgcaaacaaactgctaaaaaacggtcgacccaaaacgattcatccggaatatcaaatgttaaatcagctgaaggatcgcatgccccgtcaaatcagaattctaaacgtctatggtgatttaaacgacggatccaattccgatggcgtggtcacaaccgagtctgccctgtcgctggggtatttggttaaagggcgcgtcaactactatcaaaccttcaaagcaaccggacccaatgcgcagcatagtgaattacataatcacaatttagcggtagaccggtcactcaccaattttctttggggtaagcattacaacatgtcctcaagtgcacccaagtacaatccgatgttggataaaatgatgaatccgggaatggcttttaaacgtcaaaaccagttaaaagcgcaataaatcagttgtgattaaccaaaaaagaaattgactcaaacaaaatgatgtttggtcaatttcttttttggtctctaaccctatcggaacgcgatcatttcaacgcatctatcgtctccaatgctcgccggtattcctttaaaaaggcttcttcctgtcccgaaaccaattccttttgatattgttcagctaccttggctcgactggttgtctcgtatgatcggcttaacctaccgaccgcataggcagcggtcgcccttatcattggccgtggatcttggctcatgacatgcaagagatcatccacggcagagacatctcctaaattaaccaacgcaataatggcgtttcgctgcagcggtttcttaccccgccaggcccccgccatttgaccgaatcgatcgttaaactgtttgttgctcaatttcagcatcggtaataattccgggcgaaccttttcgacatccggctccattcgttgatgtaaatgaaaatccttcccacgattaaatggacaggcgacttggcaaatatcgcagccataaatcacatttcgaattttaggtctaaattcatctgccatcaatcctttggtttgcgtttgatacgacaaacaccgctgggcattcattcggccatcacccaacaatgcctgtaccggacacgcatcaaggcatctcgtacattctccacactgacacggaatcggcgtgtcgggttccaacttcaagtcggtgatcatttcgcccaaatacacaaatgacccaaactcctctgtaatcaataaaccgtttttgccgatgaatcccaaacccgctcgatgggcaaccgccacgtcaatgagctgacccgtatctaccattggttcgaatctggcattgccctctccgacaatgtccttgacccgatcaattaataaagccattttttcacgcaaaatatgatgatagtcatcgccccatgacgctctggcaaattggccccgctttaatccggttcgtttcggttgttgtttcatccgactggggtaagccaaagcaattgcaataatcgattgaggatggtcaaagattaaagtcggatttaaccgctcatcaatatttggatgttcaaaaccgctggtatgcccagcggctttttgagcttcaagactgcttctgagttcctcaaaatcatcggcagtcgtgaagccgattttatcgataccgagtttctgactttcggtaataatctgttgttttaacgtgacggaagccgacattcaaaacagtcctttccaagttgagtcaccattcagctcccatcttaacctattggaatttaatcagtcaattgtcgacaaaaaataccgttgcctcatggataagggttcatatccaagagacagcggtatttttttaacaattcaattaattgtaaacccgacgccgacaactcattccattcggcaggaaacgtctaacgatcattggtccatatttgccggtaccaatttgcgttgacggaaatactctaatccgccaaagaccaatgtccaaacaattgcgccgacagcgccaatgatatcttccggaataaagaacagactcacgaaaatgacaccaaagaagaaaatggttaatggactggtcaccttgtaccacggcatcacaaacccattcggcagaaagtcactggaagcacggtactttctatgagcaaccattgccagtgtgtaaacgataatgtacatatcgctggaaacccctgtaacaattgtaaagactgaggtaatcgccgttgttaaactcatcaatggtgtgattaaaaccagtgccgccgataaaataatagcagctgccggcacaccatttttggaaattttggcaaatgtcttgtgcatccaactattttcgggaacttcggttgccaactgatagaaatgtcggcctgcggagaaaatacagctattcagagacgatgccgcagatgttaaaacaacaaagttaatcatggcagccgctgcagggaatccggcaagtttgaaaacttgaacaaacggactactattagctgacaaagatgtccacggaatgatgcccatgatcacgattaaagcgccaatgtaaaacaaaagaattctgagtaatgtttcattaacggcctttttaatgaccgtatgcggtgatttcgcctcaccaatcgtgatactgacaaattcaattccttgaaaggcgaagaaaaccatcggaaaagctgaaatgaaattaaaggccccatgtgggaacaatgagaaattatggaaaacatttgtcagtgacgcgtgtccaagcggtgttaccgaatgacttgtcatcataaaaataccggtaacaatcatagcgacaatggcaacaattttaatcatcgcgaaccagaattccgcttcaccaaagagccgtgcggcaattaagttaacacttgccagaactcccagaaagattaattcaacaatccacgaaggaatgttagggaaccaatattgcacgtaagtggctgtagcggttaactcagccatgcagacaaacaccaggccaatccagtaggtccagccagtaaagtgacccactgtcggtcctaaatatcgcgaaataaacgaaacaaatgtatgttgcgaaggatcggagtaaaacatttctccgatagcccgcatcatgaagaagaaaaacagtcctaatgttaaataaaccagcattactgaaggccctgtcttgctgatcgtgctgcctgaccctaaaaacaaccccgttccgatcgtaccgccgatagcgatcatttgaacgtgacggttacttagggcccgcattgtcccatcttgattttctacaatttttgatttcatacacaatcctcctgcaaaataagagctagataagataatagttaaaatgcttctcatttgaatatcattattctaccacgttttttatttttgtgtcagattattttacataagtaacgtatcattagccaaaaagacccgtcttaagggcttaattcgtccaaaaatattttcaatgtcataagttatcacaaattatgtaaaaataaaaaggcatcacaagtcatgccttttttactcatatcatttgatttagcgtgtcgcctcaatcgaacgcatccaattccctattaagggtttcaatttgttgacgaagacgatcaatttcatctttaacttcttccaacgttaaacctgcattactgtaacccttataggtagccgtcatgtaatcgacatcttctaactgacggacttgctcattcaaagatcccagctgcgtcattaattgattaaaacgatcttcactatccatttgaacgactcctttaagccaatgcttccggagcctcaagctggggacccctgcccattcttgctaaaacccagtggtcatagttccattcttcggtggcacgtcgtgaacggaagtagtcccagtttgattcccgctcaacttcaacgacttgattgtctgcgccaattgacacccagttatatgatccattttgatgagcaaatttaacccagagaatcggaatattaatgacctgtccctgatcatctctgaacgttctgctgagtcgatcaacccgcataaaagtcagaccactggcataggctgaatccaatcgttcgaaaacctgatttgctttgtcaattgccaccctttctcccggcaaagcggcgtgggtctcaatcgcaaagttattataactgatcaaccgctgatcgctgccataaataacggtgacatgtgcattattcggttcaacctttcctggacgctggtagcgaacaaccgtcacccgttcgtggtttcgttgacgctgatcagccgtaattgctttaaatccttcaggaataatcaaatcatgattgggtttatcaaaaatcttgacgtaatttgtcataaaaacctcctagattctcaaacaccgcgctactgcattaagttttgttcgaccttgattaaggctgccattaatcgatcctgcgtcacacgatcaatgccgctaaagactctattgttgacgtattctaaacgctcattcaacttgggaaccaatgcttttccagtgcttgtcaggctaattgaccaagagcggccatcggtctgtgaccgttccttttgaacgtatcccagtctgattaactgttccaatcgcctcgtgacattactttgactcagataaattcgtttaaataattgatcctgtgttaaagttggtgcctggttaatttttaaaataaaataatagttactcgatgtcagcttcaacggttttaactgttcatccaaataggtttgcagctgacgtgaagccgtgttgatcgttgcaatcaacccgtcaatttctatatctgtcatcaataatcaccttctccatttatgactgacaaaagtttaacattaattacttgcttgcgcaaacaagttgattcgttatttccaactaaaaaagaccagccttttatcggcctgatctccactaatcttcaaattgattctttccaagcttaaaacaaccatgctataccaaatattgcaaatcactcgaaacagatggataggcaaaaatcatgtcctggatctgctcattcgacagctttaaattcatcgccaggctgaaagcgttcagcaagtgctcaccaattgaagataaaacgtcaaatccgacaatttgtttagtattggcatcccggatcaccattgccttggcaacatcatctttaatgcggttataggtataccaatgggttaaatcaaaagcacttacatgatatttttcaggtttgcttaatgcttcctgataaccaacccccacttgaccgacttccgttgtcccaaaaagaatctgtgggatgaccggatactgaattggtgctgtcgtctttttcgttaacaactcagcaacgtatcgtccttcaaatgaagcgacaggtgtcaattttggcttggctttgtcaacgacatccccgatggcataaatcgtcgatacgttggttcgcaaatgatcatccactaacacaccgcggctcgacgttttaaccccgcaattctccaattgtaattgatcactattcgccgatcggcctaccgcttcaactacataatcagaagccaacgtttcaagatcggtggtcagtgtataaccggtttcatttttagaaacagccttcagattctgattgaagtgaaaggtgatgccgtcatcaatcatgtcttgaaccagttgcgccacaaagggttgtggaaatgcctttaatggttgatcgttatgatgaataatatcaacatcactaccagccttattggcaatatttgccaactccatcgatactaagccggcaccgacaaacgtgatatgctttggcaatgcatccaaatccaggaagtctgtactggtttttaggaatgatttaccgggaatatccaataaccgtgggcggcgaccagtggccaaaatgacctcatccgcactcaccgtcgtctggtcacccagctgaatccgatgttggtccaaaaaggcagcctgcccatgatacgtatctatgccggcaccggacattccccttttcgtaccacctgggatttgtgacgtatatccacgtttaaaggccattaactgtttccaatcaatcgtgggaacgtcctttagcccgctttcctgcattcgggcaaccctatcctttgcctgaactgccgaatacagcatttttttaggatcacacccacgattgggacaggtcccgccaaaaagatcattttcaatgactaagacggattttgacccaactaacccataagcagctgcagtccctgcaggaccggcaccaaagatgatgacatcgtaatgtgttttcaaaatgcttcactcctcatatataatcatgatttactttaattgtagcccatcttggcctaaagcgtcggtattctcccaatcatttttgccttcggattcgtatcatgcacaatcgagttgtataatgaaatcctagtcaacttgttttcacacccaaggaggtgcctatccgtgtcgatcacagccattactcatttttttacggccaacgccaagtttatcaacgcactcatggaacacgtttatctgacccttatctcattgatcattgcgattgtcattgccatcccactggcggtatatgcacgcaaccaccggatattcgctcatattgcactcggttttacgtcaatcatgcaaaccattccctctctggccatcttgggaattttgattccaattgtcggcattggcagtaaaccggccattattgcactggtcatatacggtattttgcctatttacagtaatacatatactgcactcacaacgattgatcccaacttaaccgaagcggccgaagttttcgggttaaccaaatggcaacgactttttcgaatcgaattgcccctttccacggacagtattttgaccggtattaaaacgtcaaccgttctgattattggaacggctaccctcgcagccctgattggcgccggtggtttgggaacctttattctgctgggaatcgaccgcagtaacaccgcgttaacgttgaccggtgcaattggctcagcgctacttgccgttgtctttagttggctcatcacccgattcggtcgtctaaaagccaaatcgatggtcattgtcggcggtaccgcccttttacttttactgcttggcattatcgcaccaaaagtatacacggccactacccaaccggaaaaaatcgtcattgccggtaaattaggttccgagccggatattttgattaatatgtatcgggacttgatcgaagccggtgacaagaaaattgatgtcgacttaaaacctaatttcggtaaaaccagctttttattttcagctctaaagagcaatcaaatcaacatctatccggagtttaccggtaccgttcttgaagacatcattcccaacagcgaacgacagcttcaaaacaaatctgcaacgcaaatttatcacatggccaaaaacgagcttgcggctaaatacaatatgacttatggttccccgttaaattataacaatacctatacagtcgtcaccacccaaaagttcgccaagcgccatcatcttcacacaatcagtgacctcaaaaaacttcaaaaccgtctacacagcggttttgatttggaattcatgaatcgtgatgacggctataagggactcgtcaaaaaatatggcctatcctttaacaatactgatttggatcccgatttacgctatcaggccattcgccgtggccaggttcaggtcattgacggctattcaaccgattctcaaattcgtcaataccatttggtttcgttgcgggataataagcatctctttccaacctatcagggagcgccactcatgaccaaggcatttgccaaaaaacatccggccgtggtcaaacaactgcaccagttggccggaaaaattacggcaaaagagatgcgggagatgaactatgacgtcaacgtcaaaaaaatcagtgccgcaaaggttgcaaggcattatttgcaacgccatcatctattaaggaagtgatcatatgccgaatacaccagtcattcaactctcaaatatttccgtcgtttatgatcagcaaaaagcaattgatgatttgtccctatcggtttatccgcacgaaatcatggtgctggttggcgaatccggtggcggtaagacaaccattctgcgaaccatcagcggattagttaaaccggcaagtggacacattttagtcaacgggctaacactaaacgatcaaaatctgagaaagattcggttaaacatgggctacgttctccagcaaatttctctttttcctaatatgacaatcaaccaaaatttaacactactgccggaaatcaaacatcagtcaaagactgcggccgaccaaaccattaaagaattgatggctgccgcaaagttaccaatcgattatctgtcaaaatatcccaacgaattatcgggtggcgagcagcagcgggttggcatcatcagggcatttggcaccaagcccgacctgattttgatggacgaaccattcagtgcacttgaccctgtatcacgcgagcagttgcaggacctgacgctttccatccaccaacactttaacaacaccattttatttattacacatgatatgaacgaggcattaaaaatggggcagcaaatcggcgtcgtcaaagacgggcagattattcaactggatacaccggataaccttgtccgccacccaagcaacgactatgttagaacactgtttaacggcagcgaagcccacaaaatcgaaaatgtctatattcgtcggttggtcttggccgggtatggaagaaaaaccccgtttgagaagttaccggtcacttctgttgaaggagaccggacactgggcgactgttatcagctgcttgcgcaaaatcagcagttggctgttagaaggaacagtcaggtgatcggctatttaaattcggaaagcattttaaactttttggctactaaagcgacaaataattagctgcctatcacaaaaaaaggaggctggggcaagggttcaatttgccacagtctctttttaatcgacttaacccttaatagtcactattaaccacgaccacttttccaaaactatcagcctgatcaagagctgcctgcgcatcaccggtatgagccaaatcaaatatttttgtcggtttaatgtcaatacgttgggtctcgacaagcttaatcagatcatttagatcggatgcatttgctgcatcagagctgaagtgggtcaaataagcccctgcaggaatgccaaacggatcaaaatcggcaactgtccaccgggcatcgtccatgccacttaattcaccggtgaagcaggtaatcccgttaacgttcaaatgggttaaggaatccatcaatgtatccgggcctaccaattccagaatggcatcaaaatggtcttctgtttgaagccgtcgctgatggtccaaaagggtatcatcataaccggctgctttcattcgggcgaatttttcgggatctcgagttgttccggcaaccgtgatttccgggaccattgccttggcaagcctcatggcagccaccccgacgccactggtaccaccacgaatcagtaacgttttagccgttttaattttcatatttagtaacgatccataagccgtataaaacgtttccggcaatgcagccagttcaggccaagataactgggtttcaaccggataaatactgtcgttgggtagtaatgcatattctgcataactgccatcaaaagcacgtcccatgccatgcatgagtgaaataacggtttgtccttcgggaagccgtttggaatccgtcgattttgaaacaatcccgacgccctcaatgcccaggattcggggaaacttaacgggcgaatagcccaaacgggtaaagatttccgccctgttgataccgaaacctttgattttgaccaaactccaccccggttttgtctgaggggttggaacgtcttttaactttaactgttcaggaccgcccggctgatcaatcacaattgctttcaattctgatcattcccttcttaattttgctacagacttatcataacgccaattgaagcgggcttcagtcaaagaagcttttccaaaaagaaaaagccaaaacaacataagctgctttggcgactttgatttaaattttttgttcaatcttatcgatatcgactttcaaagctctggtaatccaaggaaatttcttcttcattgtatcgaagtcatcaccggatgttaagaattggccggtcccataaacgtgaaagccggcgccgggtccctgggtaccttcaacctctttactcccaaccgttataatcacgtggttgtcagttgaaaagtcctgttcaatactgtgcatgccggccgccggaatcagcaattgcttatctgttacctggacatatgacatccaggtattaacaacgtgggctggttgcgcattaattgtcacaattgtggcagggccctcatgcttcatgacatctaaaaacttttggtccatcgtaatactccccttcatcaacgtttcagtgatcgcgatttgatcatgatcaccaacaatcattttacaccaccaagttgatcaaaacacatttttttaaaacgctcttcaggatctttctcatttcgggatgaaatgattgctgacgtagtgtagaatgataggatgttctttaacatcgcgtataatcatcgcaccacaaacacaaaaacggaaaatgagactgattttatttttcacctactaaaatgattaagattggatggacgattaatgattatcactgttgttggcggtaacgggtttgtcggcagcggcatgctgaaagaattaagccaattcgacgactttgagctttacagtctttcaagaagcggcctgcctaataaacacgtgacgctaccaaacgttaaatggcttaaaggtgacgtttcccaaccgggggattgggaaagaatcatcgctaaaagcgattgggtcatcgactgcgttgggattttgtttccaaatccactgaccaaaaccagttactggaaaaatagtatccaaccggctgaatctctcattaacacgattcatcggcaaaatattgcttcggacaaccccaaaaagacgcattttttatttgtctcggcaaactatggtccgttcttcatggcaccttacataaaagccaaactggaagttgaaaaagatatggctcgtttgctgcccaaaaattcaattgtcgtctatcccgggattgtgactgacagctcgaagccgacaacccgtctactggaaaatctcgcaaaagccctgaccttaagcctttatttcaaacgtctgagatttgtttccagggatgtcattgcccaggaaacggttcggattctgacgggtgaaaccagtttcttaacagaacgggtagactagcacttgcatttttttcttccccgtcttatactatctacaatatttaaagtcgatttacatgaagtagttccttatctgggtgtcaggaagttggtggttgctgcgaaccaatcaggataaggcagccgaaataccgtaatatcatcgacaatggtcaataactagaatccattatcttctagtgagcggtgtatgcttttgcgtgcacaagttgggtggtaccacggtaacgaatcgtccctattacatttaagtgtaatagggacgattttttgttttcagaaaggactgttgacgatgagggaaacaactaatgggggcttggcgcgatattgattgaccaagttttataaacaaattcgaaacactaaaaaataaaacgaggttaacatgatgacaaaaagtaaattaggtttagttgaagcatcaatcgtattaatgattattttagcaattatgggcatcggcgtgatcggctttggcctatcacctcaagtgccggttttattagcaattacagtcgccatcttttgggcaaaggttcggggttttgactggcatgaaatcaacgccggcattaaagacggtattgataaaggtatcattccgattgtgatctttattttgatcggtgcgatgatcagtacctggatcgctgccggcacaattccaacgctgatggtcatcgggtttaaggccattagtgcacagtggtttttaccaacagtctttctggtttgttcgttggttggtgcggcagtcggcagctgctttacggttgtctcaaccgttggcattgccttcttcggtattggcgtcacaatgaatttcaacccggcactggtggccggtgccattatcgccggtggcattttcggtgataaactgtcaccgctatccgagaccaataatttagctgccgcagtggttgacacagatctcttcaaccatatgaaaaccattctctggtcaactattccggcagccacgatttcgacaattgcctttgcccttttgggaatgggacataatcacgccgatatggctaagatcaataccacggttactgctttgaacaatgattttcacatttcaattatcgcattgattccaattgcactcgttttcatttgtgccgctttcaagatggccgcaattccaaccatgctgctcaacatttttgtatcggcagccatgatgtttatgaacaatccccaattaaatatgactaaagcaagtaatatcattacgaacggctttgtcgcaaaaacgtccaactctgaagtcaacttgttattatcccgtggcggaattgtcagtatgatgccaacggtggctttgattgtgttgacattatcgcttggcggactgctcgttcacttcggtttgatcaatgcagtcatgtcgccgttgtcaaccaaattgaatagttctgccaaattaattacagccgcactggctgcctgcattggtgtgaatatctttgttggtgaacagttcctatctatcattttacctgggcgggcattcaaacaaacctttaataacggaggtttggctagtgccgctctgggacgggtccttgaagatggtggtactgtcttgaactacttggttccttggggtgttggcggtgtcttcattgcaaatactctgggtgtcccaactatttcatacttgccatttgttttcttcagtctcctctgcccggttttctcgctattaagtggctttaccggaatcggtttgaagaagtcgactacctcaaaggctcaagaagaacgaccggtaccagcacaaaattaatttaaaatttaaaagtacctttgtaaaacaccatcttgaagtgttttacaaaggtacttttaaatttggtcatattttcaaaaacatattaatcttctgaatgacttccttcaacccttttagcagccagttcaagtagatcgggaaccattccaattatttcagatgaatcaaacaaggcatacattaaaaaagttatttttttgagcacaggtgtcataatttcaattgctctttgattcaaaaaattctgaacatcattttcattccactttatcgcacctagaaaagtcatcttcgattttgcaaccacaaaaccggaatgctcattagtgttatacaagactcttgcttcggtgaaaagaaccaatgcttcatctttatttaggttatccggtgtaaaattgatagtcatactggtttgccctgcatcaaatctaaggttatcagcattaaaatacgactttcccttaagatagcctttcatttcttcaatggtcgttaaaaaagctttattaactctaatactttcaagatgtacattaatttctttatgcgtactttggtaattttcttccggcaattagttcaccgtccctgaaattataatcgtttttacgcttttatgcagattatccttaaaagaaaacgatgattccgtatcaaattgatctggggatagtcttattggcctacccacggaagacaaattatattgataatatggatgagaagtattatcaatttttgaaattccaaatgttgaatgctttacagaagaatcatcattatctttctttaaatcagagagcggataatttgtgtgaaaatcaagcgattgaataatcgaatactcatttttaacatagttaattaactgatcatacattgcaagatcggtgcaccgcccacttagatatccccttgcttcatccattttaagatcattgtcttcagcaagtttacgccacgataagtcgcggcctacgtacaaattatattttagcaaagctgccattaattccgtatgttttttgtaatgatcctgattcattaatttttgcacatgcttttttacatttttaatacgtgtcaaaataactccctccttcggccacaataattcttgcttcatcgaaaaaagtggaaaatgaattttcatcttttctaaatgactgataaatttcggctgtggataatactgcttcatttgtttttttgttcccaattctccttgctttccgcgtaatgtacttttcctttctaaaagagtcgcaatagcactgaaattgatcgaaataatctccaaattctttagaagatagaaaaagaatagacctaaatccgaattcacaagcattaattcttaattcaaaaattggggattgagaaataaagtggtgaagttctaaagactccttatttccccatccttcaatatttttaactaattcaaagctattgatttcaacatctttttgacttacatcatctagataaaataataagtgtcctgatttcaatgaccgacgcttaccttgcatgatagcctcaaaatcccgtacttcaaatttactagctgttgccaaacatttaacaattaacaagtaacgtctataagcgatttttgcttgattctcatctttgcaattttcgtacgtatcaatcaaagcgtctaacatttcaataatagaaaaagctgtcttgcctttttgacaaaaagggatgcatttcataccaaaataaatattcctttcaatactagtatctagagatattataacaggagtgtgccatctaatgcaccagtttaataatgttttcttcggtgaatatgcaaccacttcgccacaaagaaggccgcatcacagcacaaagtttccaattctttcatctcactcatcctccaaaataaacattacccgttgaagttcacccagcgcatcggccggattctgccactgaaagtcatatcccagcgaaacgttttgatagtgaatccctcgataatcaacaacattgggcatgtgagaatggccactaagtgccaccctgacgtggttctgttcgaagagttggcgataccgttcacttcccaattgatacgtgaaccgatcgtaaaacggcactggcatctgtctgaccaaccgttttgtcggcaacatatgcatcgccaccaaaagctttcttgatcccagttgcatttggttaatctgatgctgccaatcaaagagttgtttggtcacccagtcacgatcacggcaataatcaatttgattaccgttaatgtatagctgatccggccagacatgcttagccacccagttattggcaagagtcgatccccggttgtcactgaatccttttgcaaaagtataatcataccagccgttaatgccggtgataacccagtgagtcgtcaatagtgggtgttgtgtcagtgaaaatggtgactcgtccaactcatgataagcatctcttgaacgttgttgaatcatcgaaacagtcttctcacggggatgtgatacatataaatcgtgattgccaaccagcgtatgaaagggaatttcaagtgactgtgaaagcgcatcattaaatgccagattcctctcaagcccattggccgtatcacccatgataaccaagtgatcaagccgttctttcttaaccagttcggtcataaccgcaataaaatgatgccgccgattaaagtcaatgtgtagatccgaaataaaaccaattcgcattgttagtcacttctcactaaaaaagattcgtttactggtttaagcataataggatattaggcgattttcaaaggaatatgttgaccttaaaggttgtttaaatgataaaaaatttccggtatatagtttttagtaaattttgctaaataaagaaaaatacagtcgacctttttatcttgaatttatattttctcggaaatctaagtactttcaaaaaaatgcaatgatcaataatcaataaaaatatttttaaatccttattagtcaaggctttgttgcacgtaatcggacgtcataccagaatccaatgataccttgaattatattttagtaaaattgtatttacattactaaatgaaagcgctatactctatctgtaagcgttttatctttcatgtaaatcaagaggggaggcctcctatccttacatttttcagaggtaaaacatatttctgctatatttcttattctattgattggagtgacttttgatgtctcaaaacaacaagcctaaagaacctgaagaggttaaaacagccgttggtgaaattacaaacgccaagattaaagattcacaacagccaaaactaccttggatggtttcttctgcaatgtttctagcaccgctatgctggtatggtccaatcggctctacccgtagtgttttaattccacaattatttagtcaaattgacccggctcaaaaagtttgggcggttggtattttagcaacggttgcctcaattgttggtgcggtagccaatcttttgttcggcgccttttcagatgttacccgttcacgttttggtaaacggaaaccttacatcgttttaggtacaatcgcaattgcgatttccctggttgtgattgccaatcttaaatcaatccctgctattattggtgtttggatcattgcagcagcggccgaaaatgcgattgccgcggcaatctacccgcagatttctgatcgggttgcaccaaaatggcgtggaactgtttccactttctatggagttggttttacaattgcccagcaaggatttgcgttgttagcggctcaattcctgggtaacgttaaattcggtatttacacgatggctgcctgcacggttgtattagccattattcacgaattattgattcaagaaaagggtaatctggacgaaccaaaagttcgtttggataaagataccctgaagaaatacttcttcttcccaactcatgacgcacgggacttttacttagccttgactggtaaattcttcatggttgttggttcaacaatcgttaccactttcctattgttcctgtttactgattatattggtcaaaataccggtgaagccggcaaatcaatttccatcttctcgatgattatgttagttattggtgtaacctttgccctaattggtggcccactggccgataaaatgaagcgggttaaagcaccggttgtgattgctacttttgctttgggtgcagctgctctattcccattatttgtccaaaaaccatgggcaatgtttgcttacgctgttgttgcagctttcggaaacggattatataactccgttgatggtgcccttaacatggatgttttgccatcatccgatactgccggtaaggatctcggtctgattaacctggccaacacattaggtcaaatgctgggtgccatggttgcttccgcaattgtggaaggcttcggttatcatgccatctttatcttcgctgttggtatggaaatcattggtggtattgccattgcgatgattaaacgagttcgataaataaagttaaaaggattaaatataactgttcataaaagagactggcaagtcagatttttcaaccttgccagtctcttttatgaacaatttttaatgcctaaccgaactcggaaataaacaactaatcgcaaataacgtcgcaattgctgcggcaacacccatgacaattgcagaggggccaaactgaaaactcatcagtaccgattgattaccgtcattcatgtattgatcaatcgtataaatgatgtagccgatcagcccatcagttgcaaaagccgccaacaacccgatcattttcaaaaataaatttggtaacacaataaaaagcaatcctaaaaccggtaatatcgttaaaacgattttaagttggttcaagtctccatccaaataaccgcccgttgaaagcaatgccgaaaggtcgatgccaccccttttattccagaaagaaacaccagccgtcacaaaatcaccgaaataaatgctgccaactacgacacacagggttagcatcgctaaaaattctctgaccctcattgtgtagtgtgcaacatgagacgtcttatccgtctcttttccccgaccatattcgctatttgcttgattatttttggtttcagctagaatctgttcttttccggatgaatattgagcgttgccaatccattttccaagaaatgattttttcaacaaagctttatttttgcaaatccgtaccccaatatcaaccataagtaacacaaaagcaatataaaaggttccatcactttctattaaaagaccgatcaccaaaaacacaaagagaatccccggcagccaagcaactattggatcaatgatcgttttatttctttgtataaaattggcaactgccgatcgtttatataccgttttcaaatttccgtgcataaaaccctgttcctgatcatcggcctcccgatgtgttttattgctggataaacggtcatccagacttaccgttgggaccttataaccacattgttggcaatactgggcatcatcccgtaatttagcaccacaatgcgggcagaacccttttaccccactcattaacaaccatcccccaaatctgcacattatcttaggactgcttcaaaagactgattcctgccatacaagggatcaatttcaaaaatccaaaccctggatttccgaaataaacgccttacactccgaacgttaaccgcttagctccgcacactaaatccattgccatacgcaaacaaatcaaagtgatttccgacgccttcatccggcaccactgtatgggaaatgtgtaaatttgaaataccggccatccccaggctgtagagcgtactatacaggtgtttggataactgctccataacttctttgtacgattgaccgagcactcccgttgcgtttacgtagaccacatcttgaaaacgatacccctggggcatatctcccgtcataatgactattttttgagccgcaagttgttcctcgggtgtcaagtccatttgagccaacacttcacttaactggccaccatgctccagtaacggtttctcgtcgtctttagatagtttcgacccgcattttaagcagaaattagcagctacttcattacttgtcccacattttgggcaaattcggtaaacctcactaagcattttcaaatcacttcccgttaatagtcatcgtcctcatcatcataagtatcaaacgtgttgttcaaagtatcgtgtccatccccgtcgatttcgacagagacgttgtgatcatatttaacgttggtgaccgtgacatccaccgttgtctgatcaccatcatcatctgatacactcgcatacccaccatactgattaccaccgtagctggatgtaatcgtgacatcatcacactcggcatccaggtcccagtcgttttgaatcatatccgtgacaacgtcgacagattcatgggccaattgtttctcggttttattttcttttgcttcttttttctttttgatgctttctttcaactgtgatgactgaatcatagctgtttttttcgcctgtgtttgttgcttcgtaataatcgaactggcaattgtcactgtcacaatcacgacaataacggctattacgccggcaatcaaccaattacggtgtttaaacggctttttaccggacgccatattttgcggctgtgatgaaccggcattggattggtcatttgacgagcggttttgtgacatttcaataaagcgattaccacattttgggcaaaattttgcatttgctttaacctttgcgccacattttggacaaaatttaaattcgttttccattacagtcaccttcgatccttcttaattattcgtcttcatcataatcatcaaccttttgcgcacccgatagtgaattaatctgtaatggattgtcactatcgtcaccattaacgaccatattggccgtataacggaaaatttgaacgtgataatgatctccggcgtcaaatttgtacttaagatcaaacgtgacatcgctactattttgcgagctgagcttgattgaatcaattgtgtcactcatgtcagtcccatcaatatcgtcgtcatgataataacccttacccattttttcaaattgaagatagtttggatcggactctccgccagcgaagaaggaagataggtcatcgccatcatcatcggtcgcatcggcaaggtcgccattgttactcagcccggaagtcgcatcacaaagattgctcaacagcgtatcggcatcatcgtagctcacgagtcctttaaatggcaatgtcacatcatggtcaccgctttgatcgctaataactctggactgagatgaaatattattttttccggcttgataaattccctgcactttaagctcttgggtccaaggaaagtccttgaagttcatcacaccgtttgccccgattcgtccctgatcctttgaattaatgacaacttcggttccctgagggccatgcacattaaaggaaaccgtttttaatgttaacggaatcgattgattgttcgaattcaaatgataggtattgtcatttgacagactgtgcccattaatgttggcagaactggaaagctcatactttcccggtaccagtggccctatctttttaacaaaacgtgtggaattggaggttgcgataaccttagccccttgtttgatcttagcgttctttttattaacacttagagaaacgtaaaccggtctgacctggacttcatattttgggaaaatcaaaaaacgatgaccattttctttatattcaagccgattattatcaaactttccaatcgttcccatttgctgcttaaacgatgtgagtgcctcgggactgtcatggaaataccggaccaaaggttttaacgatgcgttattaattgttaaagacggatcgttcgtgtaaaaatatctatgtaggtcatgatggtcgttttttgccgacttgacgattctgcttagcgtactcgcctttgaataataatgttcgccataagcgattaatcctgctgcagcgacaacgacaataacaccaaatgtgattaatcgtcgtcgccgtttccgatgtttactgatctgtttcttggttgcccgactgaaaagccgctttttaggtttcccaacctgcttgccattatcgacttcaacaggatttccctgtcgataggcattcaaattgtacccacaatttggacaaaactcatccgtcggcttgaccttctgaccacaatttggacaaaataaaagttcactgccctgctcatcacttgattcttttgacgtcatcccaaatacccccaattaaaacccattcattgaattaatactaatataataattataatataaagccgatgccctgtcagtattaattttgagataaacgatcaattttgaagaataattgtatacaaaaaagttccgaaaacgcaacgcatttcggaacgagattgaatctgttcaattgagcctatcggtttgactgtcctgccactaatcgcttctcgatcttttccaaatccgccagagttcccattgtgcactcattggtttgagcgctcgctttaaggtgctccattagctttggtaaatcacggggaatctcaaagtataatttggtacgactgctgtgaatcgttgccatgccatttaaatcctcaatataataggcatccaggtcctgctttttggctgcttggttgtagtcctcaaatgacaattgaagttggagaatcagatctggtaatttcataaacgtcattcctccttctactacctattataggaggattaacttcaaatagttggttatccgcaaattagattgaactttcttacttttctttagtatagactggtagaccacatttacagacacactaaacttaatactgtcaaaaaaagtggctgaacagagtcagtcactaaaatgcagatacccttatcaaaaataaaaaacgttaccgtctgtctagaaattgattgaaactagtaatctaataaaagaaggtgttcttgtgattgctagtggatatccgtctagacaatcctaccataacaagttggtcaaaccagcaagttcggttatttttgtgaacacccacaaaaatccccctcaaaaaatggccataagtaaatagatctcatccataatcaaaaatcaacctttcaattatatcatcagacatggtaaactaatgtattgagtaaaactttatcaaccataagttaattgtgaacgtgctctatatattaagggggttaaccttatccttatcactatttatttattactatggatatcacttttggacgccatgggatttggcatttggaacttatttacagcgttacgtgataaacacgatagccaacattatacaaatgatccggtcagaagttttgatcacctatttgtttttgtccctgctctcaacgaagttcaaacaatcgtcaaaaccgttaatgttttattagcttcacttaacagtctcccaattaaaaccactttggtggtcatcgatgacgcatcaaatgatggcaccacccaaaaactaaaattactttcgaacctttcgggcttgaaagtaatttttcgtcaatttccaaatgcccaacagggaaaggggatggccttaaacagtgccttggaatgggttgaaacacgatcgatgacgccccaacggacaattatcggtgtcattgatagcgatagccagcccaatagccaaatcatggcacaaatttataagggcttcacaaactcaaattatgatctcattcaaacgggaattggcatttccaatcagacttcttttctgaccctcatgcaagcctttgaatttcaggtctcaaactatctggaacaggtcttaagaatggactttggttctgccatggcgagtggtaacggtcaattcatgactttggaaatggctagtgctgtcagatggcgttcctctctattggatgatttggaattctccataaacggcttctttaaagggttttatggtggcttcttacccaatgttttgatgccacaggaagctgtcacgacttataaagcgctggttaaacaacgaacccgctggtgccagggcggtatgcagtgccttttctcctatggtaaacgcatttttatcaatcaccgtattccttcacgactaaaagcaaacctactgctgtttatgctgattccgtttggctcgatgattttttcaattggcgctttgacttcaattgcgacaatgtattttttgctgatttataattaccaagaaacaatcggcattatcttaacaatcgtcatttttggcttaagtacatcaggaatcatgattattgcagcagacagaatgcattttgtgaatcatcagaaaactgttttcactactagttttaagatggcagtaggaaacttattttatatttggtgtttggtaccgataccgttcatttcactttggcgtttggtaaccgggcaaaacaattgggttaaaacagcgcatcagatttcttctgatttcaagggggtaccaaaatgagtcgtatttttaaggtttactgtcagtggtgcattcgacttttgaccatttgctttctgactttttatttagtaatgaccatttctggatactttgctaaatttcaaaagattatttatccgggcaaaaatgtgttactcattggaacgattgttgctctcggtttttttgcattaatatggggggtcgcctactggctatccaaacattatgttggttggcttgtagtaacattgacacttttaacaattccaaagatcatgttgattggtttatttaaaatcagtccggtatctgacatatattcttatacaaatttaggaggttccagtgccagcggagattcttggagatggatgtattcaaatggcggacttgatttaaatccactttttccaagtgtcattcacatcagcagtgcttttggctggatagatcgtctttttatcaataagccttttacaatccaattgttcaatattttgattacgttaacgacggccgtcctaatttactactttggcaggcaaatcggtaaccattttgttgggatcctttcatccctgctcttttatctgatgcccacctactacatatatagcgttttacccggatacgaacccctttggcttcttctattagtcatttccagtctatgttttaatcgctggcggcttggacactggcaaatttcaaacagctattattggggatggttgctcatgaccatcgtctctctaatcttagctcaactcatccgtccactaacaccaatttgggtactatcattcttcttctttacttggatgacattacacgataatcacatttcaaaagcttatcagaaaacgcgaacaccttatcaacttgctggtagttttctcattttaataatctttacgctttttttggccattgcaccaaaagttgacaggcagatttatcatatcccctttacaaataacagttcgctgtactcgtttacagtaggaagtaacatacgcgcaaaaggaatgtatgacctgactctcattaataagctagaaaagattaatcgaaaaaatcatagtgctcaacgttataatcaaatgaacgtcctattaaaatctcgcttaaaacataatctccggtatctacagagaacgaacggttggctcaacttcctcattcaaaaaaaccaagttctttctcaatcattttatggcattcaattttttgtgatgaataccaaatcgttatcagatgcatccctgtccagccactctaacgtttcattcccacgttggcttactggttttaccaccggttttcaaattattttgattttatcgacaataattgggcttttattttattggccaaatctaaaatactggcgtattggaaatggcatagtattgatggcaatcatacttgatggcgtcttactggcttcctgccttgtcgaagttcaaagtcgctaccaaattgcctggtatctgccaatgatcattttaggggcactgggtatggggaaatatgatccaaaagcgcctgataaggaggacgttaaaaagatcgaagaggcctttgataacttgaaaagtccctcaaataaaaccaaatactaaagcaacaatttatcagaactaaatttatagataaaaaaatcaaggcgtctaattaccttgaccacttttggttgattttgattatcttatagctttttaatccacgttattgtaaccggaatcggactatagtgtggcaattttgtaaatccgcgaagatttaaataaatcaccgcattagcatctgccttacttgagtttttaacaagaaccggtgtaatgcgcttttgatccgcaattttaacaatagcggtatattcaccactatcaggaattctttctggatcgtcctttggattgataattgaacgaccatccatttgagcattgatcagctcacccttggtctcatatcgatacttaatcaggtcattagtggttaatctctcgtcaatatttgaaggttcattgatttgttttgggtccatttccttttcctctttactttttagattgacgtcatcgaaaattgatcagacaaattcaatctcaatgcttgcttttcaataatccagtcataaatcgttttgaaagtctgtgaattcaacaattatgatgccagtggttacaataaatttctctatgtccattatagtaagcgctttcttttactaaatcaagtctttttttcttatattaggtacttatatccaactttttgcttaaaatttttaataattgctacatataagttatttttcgatatttttggcaaataaaaacacactgtcggttcccgagcaatgtgttacttttgaaggtatttttgaaggatatattttggtgtatcattttgtacaactattcttttaatcttatttttctaaatattttgcgcgtaacttattaatatcggaactggttagaccaagtcctttgtgtaggaatccattcattgacccataatgcttgtttgctgccttatatgcttcatccaaatactgtttctcaacaatcaacccataataattgcttttaagttcagtcttgctggcgccttttttcttcagcgcagcgagtgcagcatcattagtctgtttacggtatttgtttgaaagcaggaaatctttatagattgtgtctttatctacccccaaagcggttaatacaagggcagttccgaagccggcacgatccttaccagcactgcagtgccacaaaactgctttgcctttgggaaccgtcaataattcatggaacagtttcttgtatgcagccctaccttgtgtagaatccacaaaatagttgtaataatcaatcatagcttgttcgccattcttatcgaaaattttatcgttcgattgactttccttgttggatacaaccggatcggcaacgtacgtgacaccactcattttaacatcgggtgccgctttcatttctgcaggtgtccgtaaatctacatctactgccaaatgatgttgttttgtcaatacctgttgatcatgcttggttagcgtattcaacttggcagaccgaattaacatattgggcttaaccttgagcccggacttagtacgataaccgccaagatcacgaacgttgactgcaccactgagcttaatctgtgagccggcaccgtatcctgatttggttgtggcggcaattgccgtaggtgacgcctgattttgaatcggtgccgcaattgcaacaccggtcgaactcaacgtgagcgcaaccatcacagataaaattgactttttcatcttggataactctcccctgaccattttttggtacaagttcatgttatcaagttgtcgtaaaggcctggtaaatttcgtgtaaagatgtcgtataaaacaaccgattactgaaaaatcaccaatatacaaatccattactgatagacggctttaaatcttaactgcttttttttaataacgtttcaagatttctcttacgcaattcccttggcaaaaagttacggatttcttcatcgttgaagcctaccaataacttctcatcattaaagaggatcggtcgcttcaacatttcaggatgcttggttaatacatcaataaactgtgacaaaggcattgcatcaagatccgtttttacacgcttatacgcattcgaacgggttgcgacaatatcctcacaaccattttcacttaggcgaaggatttgtttaatttcatcggcgtgaagtggtcgccgataaatatcccgttctgcaaactcaagatggtgttcggttaaccattggcgcgctttacgacttgaagtactacttggagcaactaataaatgtagcataagcctctcctcctcacgaagatgacaattaaaaataatttaacgaatttaatatatacacatggtatcacattaataatttatgtgaaataggtttttactaatctattcattgacatttcttacattgcgatgtccaaacttaatattaatcaaaatggagcgatctatttttaatattaaataaattagttgtgtacaatttaatagtctaactttagcacgctttactgaataatacaatcgctcaaacgaaaaaaatatcgaataattcatagaagttttctatcataggccaacatccttattattccaacacaaaaatgccctttttaatggcccccaaaatttttgaaaacaaaaaaatgcagaagacttgcttccaccgatttttttcgttatcttcgatttataaatgaaaggagattgcaatggcattcaatgaggaccaggattttattcaacaacttgctcaacttaaccatgaaatgacagattatcttaaccaccatatttcatatccaaatattaacgccaataattatttttatttattaaaattattaaacaacccaaatatcatccaaaatgatttttcctctttggtgaaactcaaccaaagtaccatcacccgctcagttaacgcgctggaaaagaacggttacttaatgaaacatgctgcaacagataagcgaagccataccttacagctgacagaatcaggaacgactgccgccaaggatatcagtgctctgatagatgatttaaataacaatatccttgcatgcgatcccaaaatagatgtcgcgactttaatccagagaatgcggcagctaaactcacccagcccaacttcacacaatcggcttaatggtgagtcagcctaaatggatcgtctctgagtgtcaccacctcatcctcacgcatcaagcaggcatccaagtcatgaataattgtttctttatccatattttgaccaataaagaccagttcaatcatgcggtcaccaaaacgctcatcccaaatttcccgaagatgtttacgaaccgtaaacatcttttttatttcccattctttcatcgatgcaatccagtatcccgatggaataatgtccattgcccgaccggattgggaaatattgaagactctttcgggttgggtaatcagccacatcacacccttacatctcgtgatctcaggcggccattggtccagccagtcattaaaacgtttgggattaaaaggccgtcgccgtcggtagacaaacgactcaatgccaaattttaaatcatgatgttcagagaaatggcttaaatcatccgaacgatcataatctttaagttctgttttctcgtcaaatagccgggtattcaccactttactgacaggtaccacggcaaatctggtttctaaaaatttagcccacggttgcaattgcctgataaacttttttagatacagttgttgttcattcgtcaaaagatccgttttattaaaaaggaggacgtcgcaaaattcgatttggttgatgatcaattgattgctttgggtaaagtcctgattatactcaccgacaccgggcataagttgctgtaaaactctgaacccatccacaattgtgacgttggtatctaaacgacagctatctgaaagtcttcggccatctgtgttctttcctcgagaaataaatttggcaaccatatccggttgaacaatgccggaagattctatcaaaatcaaatcaacatctcccgaagctgccaaatcatagactgcatctactaaccgttgacgaagattaccactaatactgccgttggttagtgcaattaatcgatctgcttgcgagaaatacggatttttttcaatcattttttcatccacattaactgccgccaaatcattgacgataatgccgactctcctatgttccttacatttcagtaaatgcaaaatcaacgtcgttttcccggcaccaaggtatccggaaatgaccgtcactggaattcagttatccaaacaacgcacatcctttcacaatctaaatagtaattaatactatttaatcctaccatattctttctccagatccagtcctttttggcattaaggccggctttgtttcctgaattatgcttgcctttgctggcatttatcaaagttatccccgttattgacaacctgacaaataattcaacgctgatcgtgataagattctcaggccccagaagctaggacctattgcttgcgttaagtcggtacatcactggactttgccaatccaatttctccttaatccgctgataattgtaataatataaatatcgatcgatagctgtttttaactcatcgtaactgtgaaaggtttttccataatacatctcacgtttcaaaatactaaagaaattttccataatcgcattatccaaacaagtcccctttctggacatactttggaaaatgcgatgttgctttaacttgcgatgatagtccgctgattggtatccccacccctgatcagaatgaaacgtccgtcggtaacggcaatcatcagtgatccgaatggcctcatccaagccttctaaaatggcctgctcatttggaaccggtgacagccgatatgaaatgatttcactgttatacatatccagaaaaacatcaagataaagaccgtgtacggttgccggttctccaatacaaatatcaaaatagactaattccgttgtatccgtcgtaattttttgatgacaaaccggtgtctgaaaacggcgtttaagccgattcttacaaataaagccaacttttccttcataggaatgatatgtactgcggtattccgacacgtgagttgagtatccctttacgtgaatccccatttttcgcatcaatcgctgaatacgtttcttgttcacaagcatgccatagccacgtaaggcaaccgtcattcgtcgataaccataatccggattttgacgatgaatcaataaaatttgatcttccaactccttatccgggtcgccaagattaaatcttttttgccaatacatataggtcgccttcggaaatttcagggcccgcaaaatatctgccaatacaaattggtcccgaagccccagaataaactgggcaatttctcgtttggtcaagtcggctgctttcttcccagcagccgaaacatttttaaaaaggactgccggatatcgtcattaataaaccagtcggtcaataattcagtttgctcatatcgtcgcatgaacccacttccttaaaattggtaaacactctgcttcttattccttatttgttcatatcataccgctttttaactatttttagtgtttgaagtcggacctgcttttacaagtctgttaagtcaatgtcgctcagcttattcctaagcagcaaccagcattttctttaaattgattaaccatcatttcataaaaataattagctgatcgtctttttctttgaattagttgtgttttttactttgatttgtgtgataataattttaggaggtcctaagatatggataaactaaaccgaaaatcccgaaagcatctcgaagaaattcttgtgaactatgtccttgaagaatcaatccacgctgattttggctatatgtacagttccgtaggcagtccccaattaatctcccaactgatctcggctcgtgaaaagccggttaagcgaacggtcgctaagctaaacgataaagacctgctcgaaaagttggatcgtgttcaatctttagcagcagatgcagatgcggttaactaaggctcatcaggattttaccttagttaacccgttataagcgttttacaaattttcattactttgagaggcgattttaaatggatagaaatgttaatgcttcggataaatctaagcgtgtcccgttaaaagcttggtacaaagacgccatatgctggttgttaatcgcagttgtcgcggtcttgatcatcacatcgtgggctttcttctagcagttccgtttataaatttgccaaatcaaaccgttcccttaattgtggaatcatgtctgtgtatctaaatgattatgttaattctgagcaaaaaactatttttcacttaaaattaacaccgtcagcgacgacatggcttctcattaattaaggggatttttcatttaataatgaacgctctaaaaatagttgagcaaaatatgaacgcacttaatcattgcagccttatactgtaaatagagagaaagaaaagacttcctctcagacgttgattaatttcacgtctgtttggttgcgtgactgaatattgataaggaggacgtttatatgacatcactaaagagattatttggtcgtcactttaagaaagacagcacccgcacggaaaattcaaagatcagcttaaagggtcgtttgttttggaactcggttttaaaaggtcaataaaaagatgaattgcttagtatgtatataagaggccaaaaggcatcacgctttgatggtctctttaattttggctttatgattgattttgcctggtttccaaggatttaaaatgattataggtcatttccaacaatgttttgggagacgcattgtccaaaattcgaattctatcaggatgtgccgccgggcggtccttatagattcgactgtttacatgatgagacccttcaatcaggatgaatgccaaatccgtatcgacattttcgattctttgataaataaagtcgccactctgctcactgggatccaacacgtcgatctgcacgtcaaacggttgaaaaaggcgcttatagctgatctgtttaaaccaggtcacaatcctaatcgtcttgttgcctaaaatcgcttttgcgtcgggatgatcttccataaaccgtttagcaaacgtatcttttaccggtcgcttatcctgacgaccactttgaaaatgatcagagccaagctgatttttatcctcagttagggccgtgtaacgcttattaatcacaaaactgtcagtgtccgcaaaataattaccacgatagacatcgttttctacaagatcaaatctgttaccttggacctgtggaccaggaaaaatcgagccatccaaagaaataaacgccggctgaccattaataggcttgacgtaaccataaagctgctggctattgtgtaggtggtcactgtcaactgtatgtaggatggtattttcctcggcctttttcagtaaataattaacccgattatataatggcagcactgataggaacctcatgacattacgctcatcaagtcggtaaaacaactcactgaccagctgctgaatagaagcctgcttcatatgcggatcaggctgtctggattggcttaaccgattgtttaactgatcgagcttggatttttgcttaaggttgtccagccgtttgcgaaaccccttaatgtcttctttcaaattttgattctcattgatcaatgatttattttgagatcgcagtgcgccaagttcttggccttctgtgctacgaagaagcttttggtagttttgcgttacccgtttattcatatctgagagtgactggattcgcctgccctgggcctgattgtttttctccaagccgtccctgaccctgtaaaacgcctcgacctgctgtttggattctgcttgtgcacgtcgtgtttcaagcaactcagcctgaagtttcgtcctttgagcttccagattcgtcaccattttctttaactgtctgattttttgtcgaccagttcttcgttcaatctggttttgtctcagtttggcttttaaccgcttattgtctttggtctctttttttagtttcttgccaaactttgattgacgtgactcatgagtcttctcaatcggttctacttgggattgttttaaagcgtttgccgccaatttttcctgctttttcttaaaggcctccaacacttcatcccgatgttgatcggcaagactctgattcttcttctgtgccttgttcatgcgtcgtggatcatatcgcacaactgaccacctctcttcattttttaagtgttgctgattctcatatagagaatattgtgtaaaactaattataactcttttagcattcccattaaaccttatttcacatgttgatcattgccaacggcaacttcctgcaaaaagttaattaggcaacctcatttttatctctgccacaaatccctcaaaaaccacaattcgttttaatgacaacatcagcacttgcaatcaacaattcattctccgaaatcaatgacctggtcaaagtcaaatataaatcgtatgaattgtgcaaccttcccaaatgtttcaggatccaactcatctacttttttgattgcccgccgctcagatataaaatcaagagaacggagttgtatcgcattaacctgccctgtaacatgtcgggtattcattgaaaaaaacccggcccgttttctaattgtatgagtaatcgggcaaacctggacaaagccggttttagcattataaccatcagagctgactactactactggccgtcgctttttgatttcacggccaacttgtggatcaaggttcacggtgataatgtctccctgtcttggcgtatagccatgatactgatagtctctcatcaaatttcttcccgccctgcagtcatatcgttaaatgcttcatcctcatgatcaaaactaatagccttatctttaaacggattactcattttgggtacataggtaattgaatggtcccgtcctttgacagcaataacttcatcgccggctttaaaatcaaatctggatgggactgtcacaaccaatgagtttccctgttgacgaattttcataactgtttctccttcgtattcacattgtcattacttttaattataaaacatttttcagaaaacgtataggaagacgatttctctaactcacttctttttaatgatgcctttaagtacgcaccgtagaaacaaggtattacgagttgctaaaaaatccagttaagggctaactcattcggcctttaactggatcttattcaattaatgattaaattgtaagcatacgaacagactttactaaaccattttaaccagcttctgattatctaatgactttaacgtacttcgcattccccgtaatgtacccgccggcaacctgatatctcagagtcccccgctgcgtcatatcatgggttctggaataaaccgcccgcttaactttaaatactttttgtgttttcttgctatactgacggttcttctttgtgagattaacgttactgtaacgattaatagcacccttggccttcacctgtttggcaaacttgtaatgaccggcaatgaccaatttacgattagcagtgacgtaaccgccattcgttaagacaaatcgagtggtcagattgtgcgtttccaatcgcttaactttcaacacagttccctgtttataatttttgattttgttggctaggttcttctgccggtgcaggttaacacccttgggattaatcaccgtaatggtgcgatgctttccttgatagtaaaccggcaagacatacttggaattagcggtaatataacctgttttgcctgcggttgccgatttgtgattaacatctttcaccttgtagcgcaaagtaccattcttggacttggcataatcggtcacaacgaacatcggccggttgattctcggctttttggtatagtatacaagtcgctgttttttgttaaaagtcggtttttgatacaagtaaatcttattgaccgcgtaaacggcctggttcttcttcgcaactattccgccgtccggattagtcggtggcgtttcgggctctgatggcttttccggtgttgtcggcggctccggtttggaaggttcaaccggatttgccgggccgatcggcgtagatggcagccccggtgttgttccggttccgccaccgttaccggtattgccattgtcaccaccagtagatttcttcgaatagacgacgttaatattgccgccgttttcaggaatggttacctttttggtacttgtttcatagccgtcatacgctggtacctcgataacatctcccggaagtccgctgcccttcttcggggtgaggcctgcaattggtttgccgtcctgatcaactggaacaataacgtaatccacgctgatagctgtactttcataagggatcaaatattcaatgaccggtatctgaaccgaatcaggcgccattcggtaatccgcaattaaataatacgtgtacggatttcgaacaacttgagccttgtttccccaaggatcttcgacatcaatccccggcttaatttgagttttaagattgttatagttaaaatcatctcctgaaaccgatgcggcaccactgatccggaaaacctgaacgtgactggtaggaccgttacgggcatcaatccggtatccaatgccaccgccggttgccactgccagatttttctgatcataaacaagatccttaccggtccacggatttctggcattctttggcagcttattgataaatggttcggtcagcttatacgcattgtctttcgcgtaaacgggcggtaataccacctgttgaccaatatatgaaagaccatttgtgaatttcttaccatccaatgacgagaggtccgcaatacaattagacatcacattgagttttgtcaactttggcaaattggcaaccggtgtaatatcggtaattcggttgccggataattcaagcgtctgcaacttatccaatttactaagtggtttcacatccgtgatatcattacggaaaaactggtgttgataattcaagttttcattcatgttaatggtttcaagatttgttgcatattgaagcccttcaagcgagtagtttcccgggttggtcggtccaagtgaaccattaccgccaacaaccggttccgtcaggattggatcctgagccccggtccctggaaagtaaatgagtgacttgagatccttaatattatcctgcgtaatctcattaacattggctaggaccggtttcccttcttttttatactgttgattcaaatcatataaaaccagattttgtagttgctgattaggcatccatgaatcaatgcctgcagacctcgctgtcgttgatagactcattccaaaaagcatcccagctaccacgatcattcccaataagaaagatagcagatatctttgtaaacgctttctaaaaagtcccaaacttccccgtttgttttcttgcatgttggctcccccgttcaattacgtgacaggctaaatagtttccccggtacacgtttattataacgggtttatcatgggtttcaaagaagtttgcctatattagtgcatctttaatattctttatagtcttcaaaaaaaggcgccactccatgattactggcaccctcctgacaaaactgactaaataaccttcttttctgattatgacactatttaacaactttaacgtatttggtattaccggttatataaccactggcaacccggtaccttaacgcgccgtgtttcttcatatggtgtgttcttgaatattcccaacgtaaaactttgaaagtccttttggtatatcggccattacgctttgttaaattaacgttgcgataacggttgaccgtccccttggctctaacatatttggccgtcttatgcttgccggcaatcaccaattttcgatttgccgtcacatgtcgtccattgcttaacacaaatcgggtagtcaggttatgctttttaagctggcgaactttcaaaacggttccctgtttataatttttaacctttttggtcagattcttattccggtaagcattaaccccacgtggattaatcacggtaatagttgcatgcttaccctgataataaacgggaatgacgtacttggcattggtggtaatgtagccggttttcccgaccgtcttagatttatggttgacgtctttgacatagtatcgaagcttgccattggctgatttggcataatcagtcacaacaaacatcggtcggttgatccgtggcttcttggtgtaaaccgtcagccgttgggtcttattaaatgtcggtttccgatatagataaatcttattgatcccgtagactgcctcaccctttttagctaccagcccggcattgggatcgtcgggtgtggttggtgtgatcggtgttgacggagtgattggcgtacttggcgttgccggttttgccggtatcaacggtgtcaacggggtggttgttacgccgccgcccgaaccgccactgccaccaccggagccgccacccgtggacttgactttatacacgtaggtgaaggtttggtcattgtccgaaaatgtttttggcagggtcttctgatccttttcgcccatcaactcgtaggtaataccatccttgatgattgtcgaaggaatcttgggtgccaaataggtgtcaccggttttaccgctcttttcgtcggccgcctgcaggacagtgcccttttcatcgacaaagtgcacagttaccttgtgttcaaccactggttcacttttggtgtaataataatagaccgtttgtggtttatcggaaatggttccgattccgtttgccggcaaccggttggtatccagtttgtaggtcaccccatcggttccggaaattgttgccaatttgtattcagcagttgtcacatcgtaggaatcgccaaggttacccgatagttgtttgctttgaatgacgtttcccgttgtcgagtcaatatagtaaaccgtcacattttgaccggcaatcttttcattaacgtagggtagtgtcacggtaaaaatcggattttgtccggcagttgaatcgaaatattggcctatcatgaaataggtgtagtcgttttgaatgattttttcaatttgaccgggtatgggattagatgtaggtccgggcataatctgagtcggcaagcctgtatatttcaagccgccattgccatcccgagtggctgtcccacctttgtaaaagggcagcacgatatattttccgctcctgttatccaatccgattgtctgaagaaccgctgccccggacatgaccattttggcagtctcaccacccggcagtttcaggggtgaggccatctcataagttgtgccggacccgatatacaccggactcaaattaacggtctgtccctggtatgaaaagccatcagtgtattgagaagccgttagtttggataaatccgccatatagttgaaactaatattcaggtatttcagattggtcagcccaactaatggggtaacgtcggtaatctcattttgcctgacatcaacataggttagctttgtcagcttttcaatcggggttagatctctgatattccccctaaactgtcttggcgggtagttcaacccggcaaataatactagtttctttaaatttatggcatattgcaagccttcaagggaataatttttcccgtcattataagtcgtattaatattttgatcggttgaatttgaatctacctgcaattccgccaatagcgccatgtcgctttctttaatatcattgacggacgcccacgttttgccatcaggctgctgctcatttaaattaaataaaaccagctgctgcaattttttgtttggcatccacgtatcaatactgtcagcacgggcaaccgcagccgtattggcttgtccacccatcattgcaaatccaaaaataatggttatagtcgtcagtaaggtcatcagcagaatcttaaagcgtttcgaaaacgaaccggaactcggtccactaaaaagttgcatgtcgatttccccctataatttatgatcacaaggtaaataataacccccgtttatttaattgtatcgtgaaagcgcttaattcaaaagcggcttgctcaaaaatggcctattctcattttcttcaaataaatatggcaagagtagcgcatttcctcatcggaaaacgttgtccttgccatatttatgttttacaaactatgattaacgcgtgccttggataaccaggcccttgtttgctgaaacgtaatgaccatttgatagctgataacgagtcgtcaacttgtacctcttaattgctttcactttcaaatgggtaccacgcttataatgtttaattttgcccttcaaactaacagtttgataagcattgagtcctttctttgaaataaccgtaatcgcctttgtttttggcaaccttgtttcaaaaagtgggctgacaaatcggctgcttgcggtgatatagccagattttccaaagttcctgctgtgagaatcagtatccttcacctggaaacgtaacgtcccatttgatgaacgtgcatagccggtgacaacaaatgtaggccgattgatccggcttcgctttgggtacgttgcgagtcgctgaccgaccttaaaatcagcgtttttgtacagataaattttcttaaccgcaacgattgattcaccaattttaattttacttggttttgtttcagttgttgcccccgtggtcgttgaaccggttgaagtcgagctggaaccagttgttgcagacgagcttgaagaactacttgatgaacttgaagaactggaactggttgtgggtactgaacttgaactcgaacttgagcctgtttcacttccagtgtttcctccagaaggtgttgaagccaatggagcgtcgtcatcaatagcatcaaccgaaaagttaccattcaatacctgaaccgtaacgtggtgggtcccatcactcaagccggttaaagcgtatgaagttgctcgcttggttgttttattgattgcctgattatctgcgacaactttcccatcaacagacaccttaatattggcactatctgtcgccccgtctaacttaaagccggtgcctttgacatcaaatgccatggttccgtttgaagatgtcgaaatagtacggttaaaattatcgtaaccggttggataatcatgcctccaagtgcctgtgtatgtcacggctgaatcaacatcatcgtatcgttgtacaaatgacgctttcccattaattgattcaattttaacgttatcaaactgaccatgagaatagtttgtattcaagccgacttttccggtagcgtatgaagatgacttatcagtataattaaagacctgtttgccgtccacaaaagcagtgatggtattaccgtcagcgacaacctgtgcattgtgccacttagtcgcatcaaagttctgaagattggccgttgctacatcaccttgatctttgattaattttgcggtcccgtctttaaagactcttaactggtaaccggtatcttcagcggacttggaaccgccttgagtaatcaagttgcgaaccaataacgacacgtaattggtcccatttccatcatcattattatcaatcttgaaatctgaactgaatttatagttagcccagcggttatctcccattaccgtgtcatttccatttttagcgttccattcaccgtccgcatggatacttttatcaatcatcccctgaagcacattaccatgcccagtgtcattcgatttaacaacttggaacgagccgccgatatcttcaaagtaacgtggtgtgccgtcacgactggtcaaatacccttgtttggccgaatccaatacagttgtgtcttgataattttgatacttactatcactatattcaaaatcatccgcatatggcaaacttaattgatcgtccgcatacatcttttgactattctgatcttgataaggttgttggccggttgtcgtggttaaagttacgattgaatttgccggtaccgtataactgaaggtgtaattgccatcctgattcttcttcggagtcacattagcaacgctctttagccaattggcatcgtatttttgaccatcttttggaccactggtttgccatacatgaagagttttatccggattagccatgttagtgagcgtgtagttataagttcgcggctgagtgctatcattggtaatcacaactgaatagtcttttttatccggtgaggttaatgctaatcgattatccgaactggaactgtatggattattaccggtactaatcccttccgaggcaccctgaacatactgccagccggtttttgcaaattcactaatctgttgcgtaaccggaaggccggcatctacatagtaattgccggaccaaggtgtttccgcgtcaatcaaggatttggatgaatattgaccaccatcataaaaagcactgaccggcggctgaaattcataacgtgtcatgttggcactaacatccggggcagaatctgtggtcccattctttgaatggtacatattgataaatgcatttacaacgtccaacgcacccttttgaccacccaggccctgcttggaagggtcagcattgtttcggagctccgcataaccggatggtgcaatgccttccgaataccaaatttctttatgatactgatcgttcatttccttcatgtacggctgagtgtgggtctgataatgcattgaaatgacatcaaccgcgtttcttaaatcagggttatcgtgcattaaggttggcaattttgcactaccaagttcgtctgatgcaaccaatttgatttgagaaaaatcataaggtgtatctttatcactctttaactgattatggagataaatgatccaatccggttccggatttttggtttcatttttatccgcactcacatcattaagcttaatgccatatgtcttgtaaaccgaggtcagcgtctccttgatccatttatacctggccacataataggcatcctgaccagccgactttttatcactaacccactttggttcgctccaatgaagcatatctacctgtaaaccaggattaatcttctttgcgtccgcaacaatatgccagtcccagccacgaagtgtgtttgcgctttcattttccgaccgcattgtcgccggcgtcgacgcagttgacgtattgacatccgctcccatttccaccttaataaagttcaaagcgcccgtttgcggatcaaataaatccttcatgatttgccagtactgtgctggatgttccgctttataatccaacagtaaacgggatgttccatttgccgaaaccatcccaaatcccttgtaggtattcgccggattagtatcaacatttttcccgtcaattgtgacatcgtgtgtattagctgatgatgcccccgagtcatcagcgtgagccgccaccccataggcgctccctaatacaagtgaggataaaaccgctaaagaatagataaacttgttcttgtgcataaatttgcctcctaaataatgactagcgttggggattttactaaatacaatcgtatttggtaaaacacattattaatgtaagcggttttattagtaaagtcaatctattttttagtaatagtttggattgatttgtgaactcacattatcattattaattaaccggataaattttttagtaaaatattgccagtttaaagtatttcaaatgatatgtattcaattacaatttaatttcgccgttatttgttagtacgacttaatttttttataacgatccggatgaattttctgtttcagaatccatcatcaaactttcaaaaataaaagcaacttttcaatgacagtaaacataattttacaatcattaaagagttgcttttaacgcaaaaaaactgtttaaatgacaaattaagtgctattttacataaacctgtttggccacgttatatgtgacgattaatgccttgtgacccttgtaggtcgttggtttcatctgaaacgtttcacctgctcgatgaccatttttaattggaaagacagtcacactgccttttgtcttataaacgcccatcgaatgaccactaaaatgacccgcctcgctttttacaaagcggctgccgacaactaatttagcgccggatcccttatgccaactgccattaggataacgctgcctactttgccgccaggttccgtgataagaaaccgggattcgctggtaaacactttgagcctgcgatgtttcagatgcagaaagtgcaaagaaaatagcaatgccgaaaagcagaccaattactgatgcaagtaatacctttgacctcttcactctaatcacccctacgtttatttagctttagagccaaatctattataagtcgggaagggtcggttcactcgaatttttacaatgtttgacgttatttttacgttcgatatcaaatagacacaaatggtaccgaaaggatatccctgatcctgaaaaaagattaaacatgacttttatagatgcttaattatcatgggtcattgtcaaattgttaaccatcttccgaactttatcccccgctttatcagcattgagttgcttaatcaacttagttttggtagttgcttccgtcagatttttatgaaatgagtgaacgacaaagctgtggtaaatgatacgtccgtctttttttatctcaaaccagttcggttcaaggttcttttcattagtggtgatattcttgtcgggccacaccaagtaatgagtaccacgatcagtatggtggctttcaatctgccaaccaagactgaagtcggatacttcctgccagcgttgaattttaacgtgtttcactgcaaaataaatgatgctgcaaaacatcaatttccgattctgcttcagctcatccctagaaagtggtgtaactgtctttttttgagagctgatcttttttgcgattcgttggctattttgcgtttggtgagaatgatggttattaacattggtcagcgagaaaaatatgacacccaatatgatgaccatcagtgcaccaaaacttagtccctttttcatcgccatgtcctttcccttgcttgattagaactaattatttgctatttaaaataactcgggtcattacttccaaataaccactgataataaaacggttgtttgccaacctgaaagtcggtccatttaaaaagatagaaataagatttttcataaaatactttgtgtctcttcccaagatttttaacagttaaacggtagccatggtgactcttcttcattctcagtccgtcaaccggatgatgaaaataaagatagtagttgttctttttaaccacaaatttctgaacttttcttgaaacggaaggtttaatagtaaaaagtggatttcgatcacccataacttggttatattcccaagcggactgaatatgataatgcttcaatttacttgaacgataatattgaagataaccgtccattgtgatgttaaaaatcggctgataatccttggcattcgagagcgtgaacctgccagcctgtaactgatcggttctaatcggcagctttagtttataaagcttgaaataagtcgtattaaagtgggtagtttgatatgaaagcgaccatgaaacatgctgcttcttgtgatagctcaaaataccgggaattaacgtcactctcgacggcctcccattttttgctttcttattgataaaagtgaatagtatcgtgcctttgggcgttaaaatccggtgaccgcgatgaccattcaccttggtatactcacctataaaaatcggtcttttaacctcaacacatttagtgtgatagttggtccccaaatcagtcgctgcatgaatagataatggcaatgaaagccccagtgccatactagccatcatcactaataaacctttcttgatcattccccccatcccagaatataaagttaatttctcttctaatatgactctttttaataaaatgtgcaatctaatatttgataagcgtaaaaaggatcttctgctttttttgcaaaagatccttaaggtataatccgcattatacaacactatcagacacattctgatcaatgaatctcaaagaaaaatcctcttggtcgtacaggcgttgaaaagaccatcattgtatttgttttgccgaaacgttgcaatttattgaccaaatcatccagttcttcaggaaccttataggctactttcagtagcattgcgtatggtccagttacaacattgcattccaaaatatttggaatctgtttgataaatgaataaaattgattcttttgattagggctaacgtcgacttggacaaaggcgcgaacactcagttccagtttgttcatatcaatttcagcacggtaccctttaatgatgcctttgttctttaaattagtcagtcgttgagaaacggccggtccacttaacgataaagcttgggcaattctttttacagacaagcggccatcagtttggataaggtttaggatcttttcatcgttttcgtcgatcatatcaattctccttttgtaaaactattaagtaaaacgcttattgattttatgaattaagtatatacccaataaagtagtaaggtaaacggttatttttagacaattaagatttacttccgataaatccaaaaaagctgataacaattaacttgcatcagcttttttgtaatttacgttcttatcttgccgagaaactgattttatcatccatcattaggcaaaataattttagtcgaatgttcttaatgaatccataattaacttgatgaattttggtctatcaattcccaaaagtacatctgtgttttgtggctttcctgtcaattcataataatcacaaactgtttccccagtggttaattctccctgagtttcaacatctacgttcattaatttactttcaaacattgaaggatcaattagccatgcaagcgtacatggatcgtgtaaaggtgcccccttaaagccccatttaggtgcttcatgataaatttcaaagaagttaagtagtccataaaatgcgtgagctaccggattattaatctcatcaacctttttaatttcatcctttagaatttgtgctttgtgagtcacatttaacggtgccattgttaatggaatgcctgcattcaaaacaatttttgcagcttctggatcaacaaatatattaaactcgactgatggtgtccaatttccaaggcccattgccccacccatgaaaacaattctttcaattttatttgttaattctggataaacccttagaaagatcgcagcattagtcattggtccggtaacaaccaatgtcactttttcattagattcttgaattgttttggccattaattcaatggctgtcatattctgtggtttaaaatcaggatcaggcaattctgctccatccaaaccagacttgccatgaacattaccagcagtttctaacggtttcactagaggtgtatgatttccacccgctaccggaatttcctcatgcttcattaaggtcagcattctcatagcgttgtttaaggttttatccggagtttggttacccgctgacgtagtaactgccgctaggtcaattttgggtgaggcaattgccatcatcattgccaaagcatcatcgtgtcccggatcacaatctaaaataatttttgtcatcattatctccctactttctagttgttaacagctgatttaaacgatccattaaatttgcgagcggttttagacacccaaatattaactaaaataccacttaaactcatgacaataatcagccaggctttaatccctgaaattgtcgttactgtcatagcaatattgcttataaaacccatgccataaacaacgttgacaaagtcaataaaaggtactgcaaatctttttaatccgaacaatcgtaccaaagcccaaagatacaaaacaactacaaacgctgccgatctcaaaaccgtactgagatctgtttgatgattttgcaaaataaaagtaaacgaattactaaaaacgaaaagtgttagtgccaatagaaccaacgaaatcaatctttgcttatagcctttcatcatttgaccccttctccattaatccgttaattaaaagtacacaccaacgattgttcctgtcagaacagatgccaaagttgcaccaagcaaaagtttcattgagaatttggcaacgtagccaccctgttcggcactaattgatttaatcgatccggaaacaatcccaatagttccaaaattggcaaaagaaaccaagtatgctgaaataatcgcatttgccttaacactaagagtcgctgcaactccatgtaatgttcccatagcaacaaactcgttggtaattaacttagtcgccatcaaactaccaacctttaggacgtcatgagttggaacacccattagatatgcaatcggtgcaaatacatagccgattaagtcagtgaaactgatatggataacggccaagaaggtattgtttaagaacgtaaccaatgcaacaaatccaatcagcattgcaccaaccgtaattgccagttggaatccatcaacgatatagtttcccaagacctggaagaatggctcatcatttcctttggtcacttctactaatttatcctctttttctggaatgtaagggtttacaatacaagaaataattaaagcagataaaatattaagaaatacagctacaacaacgaattttcccggaaccattttcatatacgatgctaacatagcagctgatacagcactcatagctgaagcacaaatcgtatataaacgctgttcggttaactttggaatttgatccttaacggttaagaaaacttctggttgtcccaaaatagcagtcgagacagcgaaataactttccagttcgcccattcccgaaaccttgttcaatgcccaacctgtccatttaataatgaatggcaaaaccttgatgtagttcaaaatccctacaagtgcagagataaagacaattggcatcaaaacagtcaggaagaagaccgaaccacccggtttaatcatcaacccgccaaatacaaaatcgacaccaccggaggcttgctgcatcaaccaactaaagaacgaagaaatgcctttaagggcatttatgccgcccgaagtgtgtaaacaaatgaatgaaataataatttgcagagcaaataacttggcaatcgagaaaaatcggatgtgctttcgatcgctgcttattaaccaaccaataccaaataccagtgcgagtcctgttaaaagaaagacaaagttcatttttttcactcctcgtatgacttactataattactgtcgtccaaattcatctaagaaagcttgtacattcttcaaattcaggttaacaggcgtattaccggcaaaccgttcatgaaggacgtcttgtgcattagaggtaatttctcgctgatcaatgtgataatctgtgaatggatgcaacccaagaatctgatcacgaaattctttataggcattaattgcaaattctgtagtctgagattcgggtgctccttcaggataagtaactcccaaaatctgaccgatttccctaactttatgggggagtgtcgatccaaccaattttaatacgccgggtaaagcgtaagcgaccgcttcaccatggacaatatgatatttagatcccaatatatgggctgaagaatggccaatattggtcccggcattatttagcatccaccccgccaatgtagcagcaaccataacccgttgccgtgcttcacgatcttgtccattggcaactgcacgtggcagaaaatgatatagcaggaacatgactttctcacaaatggcatcagtcattggggaagctaaagtagatagatatccctctgcagcatgggaaaacgcatctaaacctgttgcaattgtcatatctttaggtaatgtcaaaaccaaatccggattcaagacagcatattcactcactgcattatctgataaaatcgccaactttttttgggaatctttatcagtaataaccaatgcattggaaacttcgcttcccgtcccggaagttgttggcactgcgatcaatccgggacacggatcgattgttttatgagatgttgcatagtcgctaattgatccaccgttaattcgaacaatattaatccctcgtgcaacatcgattgagcttccgccaccaatagcaatcatgcaatcagcttgatgcgctttaaaagccttaacaccactatcaacgacttcagtgggtggatccggcacaatgccgtcaaaaatagcaaagtcgatatcgttatttttaagtttgttcaaagtatccttaataatttgaacatttaacagaaaacggtccagtacgaccaacggacgcttatattgtcgttcttctaaaatctctaagatcgtttggtctaaatgatctgtgttaactattttgaccttttgcagcaacttaacgtttatcaatttgtttcttcccttcaataaaaatatgtttttgaatccattcccctagtatttgaattgttggccctgttgttaaagcggtaagaattgtaattgccccaaattttccgccaagtaagaatcctgtagtcatcaggcagatatcaaacgtcatcttactgcgtcgaatactccaaccagttcggtcacgaatcgtcagcatgaagccgttgaatggatcaacaccaatatcagcagctacaaacagactaataccaatataataaagactaataccggttaagccaccaaaacatctggtaatcattgaggcgttattgaacaagtatggataaagatgcgatcctattgtaatgaatagcccatacggtaataggtacatcaccgtgccgatgttgacataatgtctgccaaaaataaataggatcacaatcagcccaatgtttaaaaggtttgaaacaagccctaatttaatcatcggaatttgaaacgctactcttaacccatcataaataatgccgaccggatcatttcccaatccagtattattattaaatgccacacctacacaaaccaggaaaatgccgaccatggccaaagaaatttttttgaaactcaaacggtttttaactacttctgatcgaatcatttaattttataagccgatttctttggcagcttcatcagcacgttggcagaacaatcgaactttatcaatatccttttccatattgccgccttcgtacttaatactggtcttagtcagtgagtcaacaccatatggcttaatctttttaattgcatcagcgacattatcagggcctaaaccaccagcttcaataactggaatatcaacttctttaacaatttgagcatcaatattccaatcatgcgtttgtccacttgcaccgattccggtatccggtgccaatcctgagtctaataggagataatctacaaaaggcgcaaagtgtttggcacggtcaattgcagactcattgtcaattaaaacagcttgcattaagtctgtatccggcgcaacttccttgaggcgtttagcaaatgcaggagttgcggcgtaaccatcaccagcaatgtgcaaaatatccggttggatctcttctgctaactgaagcatttcttcaggatcatttgttaacataatggcaactgaattaacgccacgtttctttgcttcattgaagatcttatgcacccgatcaagcggtacccgatgcgcgggaacaccaccattttgcattggtactaaaccaatattgttggcaccggcctccattgtttttacactttcgtcgtattgaattaaagaataaatttgcttaatcattatcgataatctccttgaatttttaatagttaaattgctacagtcatactttctaatttggccattaccttatcaacggtgatgttcggcactgacttggaactttccagtgcaatacttgaagcggcttgagcgattcgcccaacttctcccaattgccggttgggattatcaaagaagctccaggtaatggctgccataccgcaatcaccggctccattagcatttacaattttagtggtaaatggatgaataactaattttttccattgatttgcacataaaatgccttttgcgcccaacgaaatataaacgttttggacacctcgatctaataaagcttgagcagcctctttagcagtctcttcatctcgaatctcaattcccgtaagcagggaagcctccagcgcattgggctttaaagtcgtcatcttatccaagattccctctagatgccgtgctttggcacatgaaactgtatctccaaaaagaggaacttctacattttggccgatccaatcaatcgtttctttggctagattggcatcaactaagcacaacttggcattatttatgaagtccaaacgtttttttagaaacgatggcgaaatttgcttacaaatctccatgtcgttaacgccaacgagcatatcaccggtttcatcagtgatatacatataagttgatgatcgctggttttcaatttcagcagcataatccaacaaaatcttgttttgtcgacacgattcttttaatacttggccattgtaatcattgccataaacggtaataaggtacgttggcacatccaaatgagccaggttttgggcgatgttttgaccaaccccaccaaccgtcattccgacaacgccgggatttgaatcacgatcaatcaccttttcgttgggcatcccgaaaatatccatgttcatgccaccaataacgacaacgtaatcttttgattcgtactctgggcttcccatgatagaatcctccttgtttatcgttcttaaacataagtttagaatggtaaacttatgttagttaaacaatacatcattctgtaagcgccgtcaatttaaaatgtgattattttcacttctataattgaacgtacaaaaaaagcattttgaattaaaagactcatgataattcaaaatgctaataaaataagcgcttcttttgttcagttaatgcattgatgcttaattgttcattaacggcacttttactctctgaagtaaggtaagcagcggcattggccaattcagctgcttctttaaatgatttgtgcttttgtctggcaaatactaacgctgccgtagctgctgctccggcaccattggtattcgtcagttcaatagaaggttgtggaaaatattgaatcgcatctttattctggtaaagcatgccgacgctatcaatgtacaaaaaaacattttttacaccaagacgcaataacttggttgagcaatcaattgcagtttgcttatccgtcggctgaatgccagagagaataggagcctcaatcccattaatgactaacgtatcgatcaaatgtaaatttgaccttaaacgttcggttttgcttagtgaaactgccttggcaaacacaggaccgttaaaattctgacatatccaccgaatcgtattctctggtaaatttgtgtccacaacaacttctgtagacccttggataacatcttccctgggtttcaagaattcaggagtgatcatttcgttgatccccatatcatccaatccaacaaatcgctcacctgtaggctgatttaaatagatataactggaagtctttcgattcatcaactgtttagagtatgtaatatccatatcattattagtggcatctattttaaattgttctccacctaaatcgtccccatatacggaaataaagtagttaaaaacccctaacttccgtaaatttaaagatatattacgtcccaggcctccaattgcgtgaaaaacatgtccaggtgttgaggttttagccataaattctcgactggcaataccgtaaatatctgtattgatgcctccaataactgttacatgttcgatcggggacacaatataccctttccccctcagatatccttttttcatcaagttagaaatatgggcagcaattcccgaacgtgatatcccggctaattttgctaattcaagttggctaatcatcggattttgacgaatccactcaagaatctgacgttcacgttgagtgatctcattattctcatccactactttttcccccaattatcatttttagtaaactttctaaatgcctctttaataatatcatatatccatttaacaactttaaaacatcaataatactcatctttacttgccaatcctacattttccaaactacgcaccgtttttacgagataacagcaataaaattatttttaccgacaaaaaaacgcaagccaccaattatgcttgcgtttttcgtgtttataaaagtaactaatcaaaacaggtattacaatgagacaattaatgatgccatctatttgcaaaagatgaaaaatttgggccaaaattaatatttaaaagccggtgtataaacaccactatataatttttcaagttctttagccacagatgctgtgtgataggctttcactatttgtttataagcagctttatttgcttcatcttttctcgcaacaatgacgttaatccaaggcttattctttggatcactgtatttcggtgaaacccgatagatagcatccttaatcggatccttctttgcagctaagacaaagtttgaattggtaatgccagcggtaaagtccggtagtaaattcataatcttggatggatcgacttgaataatttttaaatgatgtttattttgcgtaatatcttggattgcaggtgtgttccctttagatggatccaacttgattaatccggcagtctcaagcacttttaaggcacgccctgcatttgttacattatttggaattgcaattttatcaccattcttaatttgtgaaaggctcttgatcttacttgagaaaacgttcaatggtactaagtatgtctgtccaacaactttaaatttatagtgcttctctttttcttcttgatgtaaaaatgcatagtgttggaacgcggtcaggtcaatatccttatttgcctgcgcctgattggccggaacaccatcagtgaaactaaccagcttgactctaactttggatccctgctttttaaggttttgattaacctgtttccaaattggcgcatcactggttccaacaacaccaaccttgacaacctgttttcctgaagcatttttattcccacaagcgcttaaaaaggcagggatactgattaacagcgccaataacagaacaactttgataaaccgattaccttttttcataagactaaacactctctttctatcttgtcagtttacgactcagtaatgtaccaattgcttgaatgatgcttacaataataaccaatataatgatgcaggcatatgtggcgtccaattcgttttgttgataaccatattgaatggcataatcgccaatgccgccaccgccaacaacacccacgatggctgttaaacctatcaaactaataatggtgatcgttgtaacacgaataatatttggaatgccttctttaagataaatcgatcgaataatttgccatggtgttaagccaatgacctctccgacttcaatcagcccactatccacttcattgagggccgattcaatttgacgggtaaagaacggggtaatcccaacaattaatggaaaaatagttccctgaacaccaattgccgtgcccgatattatcctggttagtggaattaaggccgcaatcaaaatgataaatggaatcgaccggaataaattcacgattttatccaaaatagtccatgttgcgggttgttccaagagtcctccttttttggtggcaaccaaacaaattgctaagaacaaactaataacaaaggaaaccaccccaacaataattgtcatttccaacgtttggataactgctgtccagaagatgccggaattagccgacacatttggaaaccaatgactaatcagacttaacataatccaacacctccacacgaatatcctggtcttttagataagacaatgcatgctcaatttgttccggcttaccatcaagaacaaatgccaggcctccgattggcttggactgcagaattttaatatcaccgaccacaatattggcatcgacttcaaacgttcttgagatataagaaatcaacggctgcattgctttgccattcaaataagtgatcttcaccaaccgttgactgccggataaattaatcaaatgactatggataatttcatcagataaatccaatctggaagttgtgtctataaaccgtttggtcaagtcatccttaggatctgcaaaaatagaatagacatccccggattcaacgatctgaccatgatccaatacagcaacatcgtcgcaaatttgttcaatcacatccatctcatgtgtcaccacaatcaacgtaattcctaattcacgattcaatctccgcagtaaatcaagaatatcctgggtcgtttggggatcaagtgcactggtagcttcatcacaaagcaaaacctttggattatcaatcagtgctcttgcaattgcgacacgttgttgctgaccgcctgacaattcggatggaaacgcatttgccttatcaggtaatccgaccaagtctaataatttatcaacacgctttgccgcttcctcctttttctggtgttgatacttgattggtaaataaatattttgaaaaacggttctggaaggcattaaattaaactgctgaaagatcatgccgattttttggcgggcatctcgcaactcccctgcctttaactgattgataacttgatcttgaaaaaacacgttgcccctggttggcttttctatcccgttaacacaccggatcaaagtcgatttcccggcaccgctatatccaatgatgccaaaaatactgccttcgttaatacttaacgacacatcatttagaaccttctgactgacaccattctttttggggaaagtcttttcaacatgatcaaattttattaacgcattatttgtcatctagcaaattccccctttacacacttaatttatgagtgacatgttccaatttttgaatcgcattaaaaactgcctgttcatctgtcgccaaaggtaatagatgaattgttttatcaggcgaactggactctgcagcaatttgatgaatcagtgatgttgtgatttgttgaaatcccagttcctttaaatttgttggcaaattcagctttttaaataattgaatcaaccttcttaaatcatcaacgtgggcttccaaagcgagttgaaccaaaataccataagcaaccttttcaccgtggagcaacggctgggtttccttaaacaacgtcaatgcgtcatggactgaatgggcaccggttgcccgcccatattgatcaccccaaccgcctactgttccggcagttgcaataattgtttcaacaacgtttaaccactcggtcgttaattgcccggctttcatatctttaacagcggcaattgacgatttcaacaaaatatcacgacaatccacggccatttgaaacgagatttgcaacgtactatcaaaatgatcactttcagccaaatgttgaaataccagctcggactcataatattttgcaagcgtatctgcaataccggcaatcaagtaattcaccggggaatttaaaatgaccactgggttgactaaaagtaaatttgcagccgtatcataaacttcgtggtccaatcgttcaccgttttctttgtaatgaacgcttacggaagaccacggtgcacaattactagccaatgttggtattaaaaccaactgtacccgctcgtaatgactggcactcttggcagtatccagaactttaccaccacccaaaccaatcaccacttgaatatcatattgtttaatcagtgtccgaattcggttaatctcattaattgaacattcaccattaaaattaacattgtaaatatgactatcttttggtaactccggcaaatatggtttggctgcatttaaggatcgctgcccatgaagtaacagaatccgcgtcagttgattattagagagatactttggtagctgatcataagcttcggaagaaactacgtattgttgcgggccgattcttgaaataatcatattgatccctccattttttgtaacctgcttaaaactgcctttaacgtcttgtcactatgaaccaggctgaaccgaacatattgttgaccctctttgccaaatccaatccccggggcaactgcaatccccgcctgcttcaatagctgatccgcaaactgctgaccggttaattgttggggtgccctgacccaaacgaagaaggtccccgctgccggctgaacgtcaaactgaagttttctaagtcctgaaacaaacaaatcccttcgttgacgatacgcttgacggattttagtggcaccatcttgtgacccggataacgcctcaattgccgcatcctgaaccgccccgtataccgtgctgtaaacatgagcgtgatatttttttagactggcaatcacatctgcgtttccaaccgcaaaaccaattcgccaacctgccatactgtatgtttttgacagagtataaatttccacggccgtttctttggccccgggaatctgaagtagactcaaaggatgactatcaaaaccaagtgacgcatatgcaaaatcatttaccgcaattaggtggtgctgcttggcaaaagcaactgttttctcaaaaaaggtttgtgttgcaattgcgccggttggattgtttggataattgagaaacagtaattttgctttatcactaatctctgttggaattgacggatagtcgggtaaataatgattttgtgccagtagcggacaatgatagatgtgtccgcccgccagctgaattgctggaatatactccggataatagggatccggaaccaatgcgatatcatttggattcaaaatgacctgtggtaacgcataaatgccaactgctgcaccattaaagatctcaacttcagttgtcggatcaatttcaacgtgatattcccgttcataaaaatcactgattgcctgctgtaaagatgccttcccctcaaacggtgtatatgcatcattgatgggatcatcggctgcctttttcaacgcattcacaatattttgaggggtgggtaaatccggattaccttttgataaatcaatcattggtgtgttggttttgaagttggcaatcttatcgtccagctcagcaaaaaagctggttggaatctcgtttaatctatcagatggtttgaagttcaaatcaatcacctcgcttctaaatgattgccgactatttgtcgatcggtaattggttcatcattatctgcaaatataagtggtgcaatttgaagtagaaaatgttcgtctattgaatcgaatctattcagatgtggactatccaaatcaaggacgccccaaaacgctcgatgataaaaagccgggacaacaatttcagattttgaagcagcatcacaggcaatgtgaccatcaaactttgtcacatccggtacgatttcagatctcttagtttgagcaaccgttccacatacccctttcccaaaaggaatatgcatgcaagcaggtttaccttgaaaggggccaagtacaagttcgtgattaatattccgataaaaggttgtgccatttagatctgtcaatgaatgaaaaatgagagaaaccaagttactcatatttgcgacaatatctttttcaccatctagaagtgtttgagcttgctttaataacaactgataatcctgcttcttagtcattcttttacctccaaaatatgaaagtccttttctgattattcagaaaattccatcaactaaaacaaaaaagcttccgttccctgacaatatgtatgttctacacagtcaagggacgaaagctttcgtgttaccaccctaaattcgtaacccacttacatgaattacctcaacgacacctattgatgccagggatagtaacggatccttccgtgattgatgcgtcaacatcaatcattattcagagctcatcttaacaattatctttcttaccgcctttcaccacttggcagttctctttagaagaacgattaattgctactcttctcttcatcacgtgttgtattaagattgttataaataataacattattttttaattaatcaaatgttttttttgaatatttttaatgatgatcggttttattggtgatttaacggtgaaattaaaatcaatattttcaatccataaatgtttctttttctttttcgttcctagcttgctaaaagctgcatttgtactagcaaaattttaaaattcataaataaaagtattgacatttataattttcgggactattcttttcacaatcttttaatttcattttaataatcctatgagaagaagagtaactgaaaagattaatcaaagagaatccaaattgatgggaatggatattaatctcaaagtgaagatgaacttcaaagaggagctatctggtatgttggctagatagaccggtaggaaccgttaacttccctggtattatcaagtaccgttgagacaccatagtttttggtgtgaatatagggtggtaaagcgattaaagtcgccccttgtttgtcattatttgacagcaaggggcgacttttttgtcggaaccgattatgtgaagttgaagagatgaattagtcttcatagttttctttattagagaatcagttatattttagggaggtattattcatggcagaaaacgcaagtgttgaaggcggactcaaagtcagtctttcaacaaaagatttattagtatacggcattacattcatgattccagttgcaccactcgctttttacggttcattcctaactcctgcaaatgggatggttgccttagcctacttcgtaggaatggttgcaatgctctttacaggattcagttatgcaaccatgtccagtagatatccattttccggatcagtttatacgtacgttcaacaaggaactaatgccggcttaggctttatcggtggctggggaattacacttgattactttttaattccaaccattacttacctaatcagccaatcatttggtgaatcattatttccggcagtcccaagttgggcatggattgttatcttggtactatttaacaccatcgtcaatatcttaggtgctaacgtcgttactaagattagttgggttcttttcgcactccaaggggtcgttttagttgctttcatcattggcaccattcgattactcctttcaggtactattcaaccacaagcaatttcattttataatcctcagcacttcaacatgcagggtgtactccaagcaactggaattgtcattgttagttacttaggctttgatgcaattagtaccctctctgaagaagcagaagatccgcatcgctcagtaggaagagccattattctttcaattttatcaattggtattctgtttgttgttattaccgttttagctggatttgtggctccagactatcaaaacctcaatccaaataccgcctttctcggcattcttcaacgagttggcggcacatggttagttaaattagcagacattacaattattctttcattcggctttgccagtggtcaagaaggtcagaccgctgtctcacggattctgtacgctatgggcagagatggcattctgccttctgcttttgccaaattgcataagaagtatcgaaccccaatctttgccattgttctagttggtttagcttcactaatcctatcactaacactttcgcaagatacagtttctaatttggttagttttggtgccctctttggattcattctgttgaatctttcagttatttggaagttttatgtaaagggagaccacagttcagtttcgtcatttattaagtatttggtatcaccatttattggctttgcggtcagcacctggattttcttaagcctatcaatcgaatcaaagattgtcggtattatttggatcttggtaggattggcaatcttagttgcaaaaactcatttcttctcagaaaaaacaccaagcttagacttctcaaacaaggattaggaggatttttattatgacaactacaacaactgcaaacacaaaattcacatccaaaatttcaaagccacaatctgttggcgaagtcgttgaaaaattaaaatcatttaattgggtagatttaacccattcatttgggccagaaagtcctcgattcccttcattcgcacgcccagaatttaaaaccatttttacacattctgatggtttttacgtcaaacaatatacttttccaggacagtttgggactcatattgatccaccaattcattttgatgaacaccaagataagtatgtcgaaaacttttctctcaaagaattagttctcccactagttgtcattgatcattccgatgcagccaagaagaaccctgatgcttccctatccgtaaacgacattaaagaatgggaaaaggaacatggaaaaattccggaaaattcttttgtcgctttacgaaccgattggtcaaaacgttggcctagtcaagaaaaatttgaaaacctggatgacaagaaacaagctcattatcccggatgggacttggatgctctgaaatttatctatgagcaacgaggtgcgtcagctaatggtcatgaaactttcgacactgatacagcagtaaaacaagaacatggtttagttggtgaatactatgtcctttcccacggtcattatcaagttgaattattagataatcttgatcttgttccagcaactggtgcttacatctttatttccgtgcctaaggctgaaaaagcacccgggttcccagtaagagcatttgcggttgttcctaaataattttgcttcataaaaattatttgtgtaaatgaaattctagttttacaagtaagagctcctgccgacttttaaaagttgacaggagctcttacttgtatatttaaattttcagactttcagacttctaagcattattaatattaattgccagcaaattctgctatcaattttttatactcactattcagaaattggagcattgaatattgttacccgcgactgttaaagttgcaacagtgcaaaatcgaaaagattcttttacagttaatcgcccttacaatatcgattaaatccgcttacattcattatcaagacttcaatcccgattagagcaacgttgattgatacatcccaaagtcaactagcacaacagataaagtgcctacgttcttaagaaaattgaagagattaccaaattaagggtaaagtaaagttcagttcttttattgtaggtttatcatcaatgcagaaaaagaagcgacgatgtataatcatacctgtaggcttttgccataaacaatgaataaagatgatttaagggagaaaaatggaatctaaattatcaacaatcttgtcacaacttattaaagcctcagacgattctaaattgatcatttttgttggagctggtgtctcgcaaaattcgggattaccatcttggtcaaagcttgtaaatgcgatggcaaaagctctgaacattcaatccagccacgaatttactaatgatgaactattaaaaataccagaaatgatgtttcagaaagatcgcaataaatacttcaatatcattagaaaaacaatgcaaaaacaaagttctggaaatacactagatgacatgattgttcggctaagtcctgatcacattattaccaccaactacgatacacttctcgaaagatctgctagtcttaatgctcggatattccaatatgtaactatttttgacgactcatctttcttgcttcgaggcaattctggttctcatttcatattaaaaatgcacggtgacattactcaaaagaatttagaaaaaactatcgtattaaaagaatccgattatttaaactatgaccactctcacattctaatctcaacttttatcaaagcattacttgcaacacatacttttatttttgttgggtattcaatgtcggataataaccttcgtttaataattaactggataaaccacctaagacggcaacttacttataataatactcaaactcatattccaaataatgttttactatattcaagttcaagaagccaaaattattcttacacacagcttcaaaattattataaagcaagcaatattgatctaattgatcttgataccttacctcctgaggtaatgagatacgataacgaaaatagtttaacagacaaaacggcaaagtcagattatgcaattttaaacgcaattgctcattggtttccatattttaacaacaattatttagagatgttagatcagcttccatacacttcttttgaggatttccggcctgttataacacacgacatcgaactgtcatcaaacggaaagtttacagactcatctctaaactattacggatcaactgttattatgagtcagaattcttttaaaagaattaaagatattcagaaaaatacacctttagttgactccatcttatctaagtcctctatcgctaaaatagttgttttaaactcaaatttgtctaaataccatttaatttcagttccaagagaaaagtccaatacagtattttcattaacgaaatcaaatcaattttataaactatttgagcaagcgtcttccagacttactagttcatcaatagagtcgcagtttcaatatgcttatataaattatctcttcttccctaaaaaatctattaagatactctcaaatatctcaatagatgggacaaaaaactacctatattcgttaataaaaaaattaaatcttgcgtttacagatactgaaattaatccaataggcatcatcagcaaaatatttaatgagcaaactcctttacaacaactgcaatcgcatactttaagagaaatttttctcggtgatactgaatctttttacgcaaacaatgtaagcttacgaaaacttatcgatgagcaaaagagattttatacaagagactttttttctgctaatttaattgatgcgttgggtaatagtataaaaaagtatggaagactaatagaaacacaatttttcgtatatgacatgtataactacattcataaaaactacttatttgttgactttttctacacaagttggaatagcattttcaacgcatactgcagtatgatcattactacttatgttagtggtaaaaataagattaatcctaaaataaatacacaacgaaactatccactaaacagcgtggatgtcgacattattgtaaaacttacttccacagactttttaaagggacaattagaaaatcaacatatttatgatctaatttacaacaatgaaaaggaattttgtcaaaatttcgtgaatttgtgtgattcgtataaaagaattgataagagactgcacttgtttaacaagaagcgcatccacccagccagaaataaatttgaaaaatgggtagaaaattacctattacttataagatattcaaaactttcttcttcaagccttacacgatgtttaaaagctgtattttcattaaccgaacaagtcaaagttgacttagttattttagaaaaaatttcaaaaattattgtggattattcatttaaggtgaaggatcaaccaatcactgatctagaagtctttttgattcgttatcttagtaaccccacaaatttcagcagattaaacacacctctaggaaatctttctggcttaagtttctggacagaaagggtactttcatgtaataaactagataaacaactaattcgcaaaaacattgtttcaaatagccatcccgactatatgattttcttcatttcctctttcaaaaaggaagagttccctcgacgaaatgcttataaggttataaattactgtttaaagtggcatccccaactcccaattcaactatttgaaaatggatatcttttacaatcgcgggaatattattttcatcaccttattaaacaagttgataaacaccgagttccaaaaggtcgtatacaaattggaggtcttgaaaatcaattaattgattccttacttttgttcctaacaactaattatagatatcgcagaaaaactcttatttcaattctaaacatttcaccactatttcaatttgtatactctccaaaagattttaattatgatctaatcgatgtcaccaatgaacgttggcaaattttactaattggaaccttaaaggatggaaaaaatcgatttacaaaatatttccgaaaaggcttgacaaaggaacaaattattcctatccaaaaacagttcattgctcgaaacaacaatataaacctcactaggacatttagttttcttgaacagatattatctaggtaagatcacagatatccagtaagcgaccgttgttgataaaatgataggcggtggacttcctcactttttgaagaggcccaccgcttattattaggaaaccgatttgtaacataagcccccaacattagaccgtctataaattgttagcgcgttgcgctatccttacctcatccataaaaaagtggtgatgtatttttatggatgaaaacgaaattgttcaagtcaaattaggtcgacggagttcagggtagaagttgcccgctagcaaggcgtttcaaattcgaatctgtaatcaatagaacggggctgtgacataagtccgcaaagaggttcatcatattccagctcgtttgtgtgtcgaagaagtctaggaacaaacttacaagcgtccaatctgtgaacgtttagacgggaaaagtcatttcaaacaagccagagcgcttcgcggattatttccccatagtgtggtttcattgtcgctgctaaccagtatcctttatcaaaagtacgtcttgggaacgcccatttatcggcaaatgagagattggcatcgcctgggatcaaatgcccaggatacgactttcaataattgggttattcaaggaaccgtgccagttgaatcactttatcggctgattcacgaacacttaaccggtcaatattatttacaaggtgatgagaccccccattcggtcttgcgtgaacccggtaaaaaagcgacttccaaatcatacatgtgggtagctcggagtgttaaaaggagtgatgagccgattgtattttatgcttatagcgacagtcgttcaggcaagtttgcccaaagactatatgccaactttaccaggactcttcagtgcgatggttatgctgggtacaatctccttggaacccaggtggttcgcgtgggatgctggtcacatgtacgccgtaaattttatgatgcggctcaaggtaacagaaacaacggtaatgagtgttccgttgaaactgttggacgaaatgtttgcgttggaacgtcaatggcagaacttttctcctcgcgtgcggtgacgccgtcgttgggccaaattaaataagctggtaaagcgtttttggcactggattgatacgattcaccgttttaccaaaagcgcggttagggaaagccgttcaatatgcctgaaatcagcgagccgctttaaatcggattctaaataccgaggcaatcgactggagcaacaacgccgccgaacgagctatgaagaacatcgtcattggtcgtaaaaactggctattcagtactagtccccaaagggcacgagccaacgcaatttggatgactttgattgaaagtgcgaaagcctgtggcctagatccacaaaaatatctgcaaactttactaactgagttaccacaactgccggtctttgccaaaaaggaagttctggaagcctatttaccatggaattaaaaccaaatatctcaacaacctaaattagttgcttaaataacggtcaattcttgggtgcttccctaacgttcagaatatacgtaaagcattcctaataacactaactcaaaaacacttaccttgaatttagcagtcaaaatcataatttagataagatatctttgaatttagtgaaattaaccgtttccttttcctgcaaatgttgaaaaactaaaaaataccgaaaatcatggataccagctaatgattgccactgcgaaccaagtcttgctctttcaataccattatcacgaagatcgtcgcccttagtctcgattattaagacttttccagttaacgttttggctataaaatccggccaatggttaaagggaccattcatgcagaaaccatattttgatcgagctggattgcggtgccaccaaagaatattcttggattctgacaacatatccatcatctttcgctcaaaaccatttccccgttgctcagctgaatataaagttttctccaaagagtcgatagagttagtcaataacatttcattaggaaaatgataagttggctcaacactaattgaatcgatttcaagcctctcattgaattctttttgctcctctttatttatgagatcaaaaatttttgctttaactttttctgcaaaaaataacggttttttaataatagtctctttttgtgacgcacttaaggaattaacaacccggtttacataactgcagactgacctgtggtcaacaaagttaatgctatctgctctatgtatagctatttcgatcgcctgtcttaaaggtgctttatcatagatgattttttcaattccagagaaattaccagttatacgcccctgcttaaccttattttgggaattaacatcaatttttgccatctccggcaatgtttctgttaaattgatattgagatcagacttactaagatcaaaatttatcgttaggtcggagaaagttaggagtcttgaagaagtatcagaaaaaattgttttttcacctgggattgtaaactgaggcaacacagtattacttgcatcttctatatactgaggttggatagtaatttttggtacccgtttagaaagatcatacggaacaaaaccatcagaagattgattcaacctattgtatgtttcttttttataaaccgtattcatttttttagcttggttaagaagcctgtccgttttagtctccctgttcacctctttatttggattatgaggcagccacgccttgacagtgtctgaatttatttcttctatttgcaactctttagatactgattttgtctgaaaaggggtggaattagtatcatttttgaatggcacaggactgtctatagaaggatactgtgatatattgtcgatagctcgataatcttctgggctaaatcccgcctgattaagccccttcactattccgtctaatgcatttgcaaaatcatcagaggaagttaaaacataagacaaattaagtaattcttctgacgactcgctagcatatggtaaccttaagacgcgcccaagtatttgttcaacatctaccttagaactcttattagcaatagtcgcaagaatataggcaaacgggcaatcccacccctctttgagagcattaactgtgattatataacgaataggacactcagggttcattaaatcagtatcaccaatatcatcaacattagcagtcttaattgcaatctgttcagaaggaatacctactttaataagatcttttttgatcctattaaaagtaactgctccatctttattttgaggctcagcttggaataatacaattggacgtatataacgttttttcttaatcttatttgctaagctttctaatttatttcgtatagcaatagccgttccaatcacttcacttttatcgtttcggttatagacaataacaggtagcttaaccatatgctctttttttaaactataagaatctacaaaagagagcacattacttgattgtcgtggcgtagctgttaactctaaaataaatgtaggattaatgttctttagcatatcaatgctcaacttagatgttgcatgatggctttcatcaacaattacaatcggatcaagtgatcgaattacttgaattaaggaaagctcgtccgcatcatctaacacattttggtttgttaaactggatttaaacgacagtaaattaccgttttcttgataaacaagtctagaatccttattggaagttctaagtgaattaaagcttaacacaaaaattgatagttgatgttcaatcgacgaatttgtaaaattttgaccaccaagtagctcatctttgccgtagatctcaaccctatgcgaaaaatcagcatcaatacgctttctataagggtgagtcggatcagataacgctttaaaagtttgctttaaaattgaatctgagggaactaaccaaacgacagcctttttgtctgtatatggcaaataatctgaaaggagctttaaagcgctagctgcaacaaaagttttgcctcctcctgttggaattttaacacagagttgagggaccttttcgttatcaatttgatcattgtaaggattaattggcccatcgtcagctacctttaaaccctttatttgccagaagtgtgaataagctgtcgaggcattgtaatcggatggccccgaccactcctccaagaaccgtgagatatcgtccaaaacgcccttttgatattctttcaattccataattctagccctcctaaaatcgttcaacgtcacgaggaatttttttaaatgtaatgtgcaaagctgataacctatcttttgatatagttagtcgatcagcataaatgacatacatatcagcatggtattttatatgagtcaaaaaggattcattcaaaacagttatcctggtaggatcatataataaataatatgctgtatcagaaactcggccaagataaccactctcgtcaaagtgtttattaattacactagcactatttctcgtttctgaataccaaatataacttgctacagttgatgttggcacgtcaacgttgaaatttccatactcatctaataatgtatctccaatagtgtagtaagaaaaaccaccaccaactcctgcaacctgttgccccttctgcttaatcccttgtactacgatgctgttatcattcaatttacattgcactttatcaaagcgactttgattattctccataacttcatgtgcgttatcaagaatctgggaacccttacgtaaatttgaaagatttaatcttttagcataaagttgcacaacttttctataatgggtagtatagcctttaataacttttttaactcgttcggccgttacactttcagcataatcttccatttctatcaaaatgaagcggcgttcacctccatcccttttatttaaattcaaaactgcctccgcggtagtaccagatcccgcaaatgaatccaacaccactgcgtttttgttttttattaaatcgattagataggatatcatatctacgttttttggattatcaaaattacctgtatctaaaatacgcttaagttcttttgttccttcggatgtattatatctaataatactaggtacagggcctttatcaattgattcaaagaacaacctaccatcctcttcaaaaacttcattagaaggaacataatgcttaaaacaaacggaatacgaacccttacgattaggtttaagatacaaatcctcaatgtgttgttttgctttatttatatcccaagtccaagcgcccaactgaccacgaacacgtggaggccttattataacagtatatccttgatctttaagattactgtcgtttttataaacaacagcctcatcattagccgttaaagcaagctcttgatcataatccatcacaggaataaattcttgagtatcagggtttaaataaaatgaatagcctaaatttttacgtgctcggagagtcccccccctctcctcgagtagtaataggatcactcaaataaaagtatcggtcctgaatatccttcaaaatatgtcgacgcactttacgatcggaaaataaaacatgaccgtcctgaccagcgtcaatttttttccgatatgcgattatatactcgtgatttttttgaacattatgagtatcattctttgcgttacctttatcttgaataattggtcctaaagcattatcatgaccaaaaatctcgtcgcaaatagctttaagatttgagaactcattatcatcaatagaaataaaaattacgccatttgaagataatagtctagctaatagtttaagacgcgggtacatcatacaaagccacttatcgtggcgagacaaatcctcaccctctttaccaacgacttgacctaaccacttgcggaatttaggatcattaacattatcattgtagacccatttttcgttcccggtattataaggtgggtcaatataaatacagtctaccttcccctcatattgtggcaacaaactttttagtgctattaagttgtcagcatgaatgatcatactcttacttttattattagccccaaaagtatattgaagatccagtatatggtatggtacattaaaatgataattaatcacttttgacttaccattccaattcaaaattggcattttaaagttccctctcgctagttatttaagatactattcattatcttacaatgcttttaacaataattatacaatattaaaggcaaaggctaaagcacgtcatttgaatgccgagaatttcaatcccacaaatgttcacatcaactgcctcaggcaataaatcaagcaggcaaagtaaagtctgatccaaaatgaagacggctatcagttgattaatgactcattggaatattatcataagcttcaactgtaattaattaatcaactcattaactaacgactgctgaattagcctcaattttttctgcagatattatttttgcaagccaacagatcaaaaaaaggctgtgttatgttttctatgaaaatgaaaagcagaaaagttgatctaaattcaactatgtcgtttttttaaaatgttttctacaaatgaaatgcaggagaatatgttgaaatggttaaatatagtttcttttccttgcatcaatttttctgggaagcttgtatcatcggtatttatggaattattcagcagccactaactagggcgtgtctatctattcatgcattttgatagtgctatgtaaaaaagctagctgtaatagattatttacattttctaaccaatcaaaaatgtaaatttcaaggctaattatacagccaaacatgaatccataacaatagcataatcaaaaaattacgtatccaagttagctttcaaatcttgctaaatcctaggaccattcaggctttaccgcttttatttttttaaccacacccttctccttgctttccaccccaatctataatatatttatatcgaacttacaaaaagtaagcaaaggaggagcaacatggtcaacgttaataacttacaattcggaatcgaaactttcggtgacattgttgcggctgaagacggtcaccttttaacagccggtcaatctattctccaaatcgttaaggaaggtgaattagccgacaaattgggcattgatgttattggggtcggtgaacaccaccgtcccgattacagtgtctccagtcctgaagtcgtgctgggtgccattgcttcggtcactaaaaacattaagcttgcgactgccgttacagtattaagctctgacaatcccgttcgagtctatgaacgttttgcaacgcttgaaggtctttcgcaaggacgggctcaagtgatgcttggccgtggctcctttaccgaatcatttccactatttggatacgatctaatcgattatgatgatctgttcaatgaaaaactggatatgttcactcaacttttaaaagaaaagcccatcacttgggacgggaaatatacccaatcgctcaaagatcaagacgtttatccaaagacagattacgatggcttggaaacctatatcggtatcggcggttcacctgaatccattatccgagctgccaaaaacggatatagagttattttagccattattggcggtcaagctgatcgtttcgcgccctatcttgatttatacaagaaagccgctgctcaatacaacaagccggtttacccggttgccgttcattcccatggctttattgccgacgatgaggatgaagccgttgaagttgcctggaagaatatcaaagcaaactttgaccgcattggcttgactcgtggctgggcaccgatgagccgcgaacagttcgacggcgaaaccaagtcgggttcattttacgttggcaatccggaacacgttgcccaacgaattgcccgcaccattaaattactcaatcttggccgttttgatctcgtatacggtgccggcaatcaaactgctgcccagcgtgaacgaatgattgaactttatgcaacaaaagtcatcccacgcgtcaaagaacttttgtcccaggaggtaaccgcctaatgaccgaaattaaaaccgtcggcattctcggtgccggaaaggtcggaattgttttagcacagttggctttggctgccggttataacgtcagaatttccggttcgggttccgtccaaaaaatcgcccttaccattgaaactttggtgcccggtgccatcgcgtcaaccaatcagggggttgtcagtaaaagtgacctgattattctggcaatcccgcttagtcgatataagaacattcacgcaaagttgctgaaaggaaagctggtcatcgatgccatgaattattggtgggaaaccgacggcattcgagaagaagtgttggatccttcatcgacttccagcgaacaggttcaaaaatatttcagtaaaagtaccatcgtcaaaacgtttaatcacatgggttaccacaaccttcaagaagaagctaaaccggcgggtgccgagaatcgaaaagcgctatttgtaaccggagataatccggaagccgtcgatcaaatcgcacgctttgtggatacaatgggctttgacaccgttgtccactatcacctcgccgacggtatcatgaccgaacccggcagtcccctgttcggcgcaagtctgacccgttcagatcttaaaaacgtgattgatcattttgatgaaaccgagtttggcaagaaaattaaaagcaatcaggaagcttaataaagggcatcgtttcaaataaaaacggactagaaattttttacaattcttctagtccgtttttagctgagcatttgctgcatttcaaactaaatttctctttagtctgcaacaacattttagacgattaaaaaagtgttgtgacctcgtgtacctcagcttataattgttaatgcaacaaagaaaagcttgaatgaacggctaagcatttccataagaaacatcgggatagatgccctgaaagcagtcgtcactgtcatccgttaatcttatattgtgctcttaattagtttaaaagccatatagaggaatgcttagttacttttttagttcattcatattattttacataaaattagttagaaagattgtgaggcagttaaatggtactaagtgaggcacaaaaaagagctagtaaaaagtataaagccaagcaccgtgacagagttcgatacctgaacaaacggagcgcggcaaaaatgtttattaccacagacggaacaattgaggatgtcaagacactgcaaaagttaattgagaaacgattaaaggagggataaggcgatgagactatttaaatcaaagcacgtcactgtatacatgcgtaaggcaactgccaagcagaatattatcggagttgcctcgatcattattttaggtttaattatttgggctatagtacgttaaatgacgcaaaatcagtaaacataaagccagcgatttaaattgtccacaaagtcgatacacttaatcgactaatggcggtgttacttttcggagcacacttgaggcggctgattacattttatgtagttggtcgcctttttaatagataaattccaagcttgacttattaaagaattcctgacagctaaaacaccgcccaatgataatccaaccaaatttactaatacacacatttcttcaactatgcccatcttacctaaaataggaatgccagaaagaatccatggttatcttatgtggtccaaaataatgtagcagaatagtaaatccaccagaatgtgtgtaatggaatttatagaaatgatttcctgcatatctccatttggttatatgagcagctttttcaccagaataacgaatatagtgtctataaatgcccaccccttgatgatggttcgctgtggcataccaatacccctgtagcttggttggaattgctgatgaatgccaggagaatgcctgtgcagtattttgattaattgttgacccaatggaaatccctaagcttgttgatgccaacaaaacaattgctgtttttttaatattcatatttttaaaacccccagataatttttgttctttacatagctttatcatctaatatatctcacaagcgaattcggatccctccatatacatggagaatacccaaaatcacctaatgcagttaaaatgtattggttcaagttggtttcataagcctgtatggttaattttttccaattagtcgcattatccttgacgaaactgtcgacccattgacgcactttgacagtttcaactttcaatagatcgttttcatggtaagcaacgttcggattgtcgaaactgcgtttcttttcgtaccgatggtgaactaaatcataaaacgtcagccgatagctaaattgaaacgtgtctaacttttctattgcacttcaaaacgatgggatgttttgtaaaatagtttaatttcattattcttacctcgtacatacgttcttttagaatgtaaacaaaatccctcatggaagggggaaattaatctccttttgaatcgattttaatgaatcgtgattttacattatcgtataatgatttaaattgactgaagtgtgatctaatttgataatgaaataatttgggttttattaaatacatatagacagctatcccgaaaccaacaataatgatgtcgattcctgtgccactcataatatagtttaagaaatccatgccaacgattgctacaaacattagcagaattagccaccaccaactagttacaaaccgtgaaaggccaaataaaaagaatagcagtgtgctaataatgattatggccatgatagagacctccttgatatcattctagtccattgccaaatcttgggttaataaaggatcggattattatataaccatttattatactaatttgatttaataaaaaaagctaatgtacaataaggcaagaagatggcattatgaaattgtcgaaagcatcagtccatacattaaaacattgcattacaatttttgatcaagaaataggaatctccgtgtttgccgagatttattatgtaaattatgaaagagttcacagcgttagcaaaagagcaatcagcaaatgcgttttacctgttaataaaggaaattacggaaaaccacaagggatttagactgttgtatgaagatggacagttatatcaaccggtccaatctcaaagccattaacttcttgatgctgatctgcccactggcataaagtgctttgagcttcttgatggttatcaaaatgttgggtgctaaaggaaaagtgatcatcgtgattggtaagagctttcttcaatagcgaatcaaaatatttgtaatccttgtcttgaagcattttttcaaatctttcttcctcattcatatttatcacattctttcaattcccgctgagttcttttttaaaaaaagaaacccaatcagggcctaattataatttgaaaattactttaataagaaaaccaataagtggaatgacaatgcttgcacttataactcccattatccaccaggttatttttgataagcttccaatacttgttgccaatgcgtttatctttcccgataggtcagaattaccattgtcaatttttccgattaagtttgcttgaattgtatctatttttccagataacccgataatttgcttcgctgtttcggtttgagcaagtttgatatctttttgtaaagattccacagcattgtccagttccctatgagttacgtgatcatccatatttccgccacctccatcatcaccaccattataatccaagcccctgtttttaggtaatgatggagtatttaaataatcatcttcaaaatttttagagggcattgggataactcttgctttttcgttattattcatcatttttatctccatcatttccaaaatatttaaattttccaggaacattagcaactaacaggctttcagcttcaactgttcgttttgtatctataaagattgcaatttgaaagtaatagtttccataagataaagatttaaaattaagagatggttctcgaaatggattaagccttacagtaaaaagtgccggtttttttaaagaaggataagctgacagagctgcggattttacgtccagcgattggatgtgagttggaatttctttgatatcttcaacaaaatttttaggattatcggagataactaagcttaattgaattagtaatcttggaattatttcacgcccgttcaacatttcacctttgtagtaagaagttagaaggccattgagttcaatgtatggtttttcttttgtgatttctaagggaacgtaatcggacaaagattctccgttaattgaaaaaccactaataaagaaacttttggggagcataatttgtacctcctttatgatttataaaataaaaatccctattggggcaattgcaacgttaatcattgtcttgataccatttatctttattcaaagagtaatggtagtaaatttcgttgccagtattgggattggtgtaatcccaaatattattcgttagcacttgatcactacttttcagtgccacatcttttgtatcagttggtttaacagatgaaattacgaaagtatcaccacttaaactttgagtataggtattatagggaacaagatcgttccctgtatcagcatatgcataatatgtttggccgttgtattgaactaacgccatcttttgaattccgtcatgtttaaaaccactaagtattaatggaactccaccggtttccaatttaacagcaaaaatattgttgtcataattatccattgttgttgttaatcctacgggatcggaactatccacccaatctcctgtgtaaaccatatgacctacgcaagacttaagcgattcaggtgcgctatggtaatccaatccatagacttgagtcttttttgatttaacttttttggtatggtgaactgatttataccaaacttgagaatagcccatctccaaattgttgattaattcctttttaccattcttatattttaaatgccagcgtctactactttgataaccatattttgctaaaacattaaatgtatagtgagatgaatcaactttagcgaaggcaagtttacgccaaccatgccaattgcttctataaaacgttttaccattaagggaaactgaatacgtatttactttcatcatatcgccatcgctcgtgtggtatgtgcctcgccagcttcgaggcgtgtaagaatgatagtgcctaactggaaaataatttgatgcatatacttgcccgatattaaaactaacaaaacctagaaaagctactccagttaataataatttactaactcgcattattaggatctccccagattgatttcagcttttattgtcgtcagttcgctggacaaaatatcgttttgctttttcattaatggcttttagaagttcattattttgtttctaaagtgtaacgctttgcttaattaataatccaatttgttcgattaaagcatcaaaatctgttaccaaagtattttgaaactcatccccgttaaaaaacgccgaggattaaaaaaaaactgatcatcaggcattttttaatccatgatattttttacaagctgataagattcagattttaaatcatctaagccgtgtttgcttaagaagcgcttaactttttaatctcttttttgttctttctcttctttagttttaaaaaccgcctaaagattcccatagtaaaatcccctcaaaatattaatcaatgtcgtcaccgggcgatccatactaatggattagctcattgtaacaatttagcaagtgcccattatcgtctacatataaaactctccgaggagcgcttcgcttttcctcgtaaccatcaatgaaaagaaccgtcttcctttgtataatataggtgaaggcggtttcattgtacatcgttatctttttggtgctaataag

SEQ ID NO: 436 - DNA, 489148 bp, Unknown
  Metagenome-assembled genome
cttttagttggctagagaattgtcggcgactttggaaaaattgtgagcgtcaattaaccaccagtctgcaaatggtcgttttagcgtttttagcactattacttaagagattttagacagcttctaaaatctcatcacgaatatgaccggcccccttcggggtgtttgttacttcaccttggaaacacacttgcttatttgaatccattccacaataatcaagcttcaattttgaaacatcaataccaacattcaagttcattgattcagacctcctttccgttcttattttggataggcttgggtgctgtgtgatactccctaattatgaatcttcagaacatcctcgcaatttatgagtagacaagtcatccaatgactagctgctgatagaacgcgagctatcaaaatcatcagctaacactacagcttgtggtttgaacttaaacaattcatctgggcggcattcttaaaatgtagataaactacaggaggcgaaagcctataccagttggatccgaatccaatgaacaattagagaatatcacacagcatccaaacagcgaagctggtcaatacttgaatacatttttaataatacgaggagtggtaaaaatgagaactcggcggataatgctgactagtgcgatcatcatctgcgtcctgttaatatttgtctcaatcaatgttgcactcatcggcttgaccctggtattgtcgtggacaagctatcagctgctgatcaaaaaagactatacgctgctgcagactagcatatttcaaaacgtctcacttaggatgcctgattttgacaaattaagtcaggaacaaatttcaacctatcagcggacagcttatcgggttggctggtggatcctggcaagtacgattgcctgtgttattgtgctgatttgtttgaatctttgaattcgaaaaaatgatattaaaaaagttccgaagcaattttgcttcggaacttttttcgtgtatctattgaggattaatcttcgtcgtcttcctcatccaagccttctcgtggtgtcttaccaagcaaggcctgcagagtagcgatgttgtggttgttatcttgcagcaggccaaccaaatgttgtgccaagactggacggtcttctttttcagccagcttaattgcccgggtgacaaacatgttctcagtgtcatagtcgtggacgaagtcgttgaccagccactctacagattcatatttgttctggccgttttcttccagcatggtgtactctgtgaattccttttgggtacttggcgtaattaaggcctcatcgattaagaccgtgcccaaggcatccttttggtcgtacgcctgcttaagtaagtcgccgaataggactttcagctgttgggccgacattcccttcacataccattttgccatctggagtttgttggataaaacttccaaattggcaacgatgtggccggtcatcgcaccagccgttggggtatggtggtcgatatctgcttgcttaacttccgcttcaaataatttttcgggggttgctgttgtcatattcttcacctatttcactttcattgattgaacttcatagcctaaatcagttaccgtgtctgacaatttgtctgcggaaattttatcgccgtcaaaatcagttttgactttggctgcattgaacaagactttgacgttttccacaccatcctgcttttcaagtgcgcccttgatcttttgcatgcatgacgggcatgacagcgcgtctaattgtaaaattgctttactcatattgataacctccatctcatttactgttttaatgataaatcctattcgccaaccgataattgatctggatcaagtttggcagcttttggctgataattaattaatcgcattgcgttgaagatgacaaccaggatactggcttcatggacaaacattccgctggccatgtaaataaagccgagaatcaagccaatcagcagagcgacaaccgtcgcaatggcgatgaaaatgttctccttggtgttgatgaccgtttttttggaaagtccatatgcatggatcaattcattgaatcctgatgacatcaagacgacatcagaggtttcaaccgccacgtcggttccacttcccatggcaatcccgatgtcagccgtcactaatgacggactgtcgttgatgccgtcgccgacaaaggcaaccttgtggccttcctgctggaattgtttaacgtattcgactttttgttccggcaaaagttctgcgtggacttcgtcaatgccgatttgttctgcaacggcattggctgtctgcaggttatcaccggtcagcataaccgtcttcttgatgccgagtgacttgagtgtcgccaggctttgcttaacgccttgacgaatcacatccgagataccaagaatggcttgaatttgcccgtcgaaggcaacgataactgttgaactgccttcgccttggatgttttccaagtcttgacgttgttcagacgtcaaatcaacattttcatcgttcatcattctcaaattaccaattaaaacatttttaccgttggcagttgccttaacgccacggcctttgactgtgtcagcatcggcaacttgaacgtcctcaaacggaatatgatgatcacctgagaatttaacaactgcttgtgccaatggatgatccgactgcttttcaacggctgtggcaatttgcaaggccaactggtctcttgagtaatctttgaactgagtaaccgccgttttcccttcagtcagggtcccggtcttatcgaataccaacgtgtcgacattggcaaaggtgttcatcacttcaccgcccttgatcaagacaccgtttttcgcaccattaccgattccagccacgtttgaaaccggggcgccgatgaccaaggccccagggcaacccagaaccaagacggtaatcgctaatcggaaatctttggtaaccaagcccacaatcaatgcaatgatcaaaactgccggagtgtaataagtcgcaaatttgtcaataaacttttctgctggcgacttggtgtcttgagcatcctcaaccagttcaacaattttgccaaacgtggtgtcgtcgccaaccttggttgcccgaactttaagtgttccgttgtctaagatggtgccagagaatacctgattgccagtgcccttagtgactagttttgattcaccagtaatactggcttcgttgatgtgaccggatccatccacaatttccccgtcaaccggaatctgaccgccggctttgaccaagacgacgtcgtcaacgtcgacaaagtcaacatccgtctcctcagtgttgccatcatcatctacaatcattgcggtagtcggtgccatttccgtcaaatctttaattgagtggcgggttttggccaacgttttgtcttccaaaaacgtcccaaataagaacaagaaagtgacgattgctgattcattgtactcgccaatgatgaaagcgccaatcacagcaatgctgacaagtaattcgatgctgatcgttttaaaccggagtgctgaaaccgcccgaagaacgatcggcacagctgagataattgaagcggcgataaatgaaaccgtgtagatcatatcgctgtcaacaactttccccaagagacctacgccaattaatattgccgttatcaatgtaatttgatttgtgtgttgattaatatatctttgaaatttcataatccccgctccatttcttaattgatgtctttagtatatggtggttcgaccgataaagaattgacgtggatcaagtttgaaatttttgtttgggtaattaatggcgaatattttggatgtaagctgattcctgagacaacttttaagagagggtataatgaataaatcgtctctcaaaaggaaggaatttttacatgccatgcatttatgccaggttcaaaatgtcttagttgatggtggttattcaggcgttaattttcagctcgatgtagccagtaatttaaacgcaaccgtgcaggttgcgaagcgcaatgagttgcatcgattcgaagtcatgccccaacgttggtagtcgaacgctcgttggctagagaattgtcggcgactttggaaaaattgtgagcgtcaattaaccaccagtctgcaaatggtcgttttagcgtttttagcactattacttaagagattttagacagcttctaagggatcggcctataaattaacatcctgcttaaaattaattggtgaaaggtcagttgaagcggtgaccaattcgctaatgagtttattgtaggcatttaaactgatttcagaatttttaaagttcacctttgttaaataattgtccagctccggaccattgagttgagcagcgagcgcaacagcatccgtctgtttgacagcttgttgcagcttaacccgcaatgccgcttttgtatcatttaatttaggactcagctgaacatagtggggatctaccaatacaccagctaatttgtacgtccagtaagcctcatccggtgcgtaggaaccgtgtgcattgtgataggcagtcggtgtatcgctagcgcctgcatagaagggcacaaatgtgctttgtgcagctacccccattgccagccactgaatgcctgctaatccaaccggcatagaagggcgtatttgcaggatatgggcctcttgagtctttgccaagctaattggccgaaaacgatgtttgtcgtcctcagagccctctccaattggatcgtagggggttccctggtaatgactgcttaagaaatcctgaacatcgaatacacttaattttcggtttgcctgattgataaacggcatttcctgactggtaggctcaacgtccaacttgggggaaaatagctttaagccataccagacacgcggcgtattataatacgtatcagataaatccgctgttccaaaaatttttctgaaattaaatgtttttcccgttgaatcgggattgagatggttggcttcaacaaattgccgtaggtcggtcgaccacatgaaatggtccggatcgtcgaaatcaatttcttgaatggcgctttgattggcgataacggcataactgtcatccgggattcgttgggcaacccagcgatgaccgccaccggtttccatataccaagcttcatcctggtccgcaaataaaatgccgtttgattcggacgtgccataatgttcaacaatctgacccaagcgtgctactccctcacgtgctgttttaacgtaaggtaagacaacagttaccattgcctcctcaccaataccgtctttttccaaagggtcggcacccagggcaagatcatttgtataggtgctttcggtcgcactcatcgcaacgccatattcgttaaaaccgttttcttcgaacagaccgaatttatcagtccattcgggagtggcagaatatttggcacgcatttttggcagcggcattttaaatccgttatcatttgaagaaaaattctgggggttggaaaaatcttttcgagcatgaatcacataattctttggccaagacgatttactgtcctcgtttcgggcaatcatgatggacccgtcgatgctggcgtttttgccaacgatcatactggtacatgctgaataatattttgttggaatcatgatgaatatctccaatcgttaaggattttgacttcattaattgtaccatcttttttcacgaaaaatgttataacgaatccaaactgtccgctcaaaatttaattgcaggtcatcataaattacggtatacttttttcaattaaaaaatttggaggaacctcatcatgccaatcgtaaatattcaacttattgccggccgttcacaagatcaattgaaagcattagtcgcagacgttactgcagctgttgttaaggataccggtgcaccggcagaacatgtccatgtgattttggatgaaatgcaaaagaatcgttacagtgtaggcggcgttttaaaaagcgacgaaaaataaagatgactaatcgaaaatatgctattgatcatgtctaaacggtcaagcataaaagtggcctgggtaaacgttaagtctcccaggctcttattttttgaacagtgcatccaacacgagcaattaattatcctcaaaggattgtatttaacggtcacggatttctcattggtttgtttggggttatattgtatactaattaggtagaattcgaataaatgcattaataacaagaatggagacgtttacatggacgatcaacaatacataatggcgattgacgaaggtaccaccagcacacgggcgatccttttcaatagtaacggtgagattgttggtaaggctcaaagagaatttcatcaatattttcctaaatccggttgggtcgaacatgatgccaacgagatttggaatgcggttcagtccgttatttccgaagcactgatcaacgctgaggttcctccttataaagtccgcggtatcggtgtaaccaaccaacgggaaacaacggttatttgggataaaaacacgggcgaaccgatttatcacgcgattgtttggcagtcaaaacagaccgcagacttggccaatcaattaaaaacagatggttatgatgatttgattcacgaaaaaaccggtttaattatcgactcatacttttcggctacaaagattcaatggcttttggatcatgtagaaggcgcccgtcaaagagcggagaatggtgagttgttattcgggacaatcgatacttggatactctggaaattgacaggtggcaaagtccacgcgaccgattatacaaacgccagtcgaacaatgttgtttaatatccatactttagagtgggataaagatattttgaagttattgaacatccctgaaagtattctgccggaagtccattcttcatcggaaatttacggttatacggccggctatactttttccggtgtccaagtgccaattgccggaattgccggagaccaacaggctgctttgtttggacaaatggcctatcaacggggaatgattaaaaacacctatggtaccggtgcttttatcgtgatgaataccggcgatcagccgacgttgtccaaaagggggcttttaaccaccattgcgtatggcattaatggtaaagtcacctatgctttggagggaagtatctttgtagccggttcggccattcagtggctgagggacggtatgaaaatggttgccaattcacctgaatctgaacaaatggcaattgatgccaaaagcagcgatggtgtttatgtggtacctgcattcactggtttaggagcaccatattgggatcaggaggcccgtggtgccgtctttgggcttacaaggggcacgacaaaggagcaattcgtccgtgccacattagagtctttggcatatcaaagccgggatgttattgatacgatgatttcagaaaccggtcttgatttaaagacacttgccgtggatggtggtgccgccaataataattatttaatgcagtttcaggcagatattcttggtacgccgattcgaagggcggctatttcggaaacgacggctttgggcgctgcatatttagccggattagcagttggcttttggaattccttggatgacatcaagaaaacggctaaggcacgggatgcctttgatcctaaaatgaatgtagacgttcgtgatgacctttacacgggttggcagcgtgctgttcacgcgaccattcaatttcaccctacagaaaataactaaagtcaaaatatttttcaggtctatacaaaaagcgaaagcaacgtggatatacgccgttactttcgcttttttattatctgtcaaaaaaattatcccacggccaaatttaagtagtcttccaagtaacgggcaacaccgtcttgatcattggtgtattgggttacctcatccgcgcttttcttgatggaatcgatcgcatttttcatggcaactcctgtgcctgcgtatttcatcatagtcgcgtcatttgcttcgtctccaaacgcaataatatctttttgtagaatgccatagtaatcggccaaaaactttaaaccggtcgatttatggatgcctttggtcgcaatttcgacaattgggtgtgggccaccccagggagaaacttcaacttgatcaccaaaatgatgtaagacatagtccattaatgcttgcttttgtccgggctgctcaacttgaaccgtaatactaattggattatctttaaggcttttctgatttaggatttggttggattgtaatgtgcttgggaaaaatccgaagccactactaatgccacgatttgccaaaaacaggtcccgaccttcaactgcgatcagatttaatccaagctttcggctattggatagaagctccatcacaatttctttatcaattgtgtactggtattcgcgctcccaatttttatgtggtaaaatgcctaagttaccattgaaattgatcattggtgtatttaaatgaaggtcgtcatagaaactttcagaaagtcggttgggacggccggttacaatactgaccacacaaccttctttgactgcctggttaattaccgactgtgtcctggaacttagttgtgcatcgtcattcaacgttgtgccgtccaggtccaacgcgatcatttttttagaaataattatcactccttaaccagcatattcattaatactatcgaaaaataggacgctcgtcaatttattcgaacgtgcgattgacttgaaaattaaatacctttaagatattttagaagttacgtacaaaaataacttaccgacttccaactataataatttgacattttatgattagaaaggatccatcatgcagttaccagatgattttaaaaataaatatacaaaattacttggtcaacaagaagcattgcagtttcttgccagcttttcaaaaacagctaatcatggttttcgacttaatccgttaaaacaaaatcagccggttaatatcgacctgagtcatcctacagcccactgccaattggggtattacggtgacgttagcggtaaaaccgttgcccaccaaagcggggcggtctatagccaagaacccagtgctatgtatgtaggcgaggttgccgctcccaaggcgggtgaaagggtattggatctctgtgctgcaccgggcggtaaaacaactcacgttggcagttacatggcaaattcgggactgctgatcgcaaatgaaattgatcataaacgctctaaagttttgatggaaaatgtggagcggtttgggctaaccaatacgattgtaactaacagtacccctgaaataattgctaaacaactgccaaacttttttgatcgaatactggtagatgcgccttgttccggggaaggcatgtttcgaaaagatcctgacgcggtctcttattggagccttggttacccagaagaatgtgcaaccagacaacgccaaattttaagtgaaaccgttaaaaacttgaaacacggtggggaattgatctattcaacctgcacatttgcacccgaagaggatgaacagattattgcttggcttgtcaaacaatatcattttgatatcttaccggttaaaaaattccctggaatggacaacggtcgacctgattgggcagatggcaatccggatttggtgaattgtgttcgcatttttccaaaccattttaatggtgaaggccactttattgccaaattgaagaaaccggaagaaagttcgagcccaataccacatccatctaagcaaaagaagcgtcgccaacgcgataccaaaaataccacaacgttatccgcagatcaaagaacgttatgggaaaatttcgcagccgaaatgcttaagacgcttccaattggaaatctaagaacttttaaagaaacgttgtattcggtaccattagaaacccctgatcttggaaaaataaagattgttagagatggcttgcaattgggtttcttcaagaaaaatcggtttgaaccaagttatgctcttgccttagcacttcgaccggatacggcaaaacgggtcattgacatttcaactgatgattggaaaaagtatgtccacggagacacctttacagttaataaggagttgaaaaagggctggtatctgttagcctgtgaaggccagtcaatcggcttttcaaagatcgtgaatggaacggccaagaatttctttccaaagggactgcggtttcagccaactagttccattaatgatgctaaataacgattaattattccaaactcaaaaacggcattcaacctttaaattcaaaaggatgaatgctgtttttatttagccttttgttcatttgttagaacgatttgttttctcaataaaaaccaattttttagccgttgatcgttttaaatcaaaaacataatttggagaatcaaagcgcttgatgtcttcaaccatcgtaagttggttttccgcaataaagcgaaccatctcgccacgagccatttttgccaacgtagccctggtttttaattgcccattaaccaaatgaccaaacacaacatctataaatatatcatttggctttaaaaaggggataattgcctttgaatattccctggaagccaaattaatgatgggctctttattaatgtttaaggattgatataaacgatctccccaaaatgaataaagatttttcatgcccaccagaggaatatgtgcctgcatttccagtcgatagggaacaactccgtcaaatggtttaagaattccgtaaagcccagatagaattcgaagattttcctgaatataattaagggcaggggctgttaaaatatccggtgccatatattgatattggatgccagtaaaactaagaacggcaggggtcagtcgactggttagttccatcttttgtagttgatcataattagttttggtcagcttgtcactggtatgccagagggcttgagcatctgcgtaagttaactcttgcatggcttttagaagcttttgagaggctcttaaatatattggaaggtccttcacctcaaaatcatttaaattagtgaccatttttttagctggggagatgatgagtttcatgagattaattgatcgtttcctttcattgtcgtagtcacttcatcgagtaaaaataaggattaaatctattgtaaccgaaagtatagaactcgtcagatggacaaataagtcgtttgagttttaaggaggcaaaataaacaaacaccaaccctttggcgagtggtgtttgtttattttaaaaaaatgatcaataagttaaatgcctttgttccaagtatgacgctagggacggcggtaaaatcaatttcttcttttgcagttcagtaatattctttgagttggtcagcatcataatggtctttaacccatattgccactgttcaataaccctaatgacttcatcaatattttcgtggataaccagatgtagaaacgtcccggcaacaccaactgcgtgacttccaagtgccaggcatttagcaatatccaaaggggatttgacgccaccagaagccagaacagtcaagcggtcctggaagggtcgactttccattaaagattccggcgttgttaatccccaatctttaaggtaagccatctctttatcacgccgccgaaagttttcaatttcagcaaaattagttccaccctggccactaacatttacatagccaacacccaggtcaatcagttgctgaatagtctcacggctcattccaaagccgacttctttaacaataaccggtactgaaagcccctcaacaatttgcttaatgttggttaaaaagttaaattggcggtcaccttccggcataatgagttcctgagcagggttaacgtgaagttccaaagcatctgcatcaatcatagctactgcatgtctggcgtcattgaccgttttattagcacctatattggcaaataaaaggccgtccggattaacctcacgggcaaccgtaaacgtctcaaccaaagaagtgtcactgagagctacactttgagagccaacagccatggcaagtcctgttttcttcgcaattgttgccaatttttgattaatatcccttgtatgcggactgccacccgaaattgcttcaatgtagaagggaatttgaaggtttaacggcccaatcttagttgaaaggtcaatttcagagagtgcatattttggcagactttgatgaacaaatctaagcggggcaaaaacatcggtatcctgataaaacttttcagctaacgaaatatgttcgtcttttcgatgtgaatgttttgatatcattttgtctccttagcaagatcaataactgggtgaactcttaaagacaatctggtaatgccattttcttcccaacgtttaataagtgatttaatattttgatttttatcgataacgacaatgccacaatcaccgccaccggctcccgaagatttggctgccgctgaatgagcaaccgcaatatcacacatttttttgagggtcggcgtttcaatttgaacctttgagaactccgccaaacgtttaaggatctcacgatttttttgaatgccggcttgaatggtcgataaacttccgtttttaaaaccatcgatcaaatcatttaaacacttcttgctgtcaattaagaattgattgtaagtttcatgctgacggctttttgaaatggccactttgtcaactaaatgcgaagttgaggcaggagatcctgtccaaccaataatcaatcgaagattttccggtggcgttaattgtgtgattgtcaaatcaggccatggctggtcaactaattctgtcaggctttgttgacgatgagcagccattaaccaattacggtcaaatgattggtaggcgatccagcctccatagacactcgcagccacatcgcccaaagacccgtttccctgaacatccaagtgagcgattgccgatagtttaaagagtttactcttggtcagaggaatctgataaaactcacaaagtgctttcacagttgcaaccgtcacagctgctgatgatcccaaaccatattttttgccattcggactatccaaatcgctattaacgcgaagatcataaacttccatccgtcggccaagtgtctgggcatattcttctgttaaccgaatagcagaaataatgtaattaaatgtattgtcccggttatcgagaatcatctgatccccctgacgccgccagaaaaccgaatcttcacggtattgtttggagacaatgctcccaaaggacttgctccgagaaatttcaactgtcacaaattgatccaaggcgacaataattgacgggtagccggtttcaaccacggcatattcacccgcaatgtataattttcctggagccttagcggttatcaagtgatcatttcctttcaaaattataaatattgaactcctggtccaggctttgcaataatcacgttttgatcacctaagacctgtgcaaatgttgcggagatttttgcaaccgttgactgctgacaaagaactttaacgtttggaccggcatcaattgtgtaataacactcggttccttggtgacgaagctgcttgaccaaattcataattgccaatgtttgaccattgaaatatgtaaaactgggatcagcgcttaaagtaagtgcatgcattcgcatcgcgttgagttcactaatcttaccaaaacgggtaaaatcacctttttcaatagccgattttaactgaagaagatcggcctgacaggtttttacccaagccggatagtagggtgaagttgtcacagacaggtgcatcccttgtcgactcgaaacagctttttggccacgttcgacagtcagtgcgacaactcgaatatcatttaagccggagtctggtaatggcttcgcgtatgaatcggcatcatttgttcctcgttgccattcaacaaaatgaccaaacacagaccggcatgcagatccggaaccacgtctggcaagtttggaaagttcggttgcatccagatgaagtccggctgcctcactggctgatgctgcgagtgcggcaaaagcagaagccgatgatgccaaacccgcagcggtggggacgtggttcgtagaagaaattgatgcagggatggcaatttgtgcctttcctctcacaatttccaagaaatcatgaacccgctgacgacttttttcagaaggtatctgaccatcgattatgatctgatcggttgataacgattcatcaaaccaaacggtggtgtccgtataaaaatgatccaaggtcaacgataaactactggtgtaagggatgattaacgattcatccttcttcccccaatatttaatgagtgcgatattagtatgggcccgtgcagtgacgggattatttgacaaggttgccattgttatctccaattgaaaattcataatttgtgaaagattgaatccatgtttgagtggcaccggccttaagtaactcagtcgccactctttgagcgtctacctgattttcaacaattgaaatcatacagccaccaagtccgctaccggttagtttggcaccaagtgcaccattttgaattgcaatgcggcaaaaatcatccaatttccgagtactgacacccagttttgacagattgtattgggactgggtcatcaagcggcccaagcgctgctcatctgatatctgcaatgcctggcgggcgtccttggcaatttggcccaactgatcaattaagggttttgcaaattccggttgatcaagtaaattatcgtgaaccatcgacactgcttcgccggttttccccttaataccactgtcagcaatcactaaagaagacttggataaattaaagtcgatttgttcgttaatttcatttcgaatgaaccacaccggtgtatcggaactggccgttgcagtatccaaaccgctcggattaccatgagtaatcttttcttcaacatcggccaatccaagaagccggtcacgggtcagaggggtttcaaaaagtttaaagaatacccgaacaatcgcaacagccgttgctgctgaagagcccatccctctttcagatggaattttactatcgatctcaagatggaaattcaagtcggttgcattaaaaatcgttaacaattcgtgaataagcacactgacaccctttaagttatcagccattttacttatgggtccatcaaagtaacggcagttaatggtctgaccggtaacgtcggttttaatactggtgtggacatctacgttatatagcggcagggcaatagcaggctttccataaaccacactatgttcaccgaaccaaattatttttgcatagcttttcgctttcgcattttctttcaatctttatccgctcactttcaaacagtccaattttatcataatttaagcgcagaaagaatcgtaaccatttttttaaaatattcataaaaaatagaaattaagtaatcataaataatcgggggtaacgattccttaattaacactaaattaagttaacaccaattgattattttgaattgtttcttagtatataaaaatatcaatctcgttcacacttattttcagtagcctaacacatcttgactgtagtaacatagtagatagtgtattgtttaagaatcattattaaaaattaaacgattttggtgaaacaattatgaactcaaaaacgacttatgcggttgttgatatagagacaaccggaacagatatgagtgttgacaatcgaattattcagttcagctgcacgttggtggctcacggtaaaattgttgaaacatatgtgagtgatattaatcctcaacgtgaggtacccgaacgaattattcaattgaccggcattacgcctgaacgattaaagaaagcacctacttttgaccaggtatcttctaaattatataaacttttaagtggaacagtctttgttgctcacaacgttaatttcgattttccatttctcaacggtgaatttcaacgcgtggggtatcctgaattggacattgaggctattgataccgttactttaagtcaaattctgttaccaacactctcaagctatcggcttcaggaccttagcgcctattttaatattatccacaatcatccacacactgctgacagtgacgcactggcaaccgccaagctcctgttaatactacttcgacaggttaagatgctgcctcgaagaacgcttgaacaaatcattcagatcaatccttcattaccacttgatacgatgaaagtttttatacaggttaacgatgaaaatcggtcagaatcattagcagaaaaattgccggatcagcttaaattatcggccggattggttttgcgaaaacgggagccgattttaaatgaacctcagagcaaaacggcggaagccaaattcccaaagacccgaactgctaaatccaaaattttaccgcctcatttggaatcccgaattgaacagaacaagatgatgaacatgatttacaacaactatgccagcgatggtcatcatcctgccaaaccactcgttatcgaagcaccaaccggcattggaaaaagtttgggttatagtttgccgttcagttatttggcaagcgcgcaaaagcccgttgtcattagtacagcaacgacttatctgcagtttcagcttcaaaatcagacattgccattattgaatcagagtttgcccttcaaaattaacagtgtcattttgaagggggccagtcactacattgatctcaacaagttccgtcatttattatttgttgccgatagttccgttcaaaccgccttcattaaagcgcaaatattagtttggctgacaatgacgactactggagatcttgacgaactgcacttgaacgtggaacaaacgccattcgtttggacaattcaacattccggagtgaagtggctcgatgcgaattcacctttttacgacgaagactttttacgatataacttaaaaaaagctcagaatgccgattttattatcgtaaatcacagctatttgcttaaaaactggcagttctttagtgacttcccggttaaaccatacttattaattgatgaaacccagcaatttgctgaaacagcgatccgaaataatcaaaaacaaattaatcctttggccgttatgtcagcggttaatcgggtccgaggtgatattcaggaaggccatcatggaagtgcgagggatgccttctccggtaacagtgttttaaacaactctgctgacgatcttgatgaaaccctaaatcaaatcaaaagcctgctcaagcagctgacccatcgtctatatagccagatgattgctaatcaacagctccacaaaaatgccagcttctttgtgcggctcattccaatcagcgaccttaaggccatcattaacgaaaatcgggaaaccattacccggcttcaggataaacaatccgaagtggaagacctgttaattcggttaaactctgagatcgatcattctactgatgcattcactaatcgcgattactccagtatatatgacctttatgaagactttaacgagtttgccgaaaagctgacatttttgctctccatcattgatatggatgaatcagcgattaatcaaaatgttgtttgggtaactgtcaatcatgtaaaagacattaacagttttacaattaatcaaggcattttaaaaaccgaagattacttgaatcaccgcatctatgcatcatttgagcctccaactttcacaggcgccacgattttttcatcaagacgatcccaatttattttcaacttactgggaatcgatcgaaaggctgcctctgttaggaggcttcaaagtgactttgatcctaagaatcaagctcgaatctatctaattgataagcagtcaaaggaacactttataaccaactccgatgactatctgcaacaggttgcccagtcaatcaaaaaaatttatcaagcctcgccccggcaaaccctagtactatttaattcattaaaagcaattgaaaaaacacatcaatttctttctaaagacggttttacggccactcatctggtattggctcagggcgttaacggtaccgctgcccgcctaagcaagcagtttattcatagcgagccggctattttattgggagccaacacattctgggagggtgtcgattttcccgctcatttattggaaaatttgattattgctcagcttccattcgatacgccggaagatccgtataatcatgcgctttactcagttgaacgtagtaagggcaagaatccgttctatagtttggctttgcctaaagcaacactaaggctacgccagggaatgggacgactattacgaacaaaggctgactatggcactatttttgtattggaccccagattaacaaccaaacgctatggacaaacaattttgaccaacttaaaaaatgaaattcctgtgatgaccggacaacttgacgattgtattaatgacatggttaagttttttgaaagcaggaattaaggttatcccgataagttgattatttgatataataaaaaatgtatgtggaaactagttgaaatctgttatcagtattcttttcagccacatgttttatgaggtaccgtcaatcaaattatttggaaggaaaatgtcatgcaacgagaacggcgaattaagcgtgatcccaaagttaaactcagatggataattatcttgctgatttttattctgggttttacaacatttatcattatccatcaggccgaaaagccgatggcaactgcacgaagtcagacgatttcgattgcaaaaaaatacgctgatttaaaatcagcaaataccttttactcggctaaccttggtaaaacttactattcgattgccggtaagactaataaaaacaagccggtgtatgtcatcgttgctaaaaagggtggtaatgtaacggttgttaatcaacgtgcaggattaagcgaaacccagattagaaatcggattcaacaattaaaacggccaaagaagattaacaatgtcggcttaacgctgattaacaacaagccttactgggttatcagttacattaactccagtaacaatttgtgctttgcgactttgaattttaaatcagggtcagttaaaaagttgattgaaaatatttagacgtagattatgaaagggaaaaaacaatgaaattttcaaatcgggcaatgcaagttaagccttcggcaacggttggcgtgtcaaatagagccaaagcaatgatcagaaatgggattgacgttattaacttaggcattggggaaccagattttactactccaaaagttattgcggctgctgcaattgatgccattcagcatggtaagaccagcttttatacgcctgcaagcggattgcccgaactaaaaagggcaattgccgaccgaattcaagcagattatcatgttaattacgcgcctgaacaaattagtgtagctaatggtgccaagatggctctttacgtcatcatgcaggcattggttgacaacggggatgaagtcttaatgcccaaacccagttgggttagttacggtcagcaagtctcactggcaggtgggacaccaatccttgttgacacaaatgccgaatttaagatcacaacggatagcttgaatagggttgttaatgatcatacacggcttctggtgattaattcaccccagaatccaaccggaactgtctattcaaaagcagagttacaaacaattggccagtgggcggttgatcatcatattcttttaattgccgatgacatttacggaaaactggtctataacgaaaccaaattttattcactgattcaatgtggtaaacaaattgcggaatccactattctagtaaacggtgtttccaaggcttactcaatgaccggctggcgaattggatacgtggctgctgttcccgaaattatcagcaaaatcaatgcgattctttcacattcaaccgggaatccggctacagttagccaatacgctgcaattgcagcatttagatccgatcaaacagaagttgaaacaatgcgtcaggcgtttgaaaaacgtttaaatacaatttatccattattgcaacaagtaccgggttttcatattgaacaaaaaccggaaggggcattttatctctttccaaacgttgaagaggccatgaacattgttggtgtcgacacatcatcacaattagttgaactccttttgaatgaagctcacgttgccgttgtggacggtggtgcttttggtatgcccggttacttaagattaagttatgcaaccggcatggaagacctaaagattgccgttaaacgtattaacacgtttatgacccattatttagaaaaaaaagtatctggaggaatttccattgagacaaattaacatgattgacgcacctaaatacgtcaatgaaaaagtaaagattggtgtttggctcaccaataaacgatcaagcgggaaaattgcttttttacagttacgagacggaactgcttattttcaaggcgtcgtggttaaaaataacgtttctgaggaaacctttgaactggcaaaagaagttaagcaggaaaccagtatgtggattaccggtattattcatgaagacaaccgatcacattttggttatgaaattgaagttgaatctatcgaggttgtcagtgagtcacatgagtatcccatcacgcccaaagagcacggtgtcgacttcttaatggatcatcgtcatctttggcttcgttcaagtcggccacatgccgttatgcgtattcgaaatgaagtcatcaaagcaacttatgacttcttcaatgatgaaggtttcatcaaaattgatgcgccaattttaactggcagcgctcctgaaggtacaaccgatcttttccatacgacatattttgataaagacgcttatctttcccaaagtggtcaactgtatgaagaggcaggtgctgaagcctttggcaaggtcttctcatttggtccgacttttcgtgctgaaaagtctaagactcgccgtcatttaattgaattctggatgatcgagcctgaaatggctttcatgcaccaagaagaaagcttagatattcaggaacgctatattgcttaccttgttcaacgtgtcattgataattgtcaaatggaactcaagacactcggtcgtgatattgaaacactaaagaaatatacaatccttccttatccacgaatcagttatgatgaagccattgacctcttaaagaaaaatgatttcgatcttgactggggcgtagattttggctcaccggaagaaactttcttagccgatcaatttgaccaacccgtgtttgttttgaactatccgaaagctattaagccattctacatgaagccgcacccaacccgtgacgatgttgtcatctgtgctgatttacttgcacctgaaggctatggtgaaatcatcggcggctccgaacgggctgttgattacgattacctttacgatcaaatcgttaaggccggcttagatcctaaggaatattcatggtatcttgatctacgtaaatacggcagtgtgcctcactcaggattcggtttggggctggaaagggcgcttacttggattaccggtgaagatcacgtccgcgaagccattccgttcccacgattgcttaaccgaatttatccataatgatgtcgcataaagaggtgagtcaacttggataggtatgcacacgatgtgcttcaatacggacagacgactattacgaatcttttgttgaaaaattatcgcaagatagggatgtccaatgaagagctgcttctttatattttaatcaaacgcaaccggaccttaattgtcccgatgcctgaaattgatggtctaacggctttaacagggtatagcaaacaacaactttttgagatctttcatcagatgattcaaaaaaagctggccaaaattactcaggttaatgttgataatcagcaggtcgatgcctatgactttaattcattatatgaaaaattatcgcttgttgaacaagcagattccactgataccagtgaagaaaaggaacccattccgtcaactgaaccacaggtcagtgatcagcaaagacaagagatgtttgaaagcattgagaaagagtttggcagaacactttcaccgttagaaatggaatctattagtcagtggattgatttggatcactattctcctaaaatggttgaattagctttaaaagaagccgttttaagtcaagtatataatcttaaatatatggatcgtattttaagaaattgggaaaagcgacacttgaaaacagcccaacaaatcgaggaatacaatcgaaatcgtactcgaaataattcagaaactgaggaaccttataaaggtcctaaaattccatttgtcgatattactaatcctaataaagataaatagggtttatgacacaaatagaggtccagccattggctggacctctatttgtattgacctattattgatcatttacatcattgttattcgagtcaggcgaattactatcttggttatttgaagaatcagaggttgaaccaccaccatcacttgaggaacccgttcccggattattatccgttgaagatgaactggtactggaactgctattgtccgtaccatcaccagacgacgaaccactaccgcttggttgctgtgttgttggtgcggtttgtgaagattctgttgaactgccccgattttcttcattgcttctaggcgacgtcgtaatcgtcccgtttgagctcgaactactttctactgagtaactcccagcagctgtcgtagtattatccgtgacagtcccgggatacccggcaacgtaatattcagtgttaccgccacgattagtggccacaacgtcactcggctgtgtccaatcactattaggcttgttttgagaaacataggacataaccgacttataaatctgctgagaaatttcactttgtggctgtgtgatatacgaatttgctttaaactgatgatcatatcctgtccaaattgccaacgcataatttttagtataaccggagaaccatgcatccattgatgaatttgcaggaactttatttaaatagtcatcaggatactgagttgttcctgttttaccagcttcgtacaacccggaaatctttgcggtggttcccgaaccgtcagaatcagtcataacaccctttaacatattggttatcataaatgcagttgcgggcgacattgcacgttttccctttggatggaaccgtttagtaacgccatttgcttggacaatacgattgataatataaggcttgtagtaagtaccgccatttgaaaacgcagcgtaggatgcagcaagctgttcagaagaaatatataacccgataccattttgaagactcaacgttttcttaaatggcatgcccaactttttcagaaaagtagtggccttggaaatacccacattttccaaagttcgaatagcaggaatatttctagattcaacgattgccttacgcatggttattgttccttgatatttatcgtcaaaatccatcacgtttttgtcagttccgggataaacataaggggtatctttcactggctgataggtaggatatttaagatactcaattgcagggccataatccataatcggcttggcagtcgacccggaagaacgaccggtttgaacggctcgattaaggccaaacgctactttggttttgcgactgccttgcattgccattactttaccattgttaacgttaaccaatgttgccccgacctggaaccggttattggggtaaacaatacttggatcattatttgaaactttatatagtttcttttgagcattcatatttaaattcgtgtagactttcaacccactgttagctttgtaccctttggcttttagttcttccaaggtttgttttaaataggagtcaatgtatttcgacgttttggcggatccactcgtttgggtatgcgtcttcgccaaaccgctttttacactggtattcttggcgcgttgagcttgagcggaagtaatggctttatttttaaccattgcgttcaagacttcatttcgacgctcggttgcgtatttgggataaatgtaaggattataatattttggagattgcggcatcccagcaagcaacgctaattgcggcagtgttaagtgacccaatgttttattgtaataaaactcggcaccggtctgcataccgtacacaccatttcccatatatactttattaatatagaattcaaggatctgggatttggagtagcgattttcaacttgaattgcaagccaggcttcttgagcttttcgtttcaatgttcgatcacttgccgcggttgaaaagaccgaaagcttaaccaactgctgggttaatgtactgccaccttgcatgcctaacgatgaaccggtcaaattggagagggccgcgccaacaatacgaattggatcaacaccatgatgtttataaaagcgtcgatcttcaattgagaccaccgcttgtttcagagtacctggtattttatttgatttgacataatctcgattttgacttcccagccgtgaaataacttttccatttgtatcataaatttgagtggaattatcgcttgaaagtgcggattgagtgatccggggtgaactggatgcgtaataagcaaataaaccggctccaaacaaaattaaaagtaaaaatagactgagtacaatcttgataaagcgtttaaacgggcccttcttttttttcttggtgaattgtcgacctcgtctcatattcgctcgtgaattctgaggattattctgtgacatagatttctccttcgtgattattcaatgatcgaatcgaccgcacgtagataggggagtagtgggttaatttgataaggaacagcaacaccgatttcttcaatagtttttcgcggaattgacttccgcccaccgacttgctgctgatcccaatagtcgattagatccgttgccttaagtaggaaaacggattgatcattgacaaatttgataatagcaaaacaaatgcctctttgctttaagcattcccgcatatgttcaacttgatgtttatgaaaattttttaaaggaaacgacgttttgttcttcgtttccttggcatcaaaatcaatgtaatggccttgataaacaccattataatcagttgttgatgcttttcgaaaataagcctccttaattcttgcggcacttcgtttgggatagtctaccgacacaatttggattggggtaggtttcttgtgaatcaccgcaatttcattatttaaataaaatttattactttcgttaagttcagcttcaagcgtcattccacgattagaaaaatcaattgaatcattatgtgactgctcgaagccggactgacgatggaattgatgaccatctgggtatttaattgtcataaaacaaactcccttttaacatcaatatgtacattgtactgcaatttcatttaaaatagttttaataatgatattatagcaagtgagtatgtgattgaaaaatgttttatgaatgggtgatattgtgagccgtctatggataaccggctatcgaagctacgaactgggcatgtttaaagatgatgatccaaaacgcaaagtcattgattacgtattgacaaacgaactcagacaggcgatcattaacggtacggactggataatttcaggcggtcaactcggagtggagcagtgggctttggaggctgccaatcatttaaagagtgagtatccggatgaattccagacttcaatgatgctaccttttgcagaatttggcaataattggaatgaaaaaaaccaactgaaattgcagaaactaagacaatcagttgatttttctgcgtctgttagccaacagccataccattctccgcaacagttaagaaattatcaagaattcatgttaaatcatacggatcaagtgatcatgatatatgatttagataatccaggaaaatcgcagtacgatttcgataaaattaaaaaatttgcagatagtcatccgtatccatacagactgatcacatttgatgatctccaaaatgctgcagatgagtatcaagaaaaccaaaataatagttttcaagatgattaatatatgatatcattttagtggtttgttgcaaattaagacgaggtgtaaccaataaaatggaaaacattaactatactccaaaagatatcctccaaaaagagtttcgacaaaagatgcgtgggtatgatccaaatgatgttgacagcttcttagataatattattaaagactatgaagcctttaataaacaattacaggagctaagtgacgaaaatgatcggttgaaagttcaggttgatgaattaaataaacaacttgctgtttctggtaaccaaccgatgccaacaaccggtgcagctaatccgacaccaagtcggcagactgccagccagccgatgtccagtgcaacgaacatggacattcttaaacgcttgtcaaacttggaacgacgggtattcggatcgcaacttgatagtggctcaaatgagtcgcatcggttgtaattagttaacttgttgattaacttcagtgcagatcctcagtaattgcggtcggctttatgccggctgaggaaagtccattctcgcacaggctgcgatgcctgtagtgttcgtgctcggtgaaaaaataagccggggaactctttttaagagttacggcggattccaagctaaggcttagctatgcggcagaatccttaaggtgccacagtgacgaatgtcctgagaaatctcgacagtggaacgcggtaaacccctcgagcgggaaacccaaactttggtaggggagcttcacacacggtaattgaaccaagtgtgggggagaaataggttctatttctcagatagataattactacttcctaatttgttcctggaagttaggaagcacaaaacatggcttatagggatttgcactaaacaggaaaaagacgggagcttgctcctgtcttttttaatatcttcataaaaaaacaattcttagccaatgtttattgttgaaatacggtatgatagtcatgtgaagtattgaaaatgaatcatcatgtatattattaacgagtatcaccctggaactttattaaacaaataacgtataacaggacggaattaaagaatgattaagttttagaaaccaaaaaagataagcgagagtgaataagttgaaatttaatttagttgcgacatgtgccgccggaatagaagctttggtaggtaaagaattacgaaatctgggttatgatacccaagttgaaaatggccgagttcgtttttccggagacgaaaaagatattattaagactaatctctggctacggactgctgatcgaatcaaaattattgttgatgagttcgatgctcagacattcgatgatttgtttgaagccaccgctgccaatcagtgggataaactattaccaatggatgctgaattcccggttgaaggtcgttcacgcaattctaaactacatagtgttcctgatgttcaagcaattgttaaaaaggcgattgtaaactccttgagtacatcctatcatcgtcacacccggttaccagaaacgggtgcgaaattccccttggaaattgcaataaacaaggatcgtgcgatgttaactttggacacaaccggttcaagtctatttaagcggggttacagagttgaaaagggcccggcaccgctaaaggaaaatatggctgcagctttaattttactgactagctggtatcctgatatgccgtttatcgatccaatgtgtggttctggaaccatcccaattgaagcggcattaattggtagaaatatcgcacctggatttaaccgtgatttcatttgtgaaaagtggccttggattgatgcggatatggttcagaatgtgcgtgacgaagctgattcaaaagcagattacgatcgagaattggatatttctgctagcgatatagacggtaatatggtcgaaatttcaaaaagaaacgctgaagaagttgggcttctggatgatattcactttaaacagctggcagtcgctgattttaaaaccgataaagttaacggtgtcatgattgcaaatccaccttatggtgaacggatgagtgaaaaagatcaggtccacgatttatataagcaaatgggcaaagcatttaagccgctttcaagctggtccaaatacttcttaacctctgatctcgaatttgaaaaatattacggagaaaaggctaccaaacgacgaaaattatataatggtgctctaaggacggactattttcaatattggggtaaaaaagttcggaatatgaatagtttatctaactattaaggtcatttaaaactttatttatgttgaaataagaactattggcagaaagaagtgagtgaatgcaaaaaagaattgctgttatcggcggtggcatcattggagctacagcagccttttaccttggttacttggatcagacccaatcattatcggtcacactgtttgacgatgacttggggcaagcgacaaaagccgcttccgggatcatttctccctggttatccaaacgccgaaataaacgttggtatactttggcaaaagagggcgcggctttttacagaaagttagtaacagatgctaacctcgggacaaacgtttaccaacaaaccggaaccattgtgactcgaaaagacccaaatgatcttgacagcctttttcaagaagctgaaataaagctccgtcacacaccggcaatgcggtcagtggcccttctttcctctcaagacgtcggtaagcgtctcccatttttaaccaacccgcctgcaggcatcttggtcgagggtggtgctaagattgatggcttgcatttcgttgaagctctattggatcaggcacaaaagagacatgttgaaataagccggcagcgcgtcttttttgatgaaagtggcaaattaaggacatcaaaagggctagagtcatttgataaaattattattgcgactggtgcttggatgaaagggaccctaaagccgcttaattacttggttaaagttcgaccgcaaaaggggcaactaatcgatttaacaattaaatcaaaacactatgggggccatttacctgttttaatgcccgagagcagttctgatattattccattcgaacacgacaagttggttgtgggtgcaacccatgaaaacgatggtggatttgatctaaaacccactagtgaagcgcgtaatcgtttacttacaaatgcgaaggcgttcgatcaacatcttcagatggatcaaatcgaccgcgttcgtgttggtacaagagcgtataccgacgatttcgcgccgttctttggacatctaccagataacccaaacattttacttggagggggtctgggctcatctgggctcacaacagggccacttatcggatactttctggcaagggctgtcgttgaagaccagttaggtgtttgggataaatataccaagccgatcagtcactatattatttagcatggagagcttgcatggcaaggttatgagcaccatgattttgagtatcgggaatccatgtgttaataacagttgtaaaatgattctgcaatgtaatcagttgttctgtttgtgtttcaaagtgtttggcatacgctttattcaaactgtcaatcacgattttgctatctgtatagtagaaaacaaactcggctggatcgattcccaggccaattaatttttgaaatccaccaatggctgcttcaaattcggcatgatgattatccatcgacacaattttttggttaagctgaacctgatggccgttttggatgattaaaatgccaatagcagccttaccggattgctgattaaccgccgcatccgtatataatttaatcatttatatgcaccactttctttgttaaggagtcttattaatgataacgcaaaaacgacacttcttttaccagccaagcccattaagcagcattatttgttggagctggacattacttatcttttttattggtgtgattatctggctagaaatcacccattttcaatggattacgttattcttctttgtcttgtttgcctttctaacttgggcagaaattcattttagaaacattaaagtctatgataaccaactcattgttagtcgaataaccaatccccactggttggtcattgacttggctaagatttcacatgtgacaacatcaaagtatcaactggggttcgttgcaaacaccaaaatttatagtttcattttgccggctaattcagtcatcgaggttaatgaattaatctcaaaaaaataatttttcaaaccatactatggtgagagtcgaggaggacttttaaatgatgaaaagtgatgttgaaatttcccaagaagctaaaatggcacctatcactacgattaccgatcagttagggattaaccaggataatcttgaacaatacggtaaatataaaacaaaagttaactttaacccgtcagatgcgtgtcaagacggcaagttaattttagtgacttctattaacccaactgctgccggagaaggtaaaacaacggtgacaattgggttgggcgatgctttcaccgaactacataaaaacgttgtgcttgctttaagagaaccttctttaggaccagtcatgggtatgaagggtggtgcaactggtggcggttacgcacaggttgtcccaatggaggatattaatcttcactttacaggtgactttgatgccctcaccgaagcccacaatacattggctgctctaattgacaatcatattcaacatggaaaccaattgaatattgatccacgacaaattgtttggaaacgagtactggatgtcaatgatcgcgaattacgacaagttgttatcggattaggggggcgaacttccggtgtaccacgtcaagacggttttgatatcacagttgccagtgaactaatggctattttatgtctggcaaccagtttgcaggatttaaaacaccgaatcagtaaaatattaatcggctacacatatgatagaaaacctgtctatgtttctgatctacacgtcgaaggcgccctgactttattgcttaaagacgcgatcaaacctaatttggttcaaacattggaacatacgcctgcattcattcatggtggtccgtttgccaatatagctcatggctgcaacagtattttagctaccaaagctgcactgacttatggtgattatgctattacagaagcaggcttcggttcagaccttggtgccgaaaagttcatggatattgtgacacctcgattaaataaaacaccggattgtgttgttgttgtcgcaactgttcgtgcattgaaactaaatggcggtgctgataagaaagaattaaacgttgagaatcttgacgcactaaaaaagggtgtcataaatctaaaacgtcacgttgagggcatgcaacaatatgggaaaccggttattgtagcaatcaacaaatttgccagcgattccaaggacgagttaacttacttatcaaactatgtacaaaacgacttgaaggttaccggtgaaattattaatagttgggcagagggtggtaagggcgccgttgatcttgcccaaaaagtgattgctgcctgcgacaattctgataagtttcacgaactttatgatcatgaaaattcgagtgttttagaaaaaatgacagccattgtcactcgaatttacggcggttcaactgttgaactttctcgaaaagcaaaaaatgaattaaaacgcattgaaaaaatgggttatggtaatttaccggtttgcatggcaaaaacacaatattctttcaccgataatgcaaaagaattgggagctccggaaaactttacaatacacgtatcggatctacagcttaaattaggggctggctttattgttgcacttactggtaaaatattaacgatgcccggcctgccaagtcatccggcggcattggacatggatattgatgagaatggccgaattacaggactattctaaaaggagatttttatttgccagttatatatatcatcggcattctattgttgatcggccttgatcagcttgttaaacactgggtcgttagcacattagcgcttgggcaatcgtcttcggtagtcccaggcgttttgtcgattactcggatcaacaatactggtgctgcctggagcattttatcaggacatcaacttgtttttgtattgattgcaattgttgctgcaattctaatcggttatttcttggttcgctattggccaaatctgtggtatcgttttggattaagccttttacttgccggcacaatcggcaatgtcattgatagaattgttaataaccacgtggttgatatgtttcaattagattttataaattttccaatttttaattgtgctgatatgtacttaacagtcggtattttgattattggatttgcgattattaaagagaaatagaatgagggacaaaacagattgcctaaaaaatttaaaataacagatgaattggggcgcttggataaaattgtcagtatgctggatcctgaaatcagtcgatcaagagcgaagaagatgattgaggatggtgacattattgtcaacgattcaaaaaagaaaccgaaatacgaaacaaaagcttcggacacccttttaattaaagatgttaaacctgaaactgtgagcattaaaccggaaaatatgccacttgacattgtttacgaagatgaagatgtcattgttgttaataaacctcaaggaatggttgttcatccgtcagccggtcatccgaatcacaccctggttaatgcgttattgttccacagtccattatcatccattaatggtgaatatcgccccggaatagtccatcgcatagacaaagatacatccggactattaatggttgcaaaaaacgacatggcccataaggcgctgtccaagcaattaaaagctaagaaaaatctgcgaaaatacgttgcactggttcatggacgaattaaagaggactctggtgttataaaagcaccaattgcccgttcaccaaaagaccgaaagaaacaagctattgttgctgatggccgacctgccattacccattttgaggtaatggaacgatttcaagattacacattaattgaatgtcgcttagaaacaggtcggacacatcaaatccgagttcacatgcaatatattggtcatccgattgttggcgatcctttatatggtccaaagaaaacaattaagggccatgggcaattcttacatgctcaggaattaggctttgaacatccgaggacccatcaattaatgatattttcggcaccgattccagaaattttcgaaaaaacacttcgaacactgagagtgaataatttacttgaatcttgacaacttggatttactcccatattctggaatggataagcaataaaacaacgggattcaataaaaacagaactatttaaggagaatttagtgatgggcaagataattttagacaaaatggccatgcaacgtgcattaacgcgaataacttatgaaattgttgaaaaaaataagggtgttgaagatcttgttctgattggcattaaaacaagaggaatctttttagcaaatcgaattgcggaccgacttcaacagttggaaaacgtaacaattccggttggcgaacttgatattacaaattatcgtgatgatatcgaacatgattcaacaagtagtgacgttaaaatgtcaaataacaaaattgatttttccgttgaaggaaaacgagtcattttagtcgatgatgttctatatactggaagaacagtcagggcagcattatcagctgtcatggatttaggtcggccaaaaagtatcaatttagccgttcttgttgatcgaggtcaccgtgaattaccaattcgcgctgatttcgttggtaaaaatattccaagttcgcaaaaggaaaaaattaaagtatatgtatcagaaattgatgacaaggacgcagttgaactcattaagtgatccttatcctggtagtgaggagtcaacatgacgcaaagatatttgatattggaagacggctccgcatatgcgggcaaagccttcggatcactcgccacaacgacgggtgaacttgttgctaactcaacaatgaacggttatcaagagattatctccaatcaaatttaccataaccaaatcattgtattcacacaaacttcaattggtaatacagggctcgcacaaaatgcgtacgagtccgttttgccgaccgctaaaggtgtcatcgtccgtgaatatgaaaacctggcaacggatcattttaagcgtatttctctggacagatatttaaagagacataagattcccggaatatatgacgttgatactcgccagattaggcgacatcttcaacaaaaaggaaatatgaaggccagtatcgttgatgtggcagatgaacatgcatttgaccaactgcatgcaactgtgctgacaaatcaacaggtagcccaagtggcgacgccaaaaccatatcccaaccctgatgaaggcgctaacgttatcgtcgtagattttggcttaaaaagcggtatccttagagaattatccaaaagagattgcaatatcaccgttgtaccatggaactctacaagtgaaacaattcttgatttagatcctgatggtgttgtcttatcaaccggaccaggtgcaccaggaaatttgccggaatctgttttacaaatgatacgcgaggtacaaacgcaggtaccgttatttggaattggcttgggccatgaactctttgccatggcaaatggtgcaaaaatcagtcaattacgggtagaacatcatggaagtaatcatccaatccgtgaaattatcacaaacgaaatcttcttctcgggacaagagcagggatacgccgttgattcaaaatctattgaccacgcaaaattattcattactcatattgatttggtaaatggaacggttcaaggacttcgacaccgtgattatcctgcattctctgttcagttttcaccagatggtgccccgggtccgaaagatagtgttggtttgtttgatgatttcacagaatttatggcaagaagaagggacaacaatggcgacgaatattaaaaagctccttttgcttggcggtgggccaacaaacatcggtcacgaaaatgaattggatgccgcagcatatgaacgcctttcagcaattaaaaagactggtgcacaggttatttacgttgacaacaatccattttcgtttgccagtgaagaagttcagcccgccgacgtttatgttcaagaagttaattttcaaaatgtcgttaacattattgaaaaagaaaaaccggatgcaatcatgcctaaaattggtggtttaaatgccatgcaggtggcttggcagcttgaagaaagcgatgtgttggctaacaataacatccagttagtgggaattcgcccaatcgatctcaaaaaggttttggataatcaacaacttcgcgaattgttggatgaaacaggcgaaccaatcattgcctcaaagattgttgctagtgatgacgaggcaatggattttgttcgtgatgttggtttcccggtgattgtaaaaccattatctgcgagccatgacacaagccggtttatttgtaacaataccgatgaaatggaagatgcgctggaaattagttttaagcgaacttatattaagcgggtttcgattgaacaaagcatcgttggttataaagaaattgaaatggttgcgatccgagacgaaaatggtaataagctattaatttccgggctcgaagatatggatccaatcggtattcattctggagactcaattatttttgcaccaacacaaaccttgatcaatcaagaatatcagtcactaagaaccgccacgtttagaattatggatgcgatcaacatcacaggaacttgtcacatacaatttgcacaaagtcgtacagactcaaattattttgtgacgaaagtcagccccttctttaccagaaatgcgcttttagccgcaaaatcaactgggtatccattgtcatatgtatctacgttactagaaatgggatacgcgttgccagaaataaaactgcctgaaaaatacagtaagtatctaccatttatggaaccaacaatggatcatgttgtcgttagaattcctttatggccgttcagggatattccggacgtggatcagcatcttaacacattaatgaaatctgttggatcaacaattggaattgggcgaacagttgaagaagctatcatgaaagccatgcatagttcacaattttcacctcgagatatattgccaagtgtgtccaaaataagtgacgatgatgttattaatcaattaatccatcctttagccagtcgaatcctagttctgatggaagcaatcagaaggggattctctattgatgaattatctgaattaaccaaaattgatcgattttatttttacaaaatgaaccaacttttacgtgcccaggattttgtaatcaataatccactttcaccaacggccgttgaagttggtcataaatatggttttggtgatggaatgcttgctgaattatggaatgtcaatatttctacaattgaaagaatgaacagaaattcgaagacaaaagtcacttttaaagaagtggaaccgagtgctggggagtttttggaggccacaaacgttttttatagcagttatgaactggagaacgaaagtcagccatgtgttggaaaaactgcgttgattatcggtcgcggcgggaatcaattaggaccaaatgcagctgctgattactatacagctcaggttttagataccgcacataaagcaggatacaagaccattattatgaatacaaatccgaatgctatttcgcttgcacctgcacttagtgataaacaatatattgaacctattcaacttggtaatattctaaatatcgttaatttagaaaaaccggatattatttttctcccggggaaccgccattacctttctaaaaaactaaaagaatttgcagacttgaatatcgttgtactaccgccagatcagaaagttgctaaatacaatcaaagaaaagctactgatgctgttgatctttttattgatcatgaccgaatattgcctattacaactatttctttctatacaaacagccatcgaacagagctgcgatatatcaatgattatcaacagccaatgaatcattggcaaaaagaagagcagaagttaattggtttggccattaataaaatcgataccagtcaatggcaagggctagttcaagtgctatttaatagaatcgatgaccaatcaggttatcaatttgctggcattcgaccaattcgaattacagaatctgctttcttaaataagacaaccggtattaattggatagatgcacttgtaaaaaagtatttaggtatactggatattgaccagctatctgaatattatcaacctggtactcacaaacgttatgcgatgatggaagcagtctttccattcaaagaattacaatcaaatcgaaaagatggaacctctacccaagaggttggatcatcgctttcttttaaaaacatcgaatcttaagagttgatttttcaagcaaaaaaccgaaactgatcttcgcatttagaacggaagattgcttcggctttttatgtcaaattatttagttgtttgcgataatttattaatcagtttttcgtcaggggttaccaataatgtctgttgattatcgtagataacatacccaggctttgtcccgttgggcttacgaacatttttgacctttgtataatcaactggcaccttggatgaatcatgtgcctttgaaaaataagcggcaagattggcggcttcatcaatagtcgtttgtgacggatcgaagcttctgataataacatgtgaaccagggatattcttggtgtgaagccacgtttcccgtttgtctgccgtatgcattgttaaccgttcattttgcaaattatttttacccaccaaaatttcggttccatcagttgagacaaacttttccggtttattgatcttttgacgtttattttttttcttcttgtgttgctcatgatcccttagataatgtccctgctccagttcataacgaatatcaaccaaatcttcgggcttagctaactcaatttgagattgaatattctcaaaataatcgatttcttcttgtgttaagctgatttgttcgttcaaaaatttaacggcactcttcaatttttgatatcgcttaaagtatttttgcgcattttctgaaggagactgttgatttgaaagcttgattttaagtggggcattgttttcataataatttggcagttcaattgacgtcatgcctctatcaactttgttaaggtaggttgtaaggatttctcccttaatgcgatactcatctgcgttttctgtttcctgaagatcatgctttaaacgctttaactttgtccgattcttctttaattgttttttaacaacttgaattaagacggctccttgttcacgaacccgatcacgttgggcacgcgtagcaaaataggcatctaaaagttcacttaaacttgcataatgatcatttttatctgtatctggataaggaaatgcggtaaaattgatcttgttattaccaatatggctcaaggttgggactgccgcattaaactttgtaaagaaactctcgaagtttttctcaacttcagtatttttgtgaagggtatttgctaacgcagaagctgtgtctttgcccagcccctgaagagtcttttggaggcttccggccaaaacgtcaacattagggtaatctttaatcaattgcttaacatcatcaaaagatgttttagtaaaggggttctgcaaattttgcttaggaggattgatataagttgccccgggcaataacaggcgataccggttaacatcagaaccaacatgtttaattgcgtcaataattttattatccggttggttgactaaaacaatattgctatggcgtgccataatttcaacaattagattaagctttgtttgatctcccaattcatttcggcctgtaaagccaaaatgaagcacacgatcattttccagctgattaacttcggttaaaatagcaccatttaagtgttttcgcataatcattgcgaagtttgttggcactgccggattcacataagggattttggttacctgaaccctggcgtaagttgggttggctgaaagaagtaactggtggttcttcccatgcgctctgatcgttaaaattaattcgttagaatatggttggttaattctgcttacccgtccagtttggagcaggtccgctagttcttgtttcattgaatggataaaggatccgtcgaatgacatcgtatcactcactttcgtatatatagcaattactagtatacctcactttataagccgatgctaaggatagtgtgtataatgaactattgtccccgtttcttgaaaaagcctttatagcgaatataacaacctttagagattcatttaaatgttcatacttttttgtaagtcattatcaaatagcgtatactattttttcggaggtcttttcagaatgaaagatattcttgttgctttaaattctgctgctaaaaatcataatgccaggttaatgaaaattacgaaagcagaaaacctgactatttcagaatggaagcttctcaaccatgttattgatggtcactcaactcaagaaacactatctgcagtgactaaattggacatttcaactttatcaaggcagcttaaacgactggttgtcaaggaaatgttgtcaaaaacagctgttggaaaagataaacgacagctcatttatagcgtaacggaaaaaggaacaaaatccagtcagaatgttgagcaaaaggttgaagacctccagaatcaagtatttagtcattggactaatgaagaaaaaaatcttttaaaaatattgatcaatcgtttggaacaaagtcttgatagaatttagttgagcaggtgaatttaatgaaaattgcgatagtcactgacagtacagcttatctgactaaggcagaagaagaaaaatatcacatcaatgttgtcccaataccagtcattattgatggccatgaataccaagagggcgttgatctgaccactgaggacttttacgacaaattgaagaattcgaattcatttccaagtacctcccaagctccaatgggtgaaatgatgaatttatataattctcttgcggataaaggctacgataccgttataagtatccatttggccagtaccatttcaggattctatcaatccgttgagaatttagcacctcaaattgatcgtatcaaagtcattccttatgattccaaaattacggttaaattaatgggctatttggcaatccaggccagcaagatggcaagtcttggtagagagccacaagcaattattaagtacttagacggtctaagagcaaccatcgacgaactatttgtggttgatgatctacaaaacttggttcggggtggtcgtttatctaatgcttctgcatttattggtggcattttaaaaattaaaccattacttacttttgatgataaaagtaacgaaatcgttgcttttgataaggttcgatcacgaaagaaagcattaaaacgagttgaggaattatttgctcaggcgcaacaaaaagccaattatccattaagagctttagtgattaatggtcatgatccaaaagccggtgaagaatggacggaaaagattcatggattgtatccgaatatgccaattgaacaaagctacttcggtcccgttgttgggacacaccttggggacaaagctttggcactcgcatggcttcgcgactttgaaaaagatcaactataaagtaaaacgtaaaacttaacgattattgtaacaatcacgaaaatgttcggataatattgaacgaagtgattgttttttttatccaatatgatacactttaatagtcgtaaaaaatatggggtaggaaacaatgcgttaagtgttgaagggacggaatgtgaccttcgaacgaaaaccaatcggcttcgacttgctgattggttgcggtgttgttttcgcattcgccattttatttagttcgtttttttctaaatattggtgagctcctttcgggagatgtcattattatgaagtcattgtcgttaggttttcataagcttcggacgttagatattgcggtgttatcactattgctggcactgggactcattattgaccggtttaccgttggtacaaaatcaattcaaattggatttggtttcgttattatagctttggctagttatttatacggtccggtttgggcctcagctgttgcagcactttccgatatcatcggaacactaatttctggtggcgtttataaccctggattcacaatttccgcaatttttggggctgccatatatggtctttttttctataaccaagagatcacctggacaaaggtaatcgtttctcagctgattattgcagtgtttgtaaacactgttttaaacacactttggttgactctgatgtataatactccgttcatcgcgcttttaccggcacgactgctaaaagagattattgtcacgccactgcaaattgcgattatttactttgtctttaattcggctcaattcgagcgcattaagaacaagttaataggttaatttaaccggcgcgtctacaattatcttttgtagcgggccggtttttgtcgtactaaaaaaggagctttgattatgtacatcatcagaatgcaaaatatgcaatttcacagtcacatcggtgtcatggcagaagaaaaagaggtcggtcaaaacttacaagtcgaccttgaaacagctgttaatgccactccaatagacgatcatctcgacagcaccgtcagctatggaaccttttacccagttgtggaaaaaatcattagtgaaaatcgtgtaaatttaattgaaaccctggcacaaaaaatcattgttgctatcaaaaacctggatagcagaattgaaactgtcacgattcgaatccgcaagttgaacttaccggtggatggtgttttcaataatgtagaaatcgagatgaaacaataatgaacgatgatattgtattaagcctaggcagtaatattggaaaccgagaattttatatcaataaagccattcaactattaggaagcgatgccaatattttgattgataaagtatcgaatttctatgaaacgtctccagtcggtaacgttaaacaacgtcactttgttaatattgcactcaaaatcgctacaacctatactcctgaaaaattgttggcagtcattcatcaagtagaactcagtttgcatcgtactagagaaattcactggggaccgagaacactagatattgatattatattttggggcgataagaaaatgtcaactgatgatttgacgattccacatccagaaacttttaaccggttatttgtactagtcccaatccttgaactcatcagtaagcaatttccattttatcaacaaatcagtaagcagattcaggttctccaaaaaaaagatcagactgtttcattgattaaaaaagatgcccaacccaaacgacttgttgaaagttcaattcacaatattttatccgcgattggtgacgatccggacaggccgggacttgtagaaacaccggaccgggttgctcgcatgtatgatgaaattttttcatcagagggattggagaactttgaggattataaattatttaaaagtaaaagctcaaatcattcaaaaatggttttaatgaaaaatattccgttttactcaatgtgtgaacaccatatgatgccgttttggggcaaagcacatattgcatatattccagatcatggcacaattataggtttaagtaaaatcccgaggttggtggattttgtatcacacaaattaggccttcaagaaaaattaacggatgatattgttgatcagctcaataaaattctcgctccaaagggggccgcggttgtcattgatgcacgacatatgtgtgttgagatgagaggtgtgaaaaaaactgattcatcaacccgtacaattcgtttttcaggaatttttgatactgatcaagatttacaaatggcatttttaaattcgataggtgatattaatggcaaatcaatctgagcttaatcatgaaacgtttcctgcttttctttatgatcagggtgaccgtatcggattacttaaaaaaatattgcaatcacttggaaacccggataaacgttttaacatcatccatatttgtggcactaacgggaaagggtcaacttctttgatgattgcagctcttctgagcaagatgaactatcacgttggcttgttcacgagcccatatattggaaacatttataatgggattcaagttgactttaagaacatttccaaacagcatttcaatcaaaaaattagtttaattgaaaaagtgctccgaaatccaaaatttaatggagtaaaagtatccgcatttgaagctcaatttttaatttcaatgttatattttgccgatctgcatgttgactatgttgtattagaatgtgggttgggtggtgaattggatgcgacaaatgccgtttttaacacgatgtattccattttcaccaaaattagtctggatcatgtcggaattttgggaaataatatcacagagatcgcaacaaccaaatcaaaaattattcgccaaaataatgtcactatttcagcgcagcaccaacctggggaagcctttcgcgttctggaaaaagaagctcattccaaaaatgcaacttttttaacgtccaatcaaaccgttatttcgatgattttacaaacaccaaaatcaacaagagttcactatgttaatagtcagaatgatgagcaccaaagtggaacatttaattttggattagtggcaacctatcaactagaaaatttagcgactgtgattacttggctgattgactttttgaataggaaaaaattagtgtacaatctcaaccagcttctagaagagacgttatcaaacattgtcgtccccggtcgctttgagaaaatatctcaacaacccgttatcattttggatggtggtcataatccggacggtattcaagcgtttgttaaaacagttaacacattgtatccagactcagagaaattgattattaatggttttttaaaagacaaatcgtatgaatcatctgtaaaagagctgatttccctgaaaaatgcgtcatttattatcactgagcctgataacaaacagcgagaactgccacctcaacaattatcagatgtttatgtaaagctaaccaagcaaacgtatcaaagcttcgattcagcaactgatgccatccaatatgctgtatcacatgcaactgccaacaccattatttttgttattggttccttttatttactaaatcccattcgaacctatttattatcgaggagtgaccatcatgaacattaacgaaatcagtgatcatcagcaaacctttaccggcaatataacaatttcattcagcgtagcagcggacgaacaaccaaagcttattaacctgttaactaaatatacagaaaaaatattggtccaacagacactcgttattgcagtctttaatcacgaaaaccttaacgacgttattacagagtggccaaccgttttcgattctgaaaatgatcagcgtcaattacaacaaatttctgaagcttcaagaatccattttaaaggcaaaggttttgactttgatattactacgaaaccattaatctattcaattttgaacctgacaccggattcgttttacgacggtggccggaacgcttcaattgagggggtattgcatagaattgaagttgaaagaagtgaaggggcctcgatatttgaagttggcggaaaatcatcaaaaccaaattttgatgacattactgcaaaagaagaatgggaaagaatcgaaccatttcttgaagcaattcatcaacgatttccagacattgttttggcaattgactccaataccaatgacgtcattgaagaagcgttaaaaaatggcatccaaatcatcaatgatattgatggttttaattcacaaactaaattggatttagttgctaaatacaagcctgcggttgtcacgatgtttaacggtcgtaacttcaatgaacaaccggaaactctagtggaaacaatgaccaacttctttacacatacaataagtgatttaacaggcgttggattgaataaagccaacattgtgattgatccgggtgttggcttttccgatcataatacactggaattcgatatcatcaaaatgcgtttaacaaaattgatggctgagtttcagacaccaataatgatcgcaatttctaggaaaagcttttctaaacggttattcaacttagattctgctgacgacagactaatcccaactttattatttgagtcatttatgactgtacttggtggccgaattatccgtgttcatgatgtcaaagaaacccgtcaaatgatcgatgcatttgaattgttgaaagataacttattaagctgacctttattaacagtgatggagaagattaaatggcagcagacatttttttaaatatgctggttaaggagttggatcacttgcaaacaatccatttcccctggctaaactctaataaaatccaaaaattgaaaataaagctaatagatcatgcgggaggtcttagagaccggaaatccaaattgcatttatcagcaagtgcaatggtattttccgagcaatatggctactttatcaagcatccttatctgaaaacggttttattgcctgctggtcacgttgaaaataatgaagttcccttaaactgtgcagtgagggagtttcacgaagaaacgggctatcaagttaaacccgatagtggccgcctcattgatgttaatttaatccaaattcctgccaatccggcaaaatcagaaggcgcacatcaacatattgactttcgttttggctttcttttagaaaccggcaagcgggccgacgctgagttgccggttttcttattaacaaagaatcaggcaccaaatgagttttctaaatactttattttaaataaatcaggcgacaagtggtgaaaaattaccatattcataatggaacacttaatcgattcccagttgtgatagatttaccacatagcggtacaagaatcacaaatgaaatgacaaaagctttgctgccaaatgccatcttggctaacacggattggtttttaaaagaactctatcattttttacctgaaatgggattcacggtaattgagaataacttaaaccggtatttaattgacccaaatcgtgatcccaatgaagacttgactggggactattaccatcttgtatatgccaagaacacattcggtcatccattatacaaacgacctttaacaagtaccgaaatcaataatcgacttatgggcttttatcaaccgtatcatgatcagttgcaacaacttttggaaaacaaaagaaacgtttttggtagtgctttattaatcgatttacacagttttgcagaatacacgcatccatcactaaatccgacagccgatattgttttaggaaatgattttaatcgaacaacttcaaaaaagacgtttaattactttcaaaggctttttacccaaaggcaatattcggttgctaataactttccatttcgcggtggttatattactcgtcattatggtagtcaaaagggtattttctcaattcaaattgagttaagatacaagaagtatattgaggatcggtattttgatgaagaaatccttactcattgggacccaataatatttaaccatgcccagctacaactccaacaagtttttaaaactttggcatctgatctggataacggtcaattattctttaattaattgggctcaatagcgaattaacgagttaaatggaaggaattgtgtaattataaaatggcagaaaaagaagatcaagaggatcaattagttggtattcgtaaaatggttgcggaggattatcccgacgcatacaaactatggcaaaagacgccaggaatgaatttacgtgattttgatgacagttttgaggaaatcagtagattaatcaaattcaatccgggcttttgctttgtcgctgagaaagataatcaattaattggtacaattctcggagcaactgatggtcgcagaggtagaatctatcatttggcggttgcaagagaagttcagcacactggaattgccaccaaattagttaacttggtgattaaacaattaaaagaggttggtattcaaaaaatatcaattattgttatgaaaaataatcatgaaggtgaattattctggaaaagtttacaattcagtaagcgtctggacgttgactgtcaagggcagtttaaaaatgtaggttttcggcagaaagaaatgtaggttttcggcagttacttgaggccacgtaatcggtaagatttaccagtgatcttcactacgtgaacatgatgaaccagaacagcgagtcgagactggctggctggcacgtgtggttctggaaaaatatcaacccaagcggatagatcactattgctggtatatcgttgaagtgcttttcatagcgggcatttgactatgcgaataagagttacttcttgtgaccaattggcaatacccaatttcatcaatatcataggtcatatcgcgactagcggcttagagacgatcaagcagctttttcgtaagctgctctcaatctaatcaacagctcctgacaattaaataagagaacccgaccaccctgtttacagcctcaatcccaactaattgccaagtagggttttaccgacgtcccggattgccataaagattaagttttcagcttttccataaaagccaattctgggaattccagaaacctcttggcgattaatactgtggttgaaagctaaaatcaatgtatcttaaggattttgtaatttggggaaccgagcacgggccccaatgtcccgtgcaatctgacctcgtggcgatttttgtctggagttccgaatttattaaatcaagtagcgcctcagttaatgacaatatcagtgtggaatgtgatcaagttaattcggcaagtattcacggatttgttttacaaccctaagcgctcaagattattttaaaagaatttgattttattagtggcatgtagcctcctataagttgtcgtgcaatcaagtcatatggttcacgaatgtaagcttgaaatgtcttcatcttccgccctttaagcaaaatcactttgaggatattgctgatcttggggtccataatcagcgaatttggtatttatgagtgcgtacgaaggtcttctggcctttataataaattggatgcgctctcatcattggagatttcaacagcaaaccgtacaaccaatttgtatcgcggactactgagtacttacatttgcggaaatattgatcatggcctccttccgcaacgacaacgggtattttttcttttcttcgaatatgggttcaaggagattaactgggaccgcgataaggtactcttttttcttcgtctaaacccatttccagtacgggacttcgtccttggcctgcgaagtttcatgatttagaatcatcttcggagcatctgaacagttcgttagctcattccatcagcaattccgtattgtatggctaacgttcaaaccgtgcgagcaagctcaactgcacctttagtttgtggtctgaatggtcgacaagcaattggttgaaaccggcatcttacagaattcgtggaccccgttcgttaaagacaggtggccaaactggattttggtatgaatccacaacggttttttttcatattaatcaaaccagatttccgtcggaatacctccgggatgaaggcaagcgtcgtgtaagcaagaaaagaggggtaatcttggcctccgatcaaggttagtgtcatctagtgattttgaataggcaatacaatcaaaaatattgaatttaaacagctcacccctcgctgctcactagggccatttcttcctttccagtcaacttgagccgagagaccaggggagtttcaatccgaatggtagctttcttaactcggttcgcggcggtttggcgacaataatctttcagagggtaatagcgccggtaacgcccttctctggataactttaaaaattgacaggcagccgaacactttaagttcaagctttgaatcgatggtttgcttgaatgtattccagtaaacttggcctacattcggtcaccgactttgtcgtccttaagtcccagctttgacttcctcctaggctttattaacggtcgataatcaacattaattgccgggcatctcggcgatgttggcttaatattttcatcaacgtaaatcgtcactccttctctttctcttaaatcacgtctcacatcaaattcctcctacactctgatgtgattcatgatacaaaaaatgtaggaaaaccaacagttctaacctgccgttttcctacattttacgggtgccttttacagttgacacctatgaccgaattatttaaacgtaatgacaattttttaacctcaatattgataacgctttgggattgaacagtgcgagtagacgtgttaaaatcatcgaaaataatttaatgaggtgccaaaatgatgaaagctgctgttttaaccaactatggaaacgttcctgagtatcaagattttgctgagccaaaagtgatgaacgatcatcagctcatggtttcaccaagggcgtcgtctattaaacaattagatattagcaaagctgccggtaaacattatacgaactttgacccgttgccggcggtaatgggaatggatggtgttgccgaacttgatgatggcactaggatttacgcaatgggcctcacaggcatgatggcagaaaaggcaattatcgataaacaaaattttattaaattgcctaatggactagatagtgtcaaagccgctgctttaccaaacgctttaatgggttctgatcttgccttaattgaaaaaggcaaaataaagcagggtgatgttgtttttgttaatggtgcaaccggcgctacgggtatgatggccgttcagttagccaaatttcacggtgcctctaaagttattgcaaccggtagaaatagtaaaatgcttgaccacttaaaaacaattggtgccgataaaacaattttaattaatgaacccgatgaacaaattgtaaaaaatgtcgtttcaacatacagtgaagcaccatttgatattgtgattgattatctttggggacatcctgccgaagtgatgtttaatgcgttcaggaaaataaaactggcgaaacatttaaaatatattacagttggtggcatggcaggttcggatatcaaattatcttcgcaaattcttagaagtaaggacattgagttaattggatccggcattggcagtttttcgtcgaatgtttttcaaaactatttaaggaacgatttaccatcagtatttgattatgcagctggtggacaattggatatgaatttaaacgttttttctttatcacaaatttcaacagcatgggttgcacacggccgttcagttattacaatttagaaaaaagtgaagaggtttcattaatcatgaaattgatctctaattaaggttagggattttttgttttaaagggaagtggcattttagagagagagagatctttaaattatatgctactttacataatatacattatacgaagtaagtactaaaacaaaaagaaacgccaagatagtcttaaatgacccaaaactatctgacgcttctagaatatttttaacgttaagtcatcatttcaaattatatacttagccagcttcagcttcaaacccatttggccggattttccgctgaccatccggctcatcctcaggcaaaacttgtggaccgtcaaccgatgctcttaaaatatgacgctgaacgcgtttctcaaccggtggcaacttcatatagttaccatacaaatgagtcaaatatgaatcatacgcagataataccggaactgtcaaatcttcaaatttcatcttagtaaattgatgaatttcgtttggcagaattctttctttcccatattcatatggtgatgatagattcacgtaagtaagatccggacgatcatcatatttggtcattatttgcagtcttagttcataaagctgttccaaggtcatggatgcatactttgtatccaaagacatatctggatacaaatccggataaaaccgccgccgaatttcttttaagatgtcttgcagtatctgtttttgggcaatttgctgacgttttcccgcaggcattttatcaaatggaaaaacatcaataaaaatgccattttgagatttcgcttcttcacggccacgttccaaaattcttgtgcctttagacatcactttagcaaaatcatattcgtaaatcggatttaaacgattttcttcgacaaaatattctgtagactttaattccgttggtgcaacttggagaaacttttcaaaatcatgtcgagtgaatccaatatcaatatcgtcatcccaaggtataaatccctgatgacggacagcaccgattgcggagcctccagtcataaaatatttgatatggtgtttggaactcaaatgtgctactttcttcaaaatgtctaattgaattccgtgaatttgcttcatatcaaccatcatatgaaagcccccttatttttttgatccttatttcatctaaaaacctcttttgactattttttgttcgtctatgctattctattgagttttggggttgaggtcaaacatttggtttgtaaatatacaaaataacgtagaatttgtgttataatataacttaataaaaccggtattttattaagttatctaaataaataacgaggatactcctgttaaatccgtgttcttgctaactcaataaatgatcttttttcctaataatgatcatgcgttaccgttttttacaaataattatccgccctgtatgattgatacacggtcgactgtctaataatgcctttttatgtcactttatccaatcaccgagcagttgctaactaaactcatttgggaggttcatttaatgaaacaaaaaaggctcctctttattggtggaactatgggcgttggcaaaaccacccttggtaaataccttgttgatcaaaaattggaaaatgctgcttttctggatggagattagtgttggtatatgcacccttgggtattttctgatgaaaataaaaaaatggtgatcaataatatccaattcttgctaaacggatatttacatcactcaacatttgaaacagtggtttttgtatgggtcatggatcagcaacagaccattaatgatatcttatccggcttaaccggtgactatgacttctacaatgtctccttaatagcaactgccagtgaattgaaacgccattttgaaaaagacactcaaaacggtatcagagaattcaatgacttgttcggtgcgcttcgaaaactgtccatgtaccaaaaaatcaactcaataaagatttcagttactaactcaagtctgcaagaatcagctaatcatcttattgcgctacttaacgccaaaccagaaaagtaatatttatgcaaaaaaattttattcattttcaggagaataaacatgaaaaaatcaaactacattgctaataacgatgtccttatcgcagagatgccaacttatgttcaagactattatttggaaaaatcaaccgtccctctatcaccagcgacactataccagtatttaaatgagttccaccgcttctttacatggataatggataccggtatcacgaatgctgtgaaaatcaaagacattccactatccgatcttgaaaaatttaaaaaacaggatatggaactctataaagcctttttacttaaccgaggtaaagaaacggccaaaaatcctcaaggaacattgtctcacagaaccgtcaaccgttcgttaaacgccctttctgcgcttttcaggtacctaacagaggaatctgaaaacgatgatggagagccctatttttatcgaaacgtcatgaaaaaaattgctttagtgccagatagtgaaacttatcaaacgcgggcaagaaacattaaagacaaattaatgctgggtgatgctgacgttaactatttaaattacattttaaacgactattctaaacagattaaaggtaaacgactgctaaaaatgcatgagcgtgatcgtgaacgcgacgttgcaattaatgctttaatgctgggtaccggcattcgggtatccgagctgacaaacgcaaacttaaacgatttaaatttaaaaaaagcaactgtttccgtgcagcgtaaaggtggtaagcgcgattcagttccaattgcaaattgggtaatcccctatattaagccttatttacaagttcgaaatcaacgataccatgcaacagccgctaccccttccctcttcttgacaaaaggggtggatgagccaagacgaatttcgaccgcaacggttgaactattagtagcaaaatactcacaggcatttaaccatgttcgaatcacaccacataaattacgtcataccctggcatcaaagctttatttggaaaccaataatgagcatttggttgcaactcaactcggccaaacttctacgaaagcgaccggtctatatacacatatcgtcgacaccaaacaaaagaaagcactggatgagttgcataaagaccactaattcgcttgcgaagtatacctttaaaaatcattgttctttttgctgctgataacgttcccacatttttgtttggaccttagtaaaggcgatttctcgaaagtcagactcagaaatccatttacccggaaaatagctcaaatcactgctattatttagttcagcttccaataaagtaatctgccatttttgatgagtgaatgtatgggtaacaggacgaccaccgatttttttaacgtgtatctctaattgataagttgaaagaaattgggcttccagtgcccgtaaaacatcatcttcagaagcgtcttttttagtttgaatatcatcgcctttgattaacggaaacatccaaaaacgactaagaataccactgtttggacgtctttcaaataaataatcatcttgagaatggattaaaagaccaaagtaattcaccggaatcggcctctttttcttggtcttaaccggatagttatcctctacgccatctaaataagcttggttaaacagttttactggtgaattttccgagtcataatttttagcactcatatagcttgcacctaaatccataatagcctgattaaagtctccgggtcgattcttgggcattagcttcttaataatattttcaaataattttcgtgtttgtggttttgctatatcttcgtcaatttccagtaatcttgcaaatacccgaagcgcattcccatcaacggcgggaaccggtttattaaacgcaatgcttgcaatcgcaccggctgtgtatggcccgatgccacttagttcctgcagctcctttactgtggttggccactgcccgttataatcattcactatctgttgagcagctttctgcaggttgcgagcccttgaatagtatcctaatccttcccacgctttcatgagaattgcttcatcggcacttgccaatgcctgcacggttggaaacagcttcataaaccgctcataatatggaatcactgtctgaacctgagtttgctgcaacataatttctgaaatccaaatatggtatgggtcatgatcacgacgccatggcaaattccgtttgttattgtcataccactttagtaatgtttcttgaaaagcgactatcttttcgggtgtccattcaaccataatgatttaattactcctttatttagtctgaagcgagctttataattaaggggattaatttttccctactttccttaatgtgtcaccattctatatatagcgatattaacgatagtattgacgttatcggaatattaatttacaattttagggatagattaattataactttgagggggactttagatttggggctaaagcgggtttttaagcggcgagaatacaaatatttactcaacgccgaagaatacatcactattcgaaaattgttaatgggacatatgtccgaggaccaatatggactgacaactatcttatcattatatttcgatacaccacaatactatttcatcaatcaaagcatgaaaaaagtaccatacaaatcaaaattccgggttcgaagttatgggacacctttaatggacgaaccggtttttttggagttgaaaaagaaaattcaaggcgtggtatataaacgcagacttcagattccctacgatgcgcttgaaaatacacttcaaaccggattaagctgtcttgatcatcaacaattggtgtctaatgaaaaccagatcaagcaggaaataaaatggctgtttgatcgttatgatattaaacccaaagtgttgatttccgatgatcgggttgccctttctacagatgaagatccagactttcgagtgacattcgactttaacattcgctttcgtgacgaggatctttctcttcaccatggtggttacggcactaaaattacaccggactttgaaaccatcatggaagttaaagccacaggtgcctatccggtctggtttactgatatcattgccaatcttcaccttgtcaaaggacggttttcaaagtacgggtatgtctatcagcactatttaagtcaaacggaggataactatgttacaggaactgtttaaggcacatagtgtttcctacacactaccttcaattgtgggaagcgttgtcgcatcaatcattttagggctgctggttgcaacagtctacatgtatcgcaatacttattcaaaaaactttgttattacattggcaacactgccccttttagttcaattaatcattatgctggttaatatgaatggtaaccttggaacaggcatggctgttttgggcgcttttagcttaattagatttagatcggtagccggaaattcacgtgatattgcgaccatcttttgggcaatgggtgttggactcgcagctggtatgggatatattttttacgccattttcttctcggttgtcgtaaccatttacctattaatattaaattcctcatcatttggcaatcggggacacactgccgagcgtgaattaaaaattaccattccggaagatctggactttcctggactttttgatgatttattaaagaaatatggttatgatttttcgtatgattcagttaaaacaaccaccatgggttcagtctatgagctgtcttactatatcaaactcaaagacgtcaaggatgaaaaacatttaattgatgaaatcagagttagaaatggcaatatgccggttgtttcaagcaaattatcatcacaaacaaatgaattatagattaataaaaaataggtcatttgtttaggaattccaactcaaaaaagatcgggcaacttttaattgtccgatcttttattgttcaaacggttaatctccagtatacccaaaatggttgtccaaggtttgaatgcgttgtgtgacaactttttgaagtgccggtaaaccttgtgtgtattgattaatctctaatggattaatatcttgatcataggtgtagttatcataaccaaccttagacataaaatcaacgtactgattattaatcgtgtcagcactaatcacgtcactctttcgcagttgatcatatcgagctgttatttgaggaccaaatagctgtgcaactcgtctcaataatgtattgtgagatgggaaaagtccgccccgagcagcattatagtacattgcgtaaggttcattaatgccaagcccaaagatatagtttcctaacgtcaaatcgttatcataagcggtcatccgccaagttttaccgccatcgtaagaaaggtaagtggcattctttgcaatttgatcataagcccccaatatattcacaaataaatagtagtcaatgatactatcgatatttgcataatggctaagaccttctttaaacgcttggtctgaggagttactgacgaaggtaatgaagtcattcaaattgttcttggcactatcactgattgtgtcggagctctcagaactaaaatcggtatcatccactttggcatttcccttatcaaacatttcagcgggggcactgttaacattcccctggatagcaacttgatcggggttcttcttatccatcccccaaaggtcgccacttttatcagtggttaacgtataaaggccgcgtcccttaccgttaacaaaaaccagcattgggaatccttcgacagatccaaaatttggcgtactcttgagctcttcgggaacattttgttctgaggaaaccatcgacttccaaatacctgcattgactaaatttcgagccattgttggatccgtttcgtttgcctttagttgatacgtgttatcctttttggcatccgcaaataatttaagcttcaatttatctgtaagctgctgatccttgaaaagcttaaccttgtagcttttcttaggcaacagctgggtagaacttcccgaccagttaacttctgcataacccttttcatcttttccggtttttggatcactataatcaaacgtcatcgttgaatgatttgatttatcggcaagaaattcattccctgacagcttcataattggtaatttcgtagaattttccggcactttatcttctgtttttgactgtaagccggttaaatcaaccttaccaccacttttactaatataacctgtcacgtctgaaactaccgaaccaacggcggaaataccagttgagataatgcccattggaaattgtgtattaaattgatcgataatactggttaacccacgactgaaatcacccaatacgtcacttgaacttgtgacatttcccagcatatttaaaaccgtttgcggcagcccgatcgtaagtgcactaatcacattggggcgtccctgaaccattttatccaaggaaccgttaataatgtcattcactgaatcaagtaatgattgagcagagttatcattaccgggataaatgctgcttagatcaacattcttggtaatcgttttgccgttcaaatttggatcatcactatgaacagtaaccgtgacttgattgccttcaacagactgtgtcttaaccggtaaattgtcaacggttgtgtttttggcataatctccggtcgctacaatcgttgattttccaattccagctgtcgtaggtgtcacaccttgccccggctccatgattgaagaactgccaatgtctgcttgtgctgatactggtgtaaacgttaatactgccaacgccagtcctgtaatgccagcccccataaataatcgtttgttcaaagaatacccctccatgtttatatgatgtaaatgatatgtatagcttaccacattgcattgttgaaaatctcatagttatttagctataggcttttaaataaatgtaataattaattgatactggaatcagattatatccgagtaaatgattcttttaattactggaaaagtattaaaaaacaaccttaaattaaacatcttaaagttgctttcttactaaaaaatcaattattatcaattttcagactaatttgctgtcgtaccaccatctacaataaattcactgcccgttgaataagaggattcatccgaagcaaggtaaagtaccatattggcgatttcctgcggctgtgccattcttcttaacggcgtttgattaataatattttctttttgagcttgaggaatacctttcaaaataggtgtttcagtaaccccgggatgaacggaatttacccgaatattaaactgggcaccgtaagtggcggcggactttgtcagcaatctaacaccacccttgcttgctgtgtaggcagctgcattgggatcgcctacgagtccggcaagtgatgacatattgataattgatccaccatgtgcctgcatatttagaataccatgtttagttccaagaaagacaccagtcaggttcacattgatgactttttgccaatcatcaagggacgtatgcgcgatgtcgctcatgattgcgatcccggcattattgacgagaacatcaattttaccgaatttatcaagaacccatgcgaataagtcacgccaattactttcactggatacattcagttgataaaaataggcattatccaatttgtcagtgaaagcttggccggatttttcgttgacatcggccactaccactttggcgccttctttaacgaatctttctgtaatcgcacgaccgattcccatagcaccgccagtcaccaccgcaattttatgatttaaacgacctgacatcataccaactccctttctaaatgaagtttacattgttatcgctttcacattaagacaacatcaccgtatttgcaacgaatttggtcttttacaagcaaacaaccactttaatacaaattgtttgacaccctcatcaatctaatcattccgatctcaagatattaacgaacatcaacataacagctatgcatcagtgaagattttaaaacacctacaaaaacagctatctctcatttaataaagatagctgctcttataattgtatttctatcaaaataatcgtatttgagtcattcaaattctcaattaaaccagataggcttttgtatgccgaaattgttccatggttattttcatcctaccaccacgaacccagccacaattaccaccaaagtgatcgttatcaaaccaaccccagaaatagccttcaccaaaagaatcattccccggtgcatcccagtaaagatgcgaaccacgatgagtcagccctggaatcaccaggcaaatcagaatggtcagggtgacatgacggcattctcattttgggtcccaaatatcggatcatccgtcacctcacttggcagtttctttaacgtataaatccagatagcaggccgatgtcttcgacgctgccaacgcttatttgcctgaacaatctgttgccgctattctgttgacagtaaatgacgttgatcatgaatcatgacttgaggtactgattttgcgtgaactgtcacaattaacccaaataataccattaacaagtgttgcaatccctttttaccaatgccctcatgcccaagaaattgatgccttgattatgtcactctttatatatcagagaatagtgcgatttaactcaaaaaatcagtaatcgtgattaattaaaaaccaaacccactactgttcttcaggacttctgaacttaaatactggtgtaataaagaatgacaagaccgttacccgacacatcaatcttaatctatggtacttggaataaaagatatgttagtcatccctgtattcaaataagatggtctaacatatctttttagttggcactttttggtcaagtacgatttttacttaacaaccgttgtttctttttccaaacgctgtcgaactgcaacgtaatcagcttaacaagtacaccatctaggatgatactggaaacaattcgggtcattagtagcagtaacaacataaccaccccatagtgattgtatccggaaacaaagtagtcccagataaaacttaaaactgccgccccgattgcacctaaaatacaactcaaccatgtaaaagttttgtagttattggggaagaaaccaaactcgtttccggcaccttgaacaatgccataagcaagggttaacgcccccccattgcccacccagaaacatttccacgagtgcagccaatgtttcaccaatcgtcgctgatccaattgcgggtacaaaatagatacttaatggcgcagcgataaaccaaagacctgcaaaaacattgtccacaaacgggcttagtcccgttggccctactaataccttacaaacgttataaagtgaattcacgccgtattgatagacaaccccacaaacaattccaataagtgtgacgagaataatctgctgaatgtgccagtgtcctgatcgagtcataataaaccactcccgtcatttttaaatgccaatttgtcaaaatcatcccaagttaattgcctgcttgcagcatcccaaaaataccattccaataaacaactacgtaaaaattgctttctgacataggttaattgtgcttgatcagctttttcagcttctcgatcaattatcgccaagaaccgcttggaaataccaccaagccctgccaagtctggatcttgaacatcttggacccaagtataaaaattattaccgcttttaattttgccagtagcttcaagatattttccaagttcaatgtacatccagattcccgcttcaaatggcgccaacacattcaataacgaaccttcgcgcgcttgagacaaaatgtgttcacgatacaaaaaggtaactggttgaatcgtttggtcgcgttggttaggccaatcatgctcaacgtttttggttaatgcctcaaacaaatcgctaaccgttcgcaaatgggcacttaactgatccgcaaagagacgttgatcttcaattgttttgcttttagtaattaattgggtctgaacaattgtttcagcgtccgcatatcgtaaatcctgttgaatatagtagttcaaaacatcaggagatagtcgattgctgataacatcctggataaaagaattttgtttatttgcttccaaataaggttgtgcatctttaattaaagactgagaaaatgacatttttaatccccccgagtgatcttagcagttggaactggcaaacctaaattatcacgtaaagtatgaccggtataatcttttctgaataaccctcttttttgcaggattgggacgacgtaatgaataaaatcggccaatgattctggataagtcggcgccatgatattaaatccatcggctgcaccgctttcaaaccaattttgcatcatatccgctacttcttccggacttcccacaactgttgcgtgtccgcctccagcagctaaacgttgaaaaagttgtctggcagttggcttttcagtgtcaataatccgcttgataacctcataacgtcctttagggcctgaaaattccgaaatatcaggtaattctgggaccggagcatccaaatcccatcgtttaacatcctggcccaaaaaatcaccaagttgggcaactgaatcatcaaggggcagaagctcatccaattcggactgccttcgttgcgcttcttcatgagtactcccaacatagggaaccagccctggcaggatagccggtattccggatgagcgtttaaactcagccgcacgttttttgatatcttgataataagcttgtgactcacgaatatcccaggcaaccgaataaatagcttcggcatattttgcaccaagatttttaccttggtgtgaagcgcctgcttgaaaaatgacaggtcttccttgtggtcctgaaggaatgttaagcgggcctttaacatcaaaaaagtcaccatgatggttaatctcatgaatcagggatgaatctaaccaacgatcgtgttcggcatcattgataattgcactagcaggaaatgaatcccaaagctcgatcatggtatgaataaattcatcggcacgcaggtaacggtcagcatgatttggcaactttgacaagccatgattttgggcttcttcatcaaacatcgacgtaatcacgtttacgcccgctcgaccatgactgatatggtcaagactacaaattaatcggaccatattatacggatcatacagcgtcgacgagatagttggcacaagaccaatatgatgtgtctttcgagccattgcagtgacacaggtaattggttccaaaaaataagaaacgcctccgtaataaccacccataatcgattgaccatctgcaaaaaagatggtgtcaaacttcccgccttctgctaactgtgcaagcttctcaaaatagtcaatttgaccaacttgactaacagtagatccggagcgtcgccaagcagcgccatgatgacctgaactaaataacaacgcacctaaatgcatttgtctactcataatgttatttccctccaatttagatttaaacaagtaaatcagaaatccgttaacgtctgtcatgatcacctcgctattcatcttgttggggggcattatcgcattacgagcattaaaaaagtccactttcaaaaaaacaaaaagtggactttcagtcgtttactcatcaaaaaatgctgaaaatggtctcccttcggcagtactaactgcatcaggttccatgggtttgtctcagcttagttaaaagcaccccagaccacaaaatgatatttaatttttcgtacatattcatttaaagggagattataataaatgtcaagattaattgtggccaagaatacataaggaggcttccagatgctcaacaaaacagataaacgtctagtcgttcaaatcattaaaaagtccccggatttaatgaacattttgaaagtaattgcacaactgaacctaccacaaggcgcacttgcggctggaagtatccgaaataccgtctggcaagtgttaagccatcagcctatagaactgattaatgacgttgatgttgtctatttcgacccacgacgaccaaggaatgatgaccaaataatacaagcatctttaattaaaaggatgcctgattaccagtggcaagtaaaaaatgaagcttacatgcattattacgattttaaggacgcctcaaaattcacgtctatagaggatgcaatttcacactttgtcgaaacaccaacgtgtattggtgcataccttaagggcaacgacattgaaatcattgcaccttacggcctgacagatttaattcaattaaagtgtcggccaattccgatgtttcaaaataacaaaacgtgcttatccatttatcaaaatcgtattcaaagaaagaattggaagaagcgatggccaaatttggcaattattaatagttagccgaagtacatgcgtttaaaaacatgtgctttttatttgtactttattaaaaacaaaaagcaatttttttaaacataatgactcattattcaatcttttacgatctcttatttacccaagtcaattaattatccgcaattcaaggatagataaataatgatgccaatttaacggcatcatttctttttactataatcattttgttaactaccctatgcctaggatttcgttagttcaaaataatggcgactatctttcgatttatcaaaaaatctcttctagtataggaaatgaattaaaccaatcttatttttgctctcctcaaattcataactaagaatatatataacaagctgacattgatctcatattctttattgaaaatattaataataattgataagcgatatacagtcatcgaaaaataggcattgattatcgtttttcgataatttataatcaaagcacagaaaagaggagatgcttcacatgccaaaacttttaaatcgcgcattacttgtcgtgtcatttctggcacaaatatcatttgttatttcttggattggtttctgcatcccggtgtattttatctatcaggccttaaagggtaacgttgtatctaacattctggataataacgattttcaggtgatctcaaatcatgcccacgtttcgctcacagacatcaaccactttccggcgtacatatacactgccttagtgtcaatcggtgttatcttagcgataattgctgttctgtacgaattaaaagcacttgttaagattacggttaaccttaatcaaaaaaggtactttaccactgaaaatgttaaactggtttggttatttattgtgtctcagctttataccctggcagcagatccgtttcttgcaggtgccaatcaactgacaagaacctatttagaccgtattaaaattggtgatttctccgtgacatggagcgacattcccgaagatttagtgggacttgttattattagtgtgatctacattctatttaaaatggctgaacaaatgaaacgggaaaacgagctgactgtctaaagacgcttaaaggatgtgattgaattttgattaaaattaccctaaacgttgtcatggcgcaacgaaacatttccactggtgaattagccaaaatggttggtattacgccaactaacatttcgattttaaaaactggcaaggcaaaagcaattcgcttcagtacgctggaaaaaatttgtaaagtgctaaagtgtcagccaggggatatcttagaatacgttgacgaagaaagtaaccctaccacaaatttgagtgatttttgaatagcacttttttcaaacacaatcacttcttcaaagaatgcgtcatttgtagctatatactaaaggggttgaaacagaagtcaaaaacattagataattgactttctatcccaaaagacaaagctcctgtaacgtcagcttgcggaaatactgacgttacaggagcttttcaaataacttttttggtcttctatcccggtgttttggtctataaccgattaatcaaagaagtcgttatctatttcatacaacttatagtcgctctttacttgaacacccacctcgtattccaacattaagtcagtaagctcgataccgtccactaacacaattcgaaaattctccgcgtactcacgtgccaaacgactaaaatccgacgttgtgatgaaaacaccgctttcggctcctttacctttaatcgctccgtaaaaagattggatttgagggcgttgaacccgattatccttagcatatcgttttgcttgtacgtaaacagtattagtccctaatgggtcttggttaataatcccgtcaatgccatcatccccacttgcaggtgtcacagttgcactgccattaggacctttataccccattttggatagtaacctgacaaccagatgttcaaagaagatggggtcgctgttcataatctgacgaagcagttccgttttaacctcaatattgtacttatcagacttgtctgccaaaacttcggaaacgtctgccgtatcttctacatcatcaattgtatccattgagatttcacctttacgttttcgacgttccgcaacttctttttggtgctcttgaaacattggtaaatttgatacttcagcaagggttaaattcatcccccgttcggcaagaagccttttacctagagttgtaattcgataaattccttgttgaggacgttcaatcgctccactaattgccaaatcacttaatgcccagccaatcctattttcaataattatatttttaggattttttgtagagttacggtagcggactttatcaggtaacttaaagtcatctgccacttttttcctcaactcaactcgatgccaactatccctttcattcacaaccgtcagtgtcattgcgacagttttatcccagtctggcatcccggaaatgttttgattaacgaccatattaaccaccttaactattttctttactttaatctaagtatatcattgcttttccaattaatttaacgccaatttctttataattctgatctcttcagtcatttaaaaatggtattttgcttaaaattagttatattaataattctagtttttgcaattccatttaaattgtctacaatgaaagtaagctttcataacatcgtttatagaaaggatgacgcaatatggctcaaaaagcttctgaacaattagtcgacgttttaattgattggcatgtaaaacacgtttatggactaccgggggattccatcgatacaactgtcgatgctttacgcaaacaacaggatcagatcggatttgtccaagtccgtcacgaagaagttgcttccttggcagcagcggccgaggctaagttaaccggtaagcttggtgtctgtctttcaatcggtgggccaggtgcaattcatatgttaaatggcctttatgatgccaaaatggatcacgtgccagtactggctttacttggtcaggttgatacccagtttttaaacgaggaatacttccaagaagtgaatacaccacaactatttgcggacgttgcggtctataataaactaatttctgccactgacaatttagctgaaatcgttgatgaagccattcgaacggcttatgagaaacatggagtcgcagttttaaccattccggataaccttccggaacaaagggtcagcgaccactatatcagttccgcttcttctttccaattgacatcaccacaaatagatgacaatcgccttaatacagccgctaaactgattcgtgattccaaaaaaccgcttgcattggttggcttgggggcaaaaaaagccggcagccaggttgcggccttcttagagcaaaaccatattccgtttatttcaacgttgcccgcaaaggggatcattggcgacaatcatcctaattcgctgggaaatgttggtaagttggggacaaagccggcttatgaagccatgcaaaataccgatctacttctaatgttcggcacaaattatccctataccgcgtacttgcccaaaccaggggcggccaaaagcatccaaatcaataccagtgcgtcagcaatcggaaaacgttatccggctgatgttggattggtagccgatatcaaagacgttataaagcaacttaattcttctgaaacaacgatcctccatcctgatgatggtttcttaaaggcctgtcaggaaagtgttgctaactggaatcgttggatgaccggcaaacgtgaactcgattccaagccagttgcacccgaagcattatttaacgatattaatgaaacggcaccgcttaatacaatttattcaattgatgttggaacagccacctcttggagcgcccgtttcttaaacgtatcaccaacacaaaaatttatcttgtcctcttacttagggacaatgggatgtgcattaccgggagcgattgcagcaaaaataaattatcccgatcgaccggttatctcggttaatggtgatggtgcgtttgcaatggtcatgcaggatttcattacggcagttaaatacaagttaccattaattaatatcgtactcaataattcaaagctggcctttattgaatacgaacaacaggccgccggccaattaaattatcaaatcgacttacaggatatggattacgccaaatttgccgatgcggctggcggtgttggcattactgctaaaacttccgaagaatttaagaacgcattgaacagagcctatcgggtccagaatatgccggtactgatcaatgcttatgtcagtgatgatgcacctttgccgggcaagattgtcggtcaggaagctaaaggatacatgaaatttggcagccaatatcttaaagaagagaaaaaaataccagaactaccaccactaaaagatattttgcgccaatttttctaagcaaaacaattagaccaccgatttcaaaggaaaaaatctcagtcactacttgaagtggcttttaacaaaagcctttcggcaccaacagatatattgcataatgatttgttggtgctgaaaggttttttgatctaaaactcaggattcacctagaatttattgataaatgatacctgaaaaggttaatttgaaatcttcgtttttgacagttttaagatagccgtgataatctttaattaatatatgatatttgtttcttttctaataatgacctaaatattatatatagttgagacatgaatgcttttaactatatccagcttgtcagtctccagtcatttcattgatacttggacttaggtcagtaacaaataaccatcatcacgttaggaggaatttatcatgggctttatttgggcaattattgtcggtgccgtcatcggtgccttggcgggcgcaattacgaacaacggccaatcgatgggctggatcgctaatattgtagctggcttagtcggctcagccatcggtcaggcactactaggttcttggggaccgagtttggccggaatggcacttattccgtcaattatcggtgccgttattttagttctgattgtttcctttgttgttaaacgatcctagaaagcaggtgagtaactatggatgcattaaaagctgtttttaaatttatgatcgccagtaccctcattgtgagcggtgtcttattgggtggtacacttttcgcaacaaaaaagattgatattttcggtgataagcttcagaataaaatttatggttcaaagtcaaattaaaaatttgggatttaacaaaatgtttattcaataccctttattgaaataaaaaagctatccgttttttccgggtagcttttttattattttaagtcaaaacaatatatgattgatcatcaaaaatatccacgaaacctatttctataaataagatcagaatctgttggacttgcttcaatagttcctcaaaagcccttgaccggctcgtatcagtttcataggatatttgtaaaataaagtcggttagttcttcgataccaaaatgactgcccctaccaatatgacacataaaatacgatgcaaatcccaaaatatattttccgatctttgggttagttgtaaaactcatgcgatcaaaatgctgatccaaataatttaacccctcttcagctttgggcatttgaacttcccgataatgttttaaccacagtcgttgatctttggatcgcccgttctgatgttcttgggttggccgtggcgctttttgattcccttgccgaaaaatataggatgtcttttcgcgcttatcaatttgaagtgggacaacccacttttgccgcttccgtttcatcttcatggatgatctccggttttcgcaatcctgtatgattttcctataaggaaccaagccaatgtcgataaacgataaaaattccttaccataacgaatggcatttcctgaccggcggacaaactcaatcagttcgtcacttggcttatcagcagataaaaatgtgttaactaaaatttcgtcaatgccggtattgatctcttgtaggcccttcgctacctgctttgcgacattttccggcacgcccatgtgttcttggaaatggttaatgccaagcttttgcgtctgcttagtcctttggtcttgaatgatatattgatatttcagtgttcgaccgcatctgcatgtgagtttcccagaaacatttggatctaccttaaaatcatataattgccatttctcaccatcggataaactggcatttaaaaaattactctgcatccgatatcttcgatgcttaatcaaaaaaagacgttgcggttcagttagtttatttgccagaaagtttctcttttcactggtcaaatggattagctgatttgttttcattttggatcctttcaaaatattttccacttgaatgtatcatagattgattgtgttgtacactacttttttgaccatagttatattggtaaaaattcaatcctatcaggcattatttcaaaaatatgtttttggatttgacacctttttagtactgcccttcaaaacagcaccgctccttataaggaatagattcgaaaaactccaagccaggatttccaaaatcgacgtcttatacctcgggtgctaaccgttttgatccgcacatttgactcttatagccaacccttgtattttctgtgagaatctcattttaattttatttatgaacactaaccccacccgaccattttgattacactgaatataatcaagaacaatcgaggtggcatttatgcaacttacaaagcgtcttcaattcaatttacttcaaatgccggaaaattcgattttcttttggcttaccagaatcatcatgacgggacttggaagttggatcgcccttatcctttctcaaatgatttcccagtcagcaacattcttaattacagtagtaattttggtgcaattaagtcaacgaaccaagaatcacgttaacgcccattcaccgatatattggttgttagtcgggctgacagccgttgctggaacaacacttgccaatatcctgaatattgactttggcattagcagccttttcttcgtctgcgggtatgttgccaaaatctattcggtttattatttaaagcaccatttgattatcactcaaaaactatcacactttttattgtttgaaagcagattaatctattggttggatcttggttttgactttacctttgaatccgctattgcttcctggtttagcaatagtctcaatttaacagccctgggcacgttacttactgcagatttaccaacactttttaccgttattcgtcaccaattcaacacaattggactcgaatgatggttttgactattaaatcacgttttatgcgttaagctagaagataataagttatattgctaaacaatatccttaaagggggaaatgctatggcgaacacaattctattagtcgaagatgaagaaggattaagctcctatctcacaactgagttacaattcgaaaattacacaattattctagccacagatggtaagcaagctttggacacgtatgaaagtatgcgggggcaacttaatttaattattctggattggatgcttcccaagctggacggactggaagttttaagacgcattcggcaaaatgacgacatccccattttaatgatgactgctcgtgattatgtcggtgacaaagtagccggccttgatgccggtgcggacgattacatcacaaaaccgtttgaaatcgaagaattattggctcgaatccgggtgatgttgcgccactctcaaaatcaagcgacaagtgatgatcttttccgtatcgaagacctgactttaaatacaaaatcaagacaggttactcgtggtaattcgctcattcaactcacacaacgcgaatacgaactattactcacattaattaagaatgccggtgaaaccatgacccgcgacgaactccttaatttggtttggggcgtcgactttgagggtcagcctaacgtggtcgacgtttacattcgctacctaagaaataaggtcgaccgaaactttaaaaaaacactgatccataccgtccgtggtgtcggttatgtcttaagtgccaattatcaaggttagaggggtaaaaatgaaacgtaaaaagcctcaaatgacgaccacctcacaggaaattcagcatagttttcgagtcttgtttatttggtttgcctttctaatgagcttggcagttgtcggtgttgttggtgtccagcttgtccaccagcgccaagcagaatccattgagttattgggcagtcttaaacgatccattatcgatgaccggcctgattgggaacagtggcgaaaaaacagcacaatcaacacacagaatacttacgttaaggttaatgaccgcacccgaaacatcccgacaaagttttattcacatggcacaaaaacatttttaaaagcaaaacaaatccatttaccgtttttccgcgcactaacctatgttgacggctatggtttcatgtattacagatcaggaagtaaacttggaattatgtctcaaatctggttaagcttaaatccggttgttaacgtcttgttatcagtaattatcgttgttttcagcctttttctactaagtttattattcggttggtacttcatttcatccaccgctaaacgactgacgcaaccaattagccagttgagtcagactgcgcgagaccaaagtaagtccgagctggaatatgaaacacttttaccggtgccaaaaacacccatggaagtcaaacagctaacaaccagttttaacgaactactcacttccattaatcataaaaaccagcaggaaaaaacgtttatttcaaacgccgcacacgaactccgcacaccgattgcggcaatcaggggacatatccagcttgtccagcgtcatggcagggaccatccggaaattgttgatcgttccattcaatttatcaacaacgaatctgccagaatgcaaacattggttaatgatttattagcactttcacgggctgatcgcggagacgtcaaattggattacattgacctgaccagccttttaaacgaaactgttgaagaacagcgtgcggtgttaaaacagactattaacgtgaatattccaacaaaagccgttgtttatgccaatgctgacaacgttcaacagattttatccgcattgttggataatgccggtaaatattcacctgctgactcacaaatcacagtggtcttgtctcaacatggctcacaatatagtctctccgttcaaaataccggaccacgtattcccgataaccaaaaagaccaaattttcgaacgcttctaccgcggtgatcaggctcacaaccatcaggtatcaggaaccggattaggcttgtcaatcgttaagcaacttgctgaattaaatcatatccagataaccgttacagacttaaaaccacagggtagtcgtttcaatctcctttttaacaaccctgaaaatcaaaattaacgcgacttattaaaaaatggcaccaaagcaatcaaattttgcttggcgccattttttaaatgactgtttagtcaatagaaattgtactctcaaacatgataacagattttgtgattatccttgtcgtgtcggtcgcaacacaatttcattaatggtcgtgtctgcaggcaaatcaacggctgacaggatggccgaagctactcgctgtggggacgaggcaaattgatcatagtaggcattcattgcttttttctgatcgggatcggtcacgtgattcaccaactctgtcgcaattgctcccggcgaaaccacagtgacacgaacgttactacctgccgctgcttcttcctgtcgcaatgcctcgctgatcatccaaacgccggccttggttgcactatagacacctccaccgggatgaacgctgtgggcggcgactgatgcaatattaatgaattgacctgctttttgttttctcatcgttggcaatgctgaattaatgccatacaagacaccgcgtaaattaacatcaatcatccggttccaatcatcaaccctgcctttaataaactcggaatgaggcattagtccggcattgttcatccatacatcgattcgaccatattgctttaatgccaaatcagccaaagattgaacactttttaaatcggtcacgtcaaccggtgcatatattgattgaccaccatccgagttaattgaatctgtaatttcctctagtttcttctctcgacgtgctcccagaaccaaccggtgtccctttttagctaataatttagctgttgcttcaccgattccactggatgcaccagtgatgacgatgactttactttttgttgtcattatttttctcctcgtaaactaatttttctttttcgtaatttaacgtatgatcctcaaaatgatcgattttgaagcttaaataagcaactgtttttttgatttcagtcattttatcgattaattcccgtcgctgatcaattaataatgtttttctagcttcagaattttgctgaccatcacgatatagtttaacaaattcaattagtgcttcaattgacatgccggcttttcttaatgctttaacgtaaaagacccaattcatatcatattcactatagtcccgataaccacttccattccgctggatctccggtaataaccccagtcgctcccaataccgaagtgtatccttggtcaaatcaaatttctgactcacttgattaatcgtcgccactttgatttttactcccttcacttcaaccttattaccagtctaaaccttggtctgtacttcaaggcaagcattactacaaagaatctcacaaattaaaaataattttctaaaccataaatcaaatctgtgaaaatctcatctggctcttttttcccgcctatttcgactaggcgggattttttttattataaagacaatgatctaaccggttatttatcgacatcatccctacaaaaggaaggcacttctatgacacttatttcactcgttgttccctgctataacgaacaggcaagtatccccattttttacaaaaccgttgaaaaaattttgacccaatttgccaatcattccggtcattatcagtgggaatactggttcataaacgatggctctactgataaaacgcttgatgaactggaaattctaaacacaaaggatcccaaccgagttcattacattgacttcacccgtaattttggcaaagaagcagccctccttgccggttttacccaagctgacggccaatacatcggcgttatggacgtcgatttgcaggatccaccggaacttctgccaaagatgatcgaactgttagataccaccgataatgatgtcattgccacccaaaggaccggtcggaatggtgaacctagaattcgttcctggtgttcagacagattttacagccttattaacaaaatttcaaaagtaaaaatgcgctccggtgtccgtgattatcgacttatgcgacgttcagtcgtaactgcaatcatttctcttcctgaatacaatcgattttccaaggggatttttagctgggtcggttttaaaacaaaatacctgacattcccccaccatgatcgggttgccggaaaaacacactggtcatttagccaattagtgagttactcattagatggcattatggacttttcagccgttccactcgcaatcgcttcttggattggcattatttcattcatactagctatttttggactgatttttatcgttgttcgcgccttaatctatggggaccccacaattggctggccctccttggtcacaattatcctaatggttggcggcatccaacttctgtgtttgggcattattggcaaatacatcagtaaaatctatttggaaaccaagcaccgaccactgtacctgattaaaaaagaacgttgaggtgattcgtatgcaaaaaaaatataattataacacacagattttgattagctggtggggactttttgcaattgtcgccttcatggttaagcaacagtcttcccatctttttaatattgatcaactcggattaattgatattcatcgctttttacaaccttcacaactgactgcttttaaatggattacccttaccggaagcccgattgtgacaactcttggcgcccttattctctcagggtggctgctccatcgaaaacaacctcttttttcactgatcacattaacaacagtaattggcggtgatcttttggaattatgtgtaaaggaacttattcaaaggccacgaccggctttcgagctggtcagagcaacaggttacagctttccaagcggccatgtctttggcacaacaatgttggcagttttaatttggcatttcgttatttcaaaaacaaatcggggtcaacatcaattctttttattatttctattaatctattgggttggtttagtggccatttcaagagtttacctacaggttcattttccttcggacgttttaggtgggttcatcctagcacaagcttggtggcaaactgttaacatcagttatttacgacacgaacagcaaattgcgtctaccatcaatcaattaacgggttcagatcctaaaaaaacgaggtaagaactatgcttacgaaatttcgtcaaagtattggagtaacaacggccatatccggggtatttgcgctgctcatcataaccggggtcatgattgcttaccaaattacgccatttggtcgccaaaacttactttttagtgataacgcagcccaatacgtcacgtttctgaccgcacttcggcatgcacttgtcacacaccaatttagtctatactcattcgggcttagtcttggcagtaatgccgtgccaacactcgcatactacctcatgagtccatttaatctgggacttgttttcttcccagctgctcaagtgccatcagcgatcacattgatgattattttaaaagtcgcttgtatttctgcggcaatggcttattttctacaacgccattttgaaattgtcagcggatgggcagttttgtttggagctgcttttggattatgcggcttcgttgctgccgactattttgatatcatgtggttggatagtctgatttgtctcccactcattattaatgggctggatacaattgttcggggtggcaaaccgacacgcttttttgtctggctgctcttcggcgtcattgttaattactatttaggatatatgatctgtatttttatcgtctgttataccgtttatatcatctatgaagacggtcatggtcaattatcattcagccaattattaaatcaaaacaaggaccatttgttaacgatcgttttttcaggtctcttcagtctcatgagtgcaatggtcattctggtgccaacaattattggcatgatgcagactgccaaacatgcctatgtttccgcaaattttacgttcagatccatgttcagttttcccgtgctcgctcaactggggatcggtggtgtaagttatggcaaccatttaatccacgcacctgctattttcagctcattaattgtcacgcttttagtgggatgttattttgtccatcctaatatcagcagatcttcaaagtggcacgctgccatctttttgcttggtttgctgttaagcatgaaggtctgtatcacaaatacaatctggcatctgtttcagcaaccgtccggatttccgtttcgacaagcttttttctttagttttatgatgataaccatctcatacggtgcttggttgaagaacgccaaattggtttctcgtcactggaaagtcgccttaccagcaattattatggggtgcttaatccttggaacgtttgggccccactttttaatgatgtcatctgcttcaaatcggctttccagcacgcaattgggcattttgacgcttaatataagtgttattgtacttggatctctcattatttttaccactggtcgacttcttcagtcttgcttgatgattgggctgtttgcaggagagcttagtggtaatttcctgatagctatggccggctcaccttttggtaatcaaatccaatatcaacaacgttaccaacgggaagccgccatactcaaaccgattacgaaagattcaggacaactttatcgaaccaataatcaaagccgactcattaataacagttttcagagatattataactataatgatgcgcttttatttaattatcgggggatttcagaatataattcaacgattaacgatactacccgaagaacattaaattcactgggacttttcagcaaaaatgttcgtagaatcagtgctcaaggattaaatccggttactgaaatgctcttgggcgttaaatataatgttagcccatccaatcgattgacccaaaataccagctatgtcggaatgggatttcctacaagtaagtccctgacgacaattcagctgcatccaactgataaattcacgaacctcgaaaaaatattggtctcaattaataagggagaggccccttatttctatcccgtcagaaaaacccgtgttcaacttatacgaaacaagtccaagcagactaattaccgatatcatttacaaatgaccgttaacacaaccggccccttatatctcaatgcgcggcttcgtggtacaaattacaccactattacggtaaatggcaaacacattgccagtcccaaggttcctgccaatcgatttcgatttttggatcggctggggtcatacaccaaaggaacgaaactttcagttgctcttacgtcagccattccttatcctgaagcgttacaatttgaaagtatgaaccagtggaaattcaaaaagcttgttgcatcattacaatttccgggttatgtgccaaagattcaaggaaatcaaataagcggtgacatcatcgccaaccgacatcaaagatcggcttttctatcgatcccgtttgataagggctggcaaatcaaagtgaatggtcacccaaccgcacccgggaaagtgcttaatggattgatggctgttccgataaagagtggacttaattatattgttttaacctaccacacaccgggattaatcatcggatcaatattttctatattggggctggtatcatttatttgccttagtatggtattaaaattgaaagaacccttgaaacaccgtaaaagatcttgaggatttcattaaaaatagtcactaatatctaaaaaaatcggtatgctggacaatttgaagctgtctagtataccgattagtgtttaaacgttatttttaaacctcaaaacccggggaatgcaaggtcctccaactaataaacagggcgatttttgccttgcgttgcggggtcggccaagcccaagctatcattgacacccaatgatggatcagtgaacattttcaacactaaatcagcgacacttttacgggaacctgataccccgacaaattgatcattcttatgcgtgatttggtacgaaacttcatcacggtcagtcagccaaggtaaacgcaatgtcgtataggccaaacccgattggcttaacaacgtatctgactgagttgcggccgccaagccgcttttgaccattgaccgattccaacgaccaaattctcccggtacttcatcataaatacctaaaatattggttgaaataatacggctgacgttatgtgctttcattgccgaaataatatttctggtcattttattatcaggatcatgatcaacgactgccgtaaaaatcatatcctgacccgcaactgcttggctaaccgattcttgattctccatgtccacatcaagaaggcggactcgggggttgtttgccaaatcagctaatcgttttggctgacgcaaacccaacgtcaacgagatatccttgaatttatcttcggaaagaagtcttttttcaacaattctggcaatttgaccattagcagctaatataagtaaattcattaataatttccttccttattatcaaattgttccgtaatacttaactaaaaacaactatttaatccggcgacccacgattttcatttgtgcttccggatcccgatgatcaaagaactggctttcttgtttatccagtttctgaatcatcgtcatttcttcatctgtgagttcaaaatcaaaaatgttgatattttcaaccattcgatttttatgaaccgacttggggattgtgacaattccacgttgcagtaaccatctcagaataacctgaccaattgacttattgtacctatgaccgatttgagccaaaaccgaattttgaaaaatgtcgtgtttaccttccgcaaacggtgcccaggcttccggctgaatctgattatcctgcataaagctaaccggtttaagctgttggttccaaggattgacctcaatctgattaacagccggcttaacatcattaaaaattgcaatgtccgttaattgatcaggctcaaaattcgaaacaccgatggcccgaatcttaccctctcgatacagatcttccatcgcccgccaggatccatgaacatcgccccacggttgatgaatgaggtaaagatcaatgtaatcaagttgcagtcgttttaatgatgcttgaaaggctttcttggtcgcatcataacctgtatcagtcagccaaagtttagttgtaataaacagttcttttcgatcaatgccactttgcttaatggcccggccaaccgcttcctcgttaccgtatgcctgtgctgtgtcaattaatcgataccctgattttattgcatcaagaactgcccgttgtgcaacagccaaatctgttacctgaaaggccccgaaaccaagtataggcatctcaacgccattgtttagtctaaccattttcatcatgaactgattgcctcctcatattttttaacaagatcagtgtaaaccttggtgtggactccaaggcaagccatattattttttaaatgacattttttataagatacgccccatcaattgtttaactgccaggttaaaaatcaaaactttaagggtataaaaaaacgggccacttttccttcgaagaaaacagcccggcacaatgctcaattatttattaaacaaacctatctgtttagttatcattacttctatctggcaaaaacggcatcaataaatttgccaacccctcaatacttcgagtttgaatcaaaacggttccagtacccttaaagtggttaaccaatccttcaccggtcttaaaaccaaatgtgccgctgccgacttcaatgttatagtccaagctttgactccaagcaacaacattactgttgtcaacaacgtattcatcatttccctgcaactcgacggacataatatcagcatatcccgaaaccagaaaagtaccactaccctgcgtctccatgacaaacaacccgccggttccgccaaagacagcgcttcccagcttttgtcgaatcattttataactggtcccttcatcggaagccaagtatgcgctggtattgagacgccactgatgagactcatccgtacgcaattcccgaatggccccaggattggcaggcgcaatcagcaattcaccgtcgtctgtgttgcctgtggcagttgtaataaagaatccctcaccactggttacagaacgacccagcgcgcttaatacacccccgaagccttttttaccattgctgttcatatgcccttccaaagtcacttgaccattatgggcaatcattgatccgcgttcaatttgaatctgctcgcccttgcgcagtttgagtgtcactgtgggaaacgcagtatcttttgaaattgtaaaatccatgattcttcatcccctaaccaaatttgactccagtataacagaggatcagtcgaaattaatgcttaattgactgaaaagatcagctgtacaacaaaagccaatatcaacctgaatgatatcaaaaccgacttgataatggctatccaccaatcaattatcatataattaaacaaaaccagaaagtgatggaagtatctatgcaaatcataccactcgaatgccatcgtcaatcggccattcaattatttcaaaatctatggggagcaaccaacatggttgtttcgacgggacaatatgatattaaagatttaaaaggctttattgcaatgaaaaatgaccaaatcatcggtttattaagctatgaattaaaagcggattatcttgaaattatttctattgacagtctaaggccgggaatcggtatcggttctcaactattaaatatggttgaaaagctggcatacgaaaaacagttgaccaaacttgaggttatcacgacaaacgataatctaaatgcgcttggtttttatcaaaaaagagggtttcggctaacggaagtgatccccgacgcagttagactggcccgaaaaatcaagccggagattccgctaaaagcagataacggcatcccgattgttgatgagttaaaactggtgaaacagcttatggaccgacaacgataattaattttctttaaccaaccaagcccacattccaggcatttttgacaatccgcctgcacatttttgcctatttaagtgccagtgccaaggtttttgatggttgaactcaaccgatttatttttgaaagctggttatcttttaataattttcatgaaccgttaatcctattaatggctggatatggtaagataattcctgttatgaaaaaggaaaatttaattttaactatttcaacaattgctcttgggctttttgttggtatgagttcactttttttgagtttgtttttaacttttattgaggaaggatttcttcattttaaagaaacgccacttcgaccaattatcacgggaagcccaaacgatgccagactgttctcggtttttatcggtggtatcattgcagcagtcatttggtggatattaaggacaaaagtaaaaccacccgtaacaatcggaaaagggttggctggtgaaaatatgcctgctgttcaaactattcttcacgttatgacccagatcttttacgtaggaactggtggctctattggtcgggaactggcacctcgagaagccggtgccatgattgcccagaagtggaataacctacttaacaggctgcattggggccgtttatctaaggatgacgttgctttgttaattgcttcagctgcaggtgccggttttgccggcgtttataacgctcctatgacggggatgttcttttgtgttgaagttttatttaagaaaatatcaatccggtccgtttgcgttagcctaccaatgtcagtgattgccgcgcttgttagttccagtgtccgaggaacagaaccttactatttagtcggcaaggcccagtttgaacccaaattcttatggattgctatttttatttcccttctttgcggcattgttggcgcgcttttccgaaaatcttttacatgggctgaaagtgtaaaaccggacaattaccatattttatggcaactgccactactttcttttatcaccggtttaatttcaattaatttcccccagataatgggaaatggtcgagcccttgcccaattttcgatcagcgctacgggtagaaatttcctgcttgtgttgttactgggagccgttgcaaagtatgccgtaaccgtctttacaattcgggctggtgcttttggagggactttaacgccttctgttgcaattggagccgctattggtgcattcataggtatcttcatctttccatacgtcggcatgccaatttggcagtgtgcactgcttggcggctgtagtctattagccgcttcccagcaggctcctttgatggcattattcatggtttttgaagtctgccatctgaactctatggcactaatcccacttggaatgggcgtcgcaatttcagttgcaatctcaagagttgttttaagaaaagttatgtaaattaatgtgtttacacgtaaaccatctaaataccgccattgtttttgacgttgattagtcaaaaataatggcggctttttattcactaacaaaataaatctgatcatgtttcatcagccttttattgccggattcatcttctgtccaagtgttggttcggtttgctttgttacagatacgtttgaatctttatttccttttaacagcctcagaccattcaagattaccaataatgtacttccctcgtgcatgaagacgcctaaaccaatcgtcatcagaccaaagaaattgagtccaaccaataccattacgacaaccaatgcgaaaataatattttgccagacaactttttttaaccgtttggatacttcatacgacgtcacaaattttgataaatcatttttcattaatacgacatccgcgacatcgactgcgacatcggtgccatctcccatagcggtcccaatatctgcagtcactaatgccggtgcatcattcacaccgtcaccgaccattccggttactttaccttgggccttttgttgtttaatcacgtcaactttttgctcaggtaaaacattggtaatcacttcatcaattcccaataattgaccaacggcttcaccggtctgctttgaatcgcccgtaatcatcatggtgtgaatctgttgatctttcaaaaactgaattgtctgctttgatctttcatttggtgtatccatcaatgcaatcaggccaattaccttatcgttttcggcgagatagacaactgtcttgccttcaccggcaaactgacgcatcttcttatcgattaatgacgatacttccgaaaacaagcttggctttttaatggcatacaccttactgccataaacagcttgaacccctttaccaatttcatttgacacatcaacctgaagcctttcggttggtacaaaatgacttgcaattgcagcagccagtggatgattgatttgagattcaatggcaaaaataatgtttgttaacttgtctttgtctttagaatcaactaaataaaagtccgtgacttccggttctcctttggtgagcgttcccgttttgtcaaaagcaaccgtctctaattctgctaaattggacaaatacgaaccacccttgaatagaacaccctttttagctaattgcgatagggcagaaagtgttgccggtaccgctgcagctgcaaaagcacatggtgaagctgaaatcagaaaaacaatacttctatataaactaacgtttaacccccagttaaagccccaataaccagccgccaaaacaagtgggaataaaattaagacggccgtgacatatttaggttccaacagtttaatcctggttgcagtcttacttaaatgactctgagactgttcgaccaattttaaaattttagcaaggaccgtttcatcattccttttcgttgctgtcatcataaacgtggcatttccgttgaccgtacccgcaaagacattatcaccaggtcctttttctctgggaatactctcaccattgatagctgattcgttaatggcaggttgaccactaatgatttgaccgtctattggtacctcgtcaccattttgtacctgaattcgatcgccaattttgacatcgttaaccgaaatttccgaagcctttccgtcatcatcgattctcttggccttaaccggtgtcatttccaataaagctttaatttcccgccggcttttgccttcagcaaattcttccaagaaatgtgcaccggcaaatatcagaaccagtaacgctgcttcttcgtaactcccaatgagaatggcaccaacagcacctagtgacattaataaatgaatgttaggcatgaatctgctagttcttttgctttccaaaatggtcttttcaaagccttcaaaaataacgtgatatcccgaagaaactgtcgcaattaaaaataaactggtgacaatagctgagttaaaaccagaaaacattaataccagatcaagtagatacaggatcagcccaaaaaagtataatttggttgtcattttcaattttttcacgagacttacctccctgtctaataattgtcaatttcaatctaacgtacatttgaatttacgttcatatgagtatctcctcatatgaatatcttatcatttattttcaaaaatctcaagcattgcttcctgcttgacacaatgcgactaaattcgtacattataattattatagatttccacggaggtaatcatttgactgaacaggatcacaaacaagcctatgaacaaatgaaagaaaatggcattccgctttccgaacatattgatacggtaaccactgtttttaaagtcattgccgatcaaacacgaatgagaattctgttggcgttgtcggaaacatcattaagtgttaatgaaattgccgatatcttaacaatgagtcaatccagcatctcccaccaacttcgggtgttaaaggacaatcgactggtaaagggaacacggctcgggaaacaaattcactatcaattaaccgatgatcatattgttcaaatattcaaacagatcattgaacatatagaagaaaagaaacagcatcatttatcctgatgcaacaaaaaatgatttgaccatttgccattatgaggcattaggtcaaatcattttttggtgactattttgacaattatctcgttgcactcaagcagtgaccttatcattctcatggtctcctgcaattttagatctattcagaagcaacgatgacgtcaccaccgaaacggatgagaaagccattgccaagcccgccaattcagggcttaactgaaggccgataccaactagaattcctgcagagattggaataccaattaaattgtaaatgaaagcccaaaacagatttaatttaattcgattaaatgtctttttggcaatatcaagtgcacgaacaacgcccagtaaatcattttgaattaaaataatttcacctgattcaatggcaatatccgttccagatcccattgcaataccaacattggcaacggttagtgccggtgcatcattaataccatccccaacgaaagcgactttgcctgactgttgtaaagctttaacatggtcagccttttcatttggcaaaacgccggcaatgacttgatcgatgccaacttgtctgccaatcgcttgagcaacccgttgattatccccggttaacataaccgttttaagtcctcgggaacgtaattcggtaattgcttcagtagcggttttcttaggggtatcttggattgcaatcaacccaatgattttttcatttaagccgaccaacacaaccgttttggcatcattctgtaatttagccatttgcttcttcatttcatcagataacagataatcatttgatagtttatcactgccaacaaaggctttttgattgttaacaactgctttaacacctttaccttcaatatttttaaattttttggccttttgataagttatcttggctccactcactttagccataaccgcggctgccagtgggtgctcggaattctcttccaaacttgcggcaacttgaagcactttttcctgattacctacgacatcggtaacaaccggctttcccgcagtaattgtacctgttttgtcaaaaacaactgttttaacgtcgttgacctcttcaagtgcctggccatttttaattaagacgcccttttttgcggatcgaccggtacccaccatcagagcagtcggcgtggccaatcccaaggcacacgggcaggcaatgacaataacagatacggaaaataacatcgcctgaactgccggtgcacctaaaaatacaaaccaaatcacaaaggtcaaaatagcagcgattagaactgccggaacaaaaatacccgagatccgatcagtcagattttgaataggcgcatgactggtctgggcttttctgactaattcgacaatttgggacaaagctgtgtctttgccaaccttggtagcccgaaaaataatcataccgtccgaattaatcgttgaaccgataacgttgtcgccgatttttttgacgacgggcatactttcacccgttaccatagattcgttaatgttagtgacaccttcagtaacaaccccgtcaacaggtaccttttcgcccggacgaacccgaatcatgtctcccacttgaacttgttcaagtggcgttttaacatactgtcccttggataaaacttccgcttccttaacctgcaaactcaccaacttacctagagcattagaagcactgtgatgcatccgttcctccaaagcgtcgccaagcaacacaaaaacagttacaagcgcagcgctttcgaagtaaaccgctcttccagtcatcattgcaaaaagtgagtaaaaataagcaacggaagttcctacggcaaccagtgtattcatgttggcattatgatgtttaaatgccgcccatgcgcttttccaataaggaaccgctgaaaccaacataaccattgtggttgtaatgaaggcaatccagttgtatccgggcatcatccaatgaaacggcatcaaaaccatttgaagcagcattgggcttgccaaaattaatgaaagccaaaactttttcatattggataatttcattcgttaacaatcacctttccatggaacatattcataccacatgcataatcaaattcttgtgctttatcggtcggaatttcaatttcggtcacactctgttttgttaagtctttgtcaatgcccaacttttcaaacacaacgtgtgataaacaagcggttgagtcattcattcgaaaactcactttggctggtattcctttttttaaaaataatgtacttggagaataacctccatcaaccaaaacagttgtttcctgtttattatctgtaacctgcgcatcagcaaccgacccttcatgcttaccaaagaaccaccagacaataaatgcgattaacaggattgctaccataaacgttatcatctgtaacatcaaacctacttcccttcatcaatattctttaacaaaaacaatcagctgatttcttgttggtctcagtcaaatttacaaacgtaaactttccatatttataatctacacttgtaaacttgaaaatgcaagcattttctgaaatatgcaaaaaataagtgctttagtccttagcgtcacttggcagacaactactaaaaaactatttttaatagaatttaaagcgctttcgaattttcttttaaaatcgcttatactagagttatcaataaaactccgaaaggataaatcctatggaaaccgactacatttcaatttcctgtatcccactaccaacttttattcagggtggatatgccatttttgatgcaggagaaactcaccccaatcgaaacgaccttcagtactttgtcctcatgtttatggtaaaaggcacattattcattgccgaagacggccataattacacactcaagcaaggtgacgtttttattctcctgcctcgtcatcatcactattcatggaaaacagtagaagaacaaaccgaatactattggcttcacttttctgtaacgggtaaatggcttcagggaccgacgccggtagaagtgaattctaaaatcaatattccaacacttcattatttcacgccttcagtcaccctttacctaaaaaaatgtcaacaattgactgatgaggatgcgacttttaaactcattaatcgaatttttaagaatagcgccttacaaaacaaccttggcttttggcaggctcaacaacaattcatcgatcttctccaaacggtccaagaaaaaatccaacacgaatcatcttatacgagacttgccgaaaatatcgaacgttatttgagggatcacttcgatgaaaaaattacaaatacctctcttggacagaagtttcatgtccatccaaattccgttacgttaagtatgaagaaaacatttgggatgacacccaatgcctttttaaccaaatatcgacttgaagaagctgtcaaaagattattaacaacatccgaacccatcaaccagattgccacagatgtcggttatcgtaacatttattatttttcatccaacttcaaacaacattatgggatttcaccaatcgcataccgtgaaaaatttacgcgcaaataaaaacagaaattaaattaaattagatttaatctagttcctgtttttatattaattcattatttagaaacatgtaccctgatcatattccatgaaagtggctgtaatttcgctttaatttcatgatcgtctgtcaatacatccaaggattgtaatcccattttgccatccctgttgtcggctttgacatcgtaaccgtaaaattgagtagcctcaatcacttttttaacattcaagtctcgcaacaatgtactaaaatcaatcacttcagtctgacttttattttcagcaaaaattgtaacttcatcttgtgattgatcatatgtcgcaatactatcaagatacggtactgcgtcaaattcacgcgatttatatgttgcaacgtcaacctcaggagtcagggcaattccctttccgtaattcgagacctgcatatatggataaaaaatggattggaaccaaacaccctgatcagttgtcataatcggcgcaataacattaaccagctgtgctaaacaggcaatctttacccgatcactatttttcaataatgtcattaataagctgccaatcaacaatgcatcttcaaaattatagacatcttccaaaaggtgtggtgccgtctgccaaggcgccgttttggcatcttggtcatttgaatgataccaaacgttccactcatcaagcgatagattaattgttttttggttcgttttcgtgcctttacagcatcgcatattgctacaacacctttgatgaactcgtccaaatcaatatttttgccaagataattgtcaagttcattagggtcgtcgtcaccataaaatccataatatctgtgtaatgataagtaatccacgttgtcgtaacattggtccagtacagttttttcccaatcaccaaaggttgggttatccattgaggaacttccacaggcaaccagctctattgaatcatcaaccgccaacatcgccttggccgcttcattagccaaatgaccatattcatacgccgtcttttgaccgatttcccaaggcccgtccatttcattacccaagcaccacgttttgatattgtatggttgttcctggccattctgtcgacgaagatcactccaataagatcctttaggaaaattacagtattcaactaaattcgcagcagccataataccgcgagtaccaaggttgacagccatgtctgctttggttcccaccttgtccgcccagttcataaactcatgtaatccaaattgattggtctcaattgatcgccaagccaaatccaaacgggttggtcgcgcgtcttttggcccgataccatcttcccatttatattgagaaacaaaattaccacccggatagcgaacaattggtatatttaactttttaatcgcgtcaatcacatcccggcgcaagccatcattatctgctgtcgactgccctggttgatagattccttcataaacggctcgacccagctgctcaataaatgacccgtaaattcgttcatcaattttcgaaatttgattactgggatcaacttttaatgttgctttcatcactcatttcctccttctaataaataatcgccacttattctaaccttcgttcaagctgccccgccgttccaataaagtcgtgcggattcccttttcctgtctttcaaacttgatatacagcaggataagtagtccaccaatgacaaagaaaattgcgggtaaatatgaaatacagaatctaatagctgagaggacttgatcattttgaacggcacctgccttgtacccggcacgtgccagaacaattgaaggtgcccaaccgcctaatcctgatcccattttaattgcaaaggagctaccaatagcagtcaagaagccactggctcgaataccgtttttccactcaccgtaatcaaccgtatctgcgagcattgcaaatggcagggtgacggagattcctgttccaatggaagctaacgaccacgcaagggataagccaatgaatgactgtccggtaaaggctatcagaacttgccccaaggccgcaagaaacatcccggccattaagacatacgttttccggaatttcttgaccagaaacggaatggcaaccataccaatcaattgcatcataaccaaagcatttaatatcgacgcgaattctttatgtcctaaattatattgagtgtaatagacaacaactgaggttcgggacgcatttcccaaccaatagaagataaagacaagcactaagataaaccatggccagttcgatttggccgccttaatggaactcaagattgaaacagcttttttgggtttattaatctcacgggtatctgaaaacgcaaacattaacaagccgaatccgataacccccaaaattatggctgtatttctccaaccagcttgaggtgtgtctccaaagaaagaaacaaaacttagcgtgaaagtagcagtaataaaataaccaatcatgccgccgatgcttcgggtactatttaacttaattcgctgatcggaatcattacttaaattaggcagaattgatgtaattggtgtcccaacacccgtgtacgaaataccaaacagcaaataagtgattaacgcccaccagaatttacccgttgcacttaaatccggtgaccaaaacattaggacaaagaaaatggcaaacggaaacgccatccatagccaatacggccggctttgcccccatttggtatgggtatggtcaataatgaacccccaaattggtgcatcaaaagcatctaaaattcgagcagccagcaaaatagtacctgcagctgcgatcgacaatccaaaaacatccgtaaaataatacaaaataaacgttgtcaccgttgtataaagtaaattaccggcagcatcagtgctggcataagctaacattctatgaaacggaattttgactttactattgattgcttctccaacagaacttttcatgtgaatccctccaaatctgcttaatcttgaaattcttgtgttttaccatcaaagcgaacagctaacttagtcgtatagaaccggctggatgtatccaagttgacgtactttcgaagataaggtgcaaaacttctgacttgatattgatgatcatcctttttttgaacggcaccattaatcgcatgatattgaccggctttatccgaatagagatacgttgtttggccaaacccatttaggtaggcaaccaactcttcacccatgtcccagtcatcttcaccggtataaccatccggaaataatcttgagaagatgccaccatcggaagcaaagattgattggccaaaccgatttcgagacaaatccggacggtttaaattagggccggcaatactataggttgaagccgcttcaccaggttgaagttttcgatcagttgtcgatgcatttgcgtcatacatataaagtacggcattcgttgctcgataagcagcttgaacgagtgccacatcacctaatttctctccggttatttgagccgcagcagcagttacaccaccccatagagaatgaatcatataggaaagcgcttcccaccatctatccggactttgagatctaaaatcattactaaaaccgatattggctttaagtaactcaccataattattggcacctttttgattattggttaaagcaagcgctgccgcagcgggcccaaaaccggcattgtcaaagaagtgctcagtcattgcggctgccaacgtatcactatccgcttcaacacgttttgtagccgtttgccaagaacgtgaaatttctttatattcatgtgcaaggccggcatttttaacgtctttcagtaagtcttcaatatacataaagtaaacacccaacatctgagcctcttctttaccacgctgattatcatgcaaatccggatttactctgacatcaaatacttcggttgcccattttaaatagtccattggtttatgcagggttaaatattttgctgggcactttgataatagataaaataaatgagcaatgtattccaaatccataacccgataaaaatcgccataaagctttcgcggcttcctaaaatttccatcaacaaaccatttggttctcacgtatttaacagcgctttcttcaatttcaccaattttttgaccaaggttggaaatatgggggtccagtaaacattcctgaagaacgaatgtcatctttccaatagactcaccttgatttgaaaccgggccaaaactatatggtaccttaccatctttcccggaatatgattgatgacaaatataatctgcccgggtagcaagcagctgattaacagaactcatgacattaaaaacgcacatatccgatgtgccatccgcaaacctaactacaagttgatgttcaccaaggccttggggattaaacctcaaccggttgtcgtgacaatccgatgtcatgtctttactgacaagttcagaaccttttttatatttaacgataatttgttcaatttgttgattatctgccggtataattgtaaccagttgcttttgaccactttggacaaggggttcaaagctaatattgggatggccaaactgttttgcagttctgtaaaaattttctctgtccgagtaagcatgaatgacaaattcccaagaaacggtttgatttggttgaatgtcaatttcgttttgcggataaatccagtcatggtgcggtcgcttatccgatttgtaaccaccagccaaaacaaattcatgaaacagcatcccgtccagtgatggagaaacattttcaaaaaaacggtttgtataatcgttatatgtgccgacagacagcacattaccaccagtttggtaaacacctaagttagggttcgtgttatcacgcctaacagcagctagttttgtgtaatttgctgaaattgatgggaaaacagctgctgattgattggcatttcgatgcacatttttatctcgaaacatgacgtaagccaaactgatccagacaccgaaatcgttaatcgtcattatttctttgccatgattaaccatttcaattcgccaatagagcgaatcatcccttaaaataaatttttcgataatttctactttgcccagcagaaaggacagacgactttctgactcattactcttaattattggtgtctcattaatgcttacgtattgatgaccattaatcgtaatatgaaattcaccaaataatttatcattatcttgatacttaaggctcttcaaataagccggatcaatgacccaattcattttacttggatcatcattgatcgttaaattaacaatagcgcccctttcattttgtttaacggtaaagtattttgatttcatgggaaagtctcctcaatagtttgttgtaaacgcttacgtatataaggataacgggtttgtcccgattattaaatgcgttatctgccaaactttttatacaaattaaataactttatgtaaaatatttcacaatttatttatactatttaacaattatcttttaaccaagtgaaaaattagcatcgaatcttgcaactatactaagaatcccttgaattgaggtaatcatataaattctaaaaattaacaattgttttataaaaactaacaattgttaactgttaaaaattgtaaatcaaacgagaatgacatgcgggtttaagtaccctaatcaaaaaaacagtatctccggcattggtttattccaatgctgaaaacgctgttttatatacttagttacacattacacttatcaaattgatttatttttgtggtaatcaactaatgaatccctaacttttaacgagctttctattaaagtggtgtcaatttccatattgtcgttttccatcatattaattaaccgccgggcagatttttttcccatgacttggggattttgctgaatagttgtaatttgtggttgaacaagtttggcccagtcccaatcgtcaaatgccacaacccctaattgtcctggtacggccacatggtaatgggaaagaattgcaatcacccgcattaaaatcgttcctttaagtgcatagacagcagttcgattttccagattatcactaagcgccattaataaattatagatgtcactatcactggtagaccgatcaatctcaatcaatttggcgcttatacctactttgtcgacaatatccttgatagcgctatatctttccgttcgagcagaattatcaataatcttctcactaatcatcacgatcctttggtatcccattcgaacaataaagttcccgagcaactgggagtaaccataattatcggtcgtaatctccggccatgattgcggtgtcaacttgcgatccacaatcaccattgctgtaccggtatctttaataaattgataatgtgaagccatttcagaaacaggttggagaataatcccgtctacccgaaggctcagcaatctttccaactgcttttgttcttgatcgagtgaattattcgaattcatcaaaataatttgataaccggattcttgaaaaatttgatctgctcccttaaaaagcattgaggaaaatatattttcaatatcagccaccaccataccgataagatgggtttgcttatccgtcaaggcttttgcctgttggttaattcgataaccacttgtcttaataatttgatcaatttttgtgcgggtatcctctgacattcgttcaaaatgaccatttaggaacctcgaaattgttgccttggaaacgcctgccatttttgcaatatcgttaatcgtcatctgcttatcgctcattttctaatcacctaaatgtattttacccgcaataatcctaatttgaaagctaaatcagtataaccaattaatatttattcaaactttcaatccgttttaatagtgaatcaaaccctaatttagaaagtgtctgatcattattctcatgaatattaaagtttcgattttccaagtcattaaaatcgtctatcaaatatttagccattaaaaatactgttaaacggtcttttaactgtctttcgtaatcactggattctcggaaatgaatcgtatcaagaacatgaaaagcgaacttttcggcatcaatagtcgttctgttttctgacatatttagtcacctgtttcaatcttattcactggccatttaggattatcccccgccaacaccctgaccacttcacttgctgcgtcaacggccattcgggccatgcattccttggtatttgaagcaatatgtggtgtcagcaaaacattatcgagttgataaaaatcacttgttaggcgaagaggttcttcgttaaaaacatctaaagctgcaccgccaatagtatgcgttcttaaagcattaatcaaggcagtttgatcaaccagtgcgcctcttcccagattaattaaaacagcagaatccttcatctcgttaaactcattcttgccaattccctgttgattatcaggtgtaaccgccatatgcaacgtgataatatccgactctttcaaaagcgtttcgcgatcaaccaattggccatcttccgactctttgacaaatggatcgtaaatcattattttcatatctaatccggaagctttttttgcaaccattctgccaatccgtccataccccataatgcccaacgttttacctgccacatcgaatcccatgtgagtatttttatactcaaaatgcccctttctcatttcatcagagatagacgttaagtttttagaaacatcaaggatttcagcgagtgttgtttcggcgaccgttgacgcatttgcgtttggcgtaattgtcacccaaatccccgcttttgccatgaaattttgatcaacattatcgtacccaacaccgtgtcttgcaattaccttcaaatttggcagttgtttaatcgtttgattggggaagggatccgtcatcaaaataaggccatctgcatcaccggcatttttttcgattgagtcactagccatactgtccaactcaataagagacagcccgtgatccgttaaataccgcttgccttccactgaaagaccctttggaactgcaacttttgtcatgtttaacatcctcactttccttaatccgagtcttaacgaagtaaataaccgccgtcaaccggaattgtcacacccgtcacgtaatctgacgcactgcttgccaaaaagacaatggttcccattaattctgagggctttgcccaatggcctgcaggaatatgcgctaaaatttctgtgtttcgctctgaattgttttgaagtgctttagtcattggcgtatcaatgtagcctggtgcaattgcattgacttgaatattatcaggagccaacgcatcagcataggcttttgtgagtccaacaacaccatgtttgcttgcagtatacggaaaaataaattttcctgctctgaaagactgcattgaaccaacattaattattttgccgtgtttttgttcagccatcacttttgcggcttcatgagataagtaatagaggccgtttaggtttgtattaatgacctttctccaatcctcatcattgaaatgatcccattcatttcgaatctgaatgccggcgttgttaattaaaatgtcgattccgccaaatgattttttaaccgcttcaacaattttttgagcagcaccttcttgggtaatgtcactttttatgaaatcaatttgaccgctaacactctttgcaaattcggctgcttcctgccagcccttatcgctatagcttgcaacaaatacctttgctcctgataacagcaaggctttggtatatgaaaagccaaggccgctggcgccacctgtaatcactgcaactcgattatccaaacgaaatttatctgtactaaattcaatgctttctgacattttccaccactcctcctactaaaactgactatttcccagtacctcaagatcagcctcaagtccggcaagatccgttgggtattccagtccaatagggatttgtttatcaaattttgcaatcagtgactgccaatccaaaagtcctttagaaaagggaaccgtttcaggttctcctttctcgttgagaacataactctttagatgaatatatttagtgaaatcaagtaattgctctgtcactttctttgtatcatgatttgtataaatccagttaccaagatcattaacaaatccaatttcaagtccatgacgtttggccgtcgtaaagaaggttgctaatttatcaggatcactattctctgctgtttggtcattctcaatattcagttcaatcgttttgggcaaaattgaattcaaaattgccaattctccatcattatctttatgaaagtcacctaatgtcatttttaaatatgaacttcccatcaactgggcttctgacagatacagcaggattctttcgttaattttcccattaataaaaagattatcaggaattgaataaaaatatgtcagtctgtagttaagccgtaaacgccccagttgcatcagttcgctcattttttcttgattatattcccgtctaagttcaatatttgaaacacctaattgtcttaatgactggacaagttgcagctgtgtttgacctatattgtgatcatgttgtaaaagcaacgtatttaaaacaaatcgattcatattcatcatgaaaagtcacctcgttcaatattttggttaaccggtttctcattaagattaccatcatcatattacaagaccacaataatcgtcaagtcaaaaatagatattattaaaaagccaacacccgtctcaaatccgcttcattacatatatcaagtataaatagatagcctaaaatcgaaataagtttgacatttcacaataatcatgtttataatgaaatcgcttttatggttaaccggtttctcttttggcaaacacacatgacaatttaggagtgaacaacatgtcaaatatcattataggaattttgctatttttaactttcattggatttatagtgttcgtaatgcgtggcggcaatatcatgatcggctttttgattatggccgttctctggaccgttatcggtggcattccgtataaagaagccatcaatgatattttttctcaaccggcaatggattatggatccacgattatggtaatcatttttggttcgtggtttggaagagttctagtagataccggtgttgcaggtgctatcagtgaacaggcagtaaaggtaagttataaacatcctatttccgctgctattttagtctgcctgattactgcctttatcttcacaagttcatatggtgtcggtgctgtcattgccattgctgtcattcttctaccaattttacaatcattgggtctgtccaaaaatgtcgcagttgtcgcttttgttatgtcaattggcgccccaatgtacgttaatattgtcatcattaaacaaattcaattattctttccgaaagttatttatggtgccaaatacctaacatatgggttcagtgcaatggcggtccaaatgatcgttgttatccttttcattttagttcatgctaaatccatccacaaaaatgaagttaccagcactgatgttaaagatgtgaacattccaagtgttccaaagatttcatacattttacctgtttttcctgttttaatgaacttaatctttggatggcagcctattccggcactgatgctgtcgatcttcttagttctcttgactaccggacacttaaagacatataaaaatgcattgagcatgattaatcaaactgtcagcaaagccatttcggatatctccggtttaattgtcatgttgctttttctaaccatgtttagtgcagcggcagtcaaaaacacagctcgctttggcactattttaaaaagtattgtccctcatgatccgtttattctggcaattgcctttggtgttcttgccccacttgcactatttcgtggcccgcttatggtctggggagctggatcggcaacagctgctgttttggcagcaaccggttttttcaatcagtattttgccttttgcgccattattgtaccggccgtttcgattgcaatttctacctgcattacccaatcttggaacctgtgggtggttgaacacacggaattaaatgttaaagactttttaaaaaccggtgtgccctatgggtggttgacaagtatcattaatctgttacttgcggcaatgatgttccattaagctcattacctgtttgtgaacgattaactgatagcttttcataaaaacatcaaaaaagcacatgcttagcaaagattgaaacgttactctgctaagcatgtgctttttaaataatcttatttatgaaaaatcatttcatcaaatcaagtgttactatccaatatttatattgtttggtcatgtgcttcacttttgttttcgagccactatgtttttgtgcaattgttgcatacatggttgtatagcccttttgcaatctggtgataatcattttagtaccgccattcatcaaatactccttttcccctttatttttggaaatcggatcaatataggcaccatgatatcctcttggaacgttaatttttaaaataacgtgtttggaaaacgataaagccaccattcgctttaatgtcgttgacgaataagccatatcggaatattcaccaccgactttaacaccttgatcatcaagtgatttttttaagccaaacatggatgtccctcgaaaaaccgttaatggtgctgataatttgaattgatgaatgccggaattaatattcttaacgtccgagcgaattttcttagaggccttcttttccgaccccctaagtgcatcattaatagcttcataaccatctccggtatagtaacgaatcgcatgacgctgattaccggttaactttttcgaccattttaaagaagaacgcgttaatttatcaatttcatgcgcattgtttcgaatcgacttataagagtatagcgaatcgtgagtatcctggaaaaataatttattcggattaccgggaaccgtaatgatataacctgcattcccggctaatttttgctgaaccgtcaatgcggtatttttcggaatttgaaccggattttgataatcaggctgatcatttttcgtctcgtaggctgtaatcgacctcctggttacaaaagcctgtttaccaacatttgttgcatgcgtataagtattgatcatcaacaggttcgtctcgcttgtatgtttatgagccgtttttgcgtatgtcgggctttgcattgaaatccccgctaacaaagccactgcaaaaatccatcccttaactttcctcaatatgattcattcccttcaaaatgatgagtttaattctacactttttgcctatttatggcttctttaaagctgaaggttaataaaaataaaaacaagttaactaattctttataataaatttaaataaatatcattttaatgacgtactagtattgtaaaaatgaaccccatcattatgaatgggattttagaagtaaggggttagcgctaaaaatacattacaatccgagaaaatacacaacaaaaaagaagcaactacaattgcttcgaatttaagtatgattttttatctagacaaattatttttatttaaggttcttctccaaaaaattagcaatatccgtaccaacctgattataagtcgcttgggttggatgcaacttaccatctccgaatattgacgtgtcaatcgttgtcggtacaatatctgggtcaaccgatctccaatctaaatatttgacgccattatcctcataaacttcagcttcggcatcacacaattgagacaatgtataatcgtgatacccaacggtactatacgcatctgattgctgatctgttccaaatgccgtgacataacagttcaaaggcaaaatcccaaataattggatagtcggattttgacgctttattcccttaatctgatcatccagaacttgtgtcacatccgtcagagaggaatggaagtagtcgttaacgccataagcaattgtcgcgatatcaacctttttaaaatttgtcgtagtaacgtttgatgttaaatccaaatttgtatcaccaacaaccttgccattattttggccaagattcgtatccaatacataaagctgttgactaactaactgaggatagggacttgtggcatatgacgagcctgtccacccctttgtaatagaatctcctaaactcaccattgtcatttgttgcaaattcttggcataaccccaaccataaacagatggcttatttgcaacttgcacaaagtcatattttaatccgtttttcaaagtagctgattttgtcaccattaaagatctcttagcataatttttaagccagtgtgtcttcttagccaatttattcgagcgatacggataagtccacattgccgtttttgacttatagttaatggcctttgttcttaaagaaaccttttttaccgatgttattcgataatgagcatcaactactgcagcatgactgtcttgaatatttataaattgcataatcataaagctaaaaaatagcaaaaataattctctagtgcctttattaaaatatgatttcaaattcatcaattctccctctcagtattcgataatagcaaattaatcataaataagtcccctgaagacagttacttgaattccgagggtaatttaactcgtgatctactaaggatattataaataacctggggtgaaagtaggttgcataaatattaaaacagcattacgaatcgatgaccaactctattatttaatagtattggtattataagtatgttcatttgtatcagcctacaaatttaaaataattcgattaaatagacaaaagcctgaaccatagccacaaagaaaacgtgcggttacggcacagacttttaacaatggttaataccaaaaatactttgaattaagactttaacatcctcaacttaattatgcaccatatcaggtgccggctgcccatttaaatcaatggcaaaccgaaccaagaccaaactatcaggcgttacgggcaggctatcaatatatacctcccgatgctcgttctttcgaattcgttgataaccgccttcttgaattgccttattcagcacttgaaaggcttggcagccatcctctatcggaccatgattaattgtttgaacttcaatgccttcagcaagttgttcaaaatgaagctcttctcgttttgtattaacaaagtgaattttttccaacgcagcctcgaatgcctcttcatcaacaaataacggttgcttaatccagattttaaaatcttcaacatcgccatttcgcttccaaacagcctgcaccggataaggtacataaggcttaaatccagaaattggaatatcctcctcaggaccaccactgatcgttttggcaattcgagccgcagcctttgcaattcttaaaaattcggggtcatctgtatgcttagttgcttgtccttgggccgtaatataacttcgagtcgttagatccacaaagtgagcatgttcacttttactatattcatctggttcatttatttcccaattaaacattttgtgtccctcctctttgcccccaatttaaaccctaaacacgccatgtagcaaataatgtgactgaaaaatgcaatcgctgacacatgtacaaattattgcaacgtaagacaattgaaatgatccaatactactattaactaccaaagctgctcacactacataatgatcatttagcagcaaacaatttagttcaaatttagttcataattactcaactttatgaagttgacaaaattaaaaacaaatcttacaattctaattaatttatcatttaacagtttaaagggaagagtcattaatcacatgcggtttccagaaagcgtgatatggctgaaaaaagtgcacccgaaagattaatgaagatgaactcttagctttgttggaggtgaaagctgacaacacgattcgggtacgatatcgctcagggataacgttttaatttaaaacaaaagaatcctgagatagttcattgaaaccataaaaacggatggtaccacgaaaaatcgtccctgtgcattaagctgcacggagacgattttattttaggaggctatattttgagtactaatcacaaaccattaagcaaaaaacaacttgaagaaacacttattcaataccgtcatcattttcacgaatatccggaacttgccaaccgagaatttaaaacaacagaaaccattaaagctattttgaccaaatggggaattaaacttctacccacaaatttaaaaacaggcgtgtttgccgaaattggcacaaacgttggtcctaccgttgctttaagagccgacattgatgcgctcccgattcaggaggaatccggcgttcctttcagctctaaagttccgggtgttatgcacgcttgcggacatgatacccatatcgcatcgttattgggaggtgcctacctgctaaagcaacttgaagccagtcttcctggaaaagttcgacttctttttcaattatccgaagaggataaagaaggggctcttcaagtgattaacgatggtcaattaaagggcgttaacgctatcatcggatttcacaatacacctcatcagccaatcggccatgtcggacttagaagcggcattacaactggtgccatcgataaattcaaagtcaccctaaccggtgtaggaacccatgcatccgcaccgcaaaatggtgaagatccgatcgcggcgctgggttatgaaattaccgaactgcaatcattaatttccagagaattagatccatttaaagccgctgtattaagtattacacacctaagtgccggtaatacttggaacgttatcccaagtattgcattttttgaaggcactgttcgcacagccgacaaaaatgtccgtcaagagattaaggaccgtttttttaaaattgttaattatacagctttggcacataacgttaaagctgatattaactggtacgccggagatccatccgttgataacgatccaacattaactaagattgttaaggacgaaactgctaaatttgccccaatctatgtacaggaacaacagcttggcagtgacgacttttcctgctaccaggacattatccccggtgtttatgcaaatatcggaaacggtggacaagttagtcttcacaattcacactttacagcaagtgatcatttattaattgtcggggcaaccttttttgaaaaaaatgctgtccgacttttaaaagacctaaaaactaatcaccagagggtcaacaataatgattcgttataatccacgccgctaactgtgacaggagattgaaaaagccgccataaataatctttttatcaacattatgtcggttaatcgtttaataaggtttggcatacaaattttactttagtcgatcactattttctaggcatcaaaatagtcattaacggtttgcttataaatctcaataaagcgttcaaaattttccagctcaacaaactcgtcaacttggtgtgccgtcatattacccgggccgaagaccgcaaccgtgatcgttgggtttactttgacgaattctgctgcatccgtaccaccaggatacccacccaatggtaatttttgttggagttgctgttcaccatgctttctaagtaactgaatcaatttattattcggatcacttaccacgggatacttgttcccaagaagtttaaatgacaagtcggcttccgactcctgattattcttagaaataatccgttttaaatgatcaataatggcgtcgttgggttcttccggaatggttctgatcttcgcataaacagaggccgaagccggaacggaatttaactgatcaccaccattaattttggtgaccacaggaatcgtttttcctaaaatggcatttttttcatgaagtgttctgaaatatttaatttcattatcgtatgccttgattaaaggtgcaatggcatttatccctaattgcggcgatgaactatgagctgttttcccctttgccagtgtttcatacgtaatggaacccttgtgcgcgaaactcaaaagatattgttcagtcgaattgttttctttaactaattccctaatctgtgcttttgaaaacttaaatggatttagcggtgtatcctgtgttagccaatccaagggctcactacttggttcagcaacgattgccgctgaaacatcatccaaatacccatgtttggcaaagtactgtgcaccttgcatatgattgactgtactggactcttcaccaactgttgccaacaaacgaacggttccatttatcggttttccggactgcttcagctcgatcattgtgataatttctgcagcaagtccggatttcatatcactcgtgcctcggccgtacatgcgatcgccaacaatttcagcccctaagggattgtgcagccattttgaccgttcgccaatatcaacaacatcttgatgcccttcaaaaacaattactggtgacgttttatcaccaatttcggcaactaaattaaacctccccggttcaacctcaattgtcttaccgtgaatcccataactttccaaaaatcgagaaagatatttggccgttccttcttctcgaccaccaactgtattaattttaattaaatcgctcagtaatttaatccgatcttttcgatccataatattaacaactcccgttaagtcagcttttatagctcgttaaaaagtaactgtcgatgttttaagcctttatactattataaggcattgttaacgaattcgctttcttttcagccatttcagttgaaattttccttaatcatcgcaaaacactcatgtcaaaatattaatgcaaatttgcctaatctggtttatactgaaaatgcagctaggggagcaatttgctgagaccatttttgggaaccctttgaacctgtgagtcaatactcgcgtagggaagcttaacgatatgagtctgttaatttctctccaagcaatcattcttggaggttttatcatggttaaaacacatgcaatagaaatttttgatggttatgccactgaatatgatcagtggtttctggctaataagcaggtatttctgagtgaattaaaacttttaaaatctgctttggacttaagttcaacaaaacatgtcttgtcaatcggttgtggcagcgggctatttgaagataccctccaccgccaatatggcctgccactttttgatggtgttgaaccctctaccgatatggcacagattgcaaaaaagcggggattaaacgttcgaattggaaaagcagaaagtattaatctgccggcaagacagtatgataccatttactttaatggcagctccagttatattaaggacttattggcagcttatcaaaattgtatcaaagcactcaagtccggcggccattttattttaattgacgtgccaaaagaaagtgcttatggattaatgtatatgcttgccaaaattcagggtaattatcaatcagaagaattggcaaatgttcttccaaaatggccatacccaattgaactggttgattctgcatactggcataccaccttagaaaaaaagcaccttttagaaaacgagcttcagctacgacatttaaggttcaaacaaaccttggtagcaaacccactctacacaaacgatagtgctgaagaacctgaagatggcttttcaaaaggtggttatgtcgcaataattgccgaaaagccttaaaacaaaataaataagctgacaccaatcccttgtttatcaaggaactgatgtcagcttatttaggttctgctgattatttttgttttgactgccagtggtctttcacaaatttttcacgtccgccagcttcctccatttggaagcgaaatggattttttttataaaactgttgatgttcctcttctgctggataaaagggtttggcatcttcaatttgagtgacaatcggctggtcaaacataccggtttcctctaaagcttttttggaagcctccgcaatttttcgttgcgcttcatctttcacaaaaatcactggacgatagttatctcctcgatcctgaaactgtcccattgcatctgttggatctgtttgttgccaataaatttgaaccagttgcttataactaataatatctggatcaaaattgattttaacggcttcggtatgtcccgttgtatggctgctaacctgttcgtagctcggatttgctacatgaccgcccgtatatccggaaataactttattaataccgggcatggtatcaaacggtttaaccatacaccagaaacacccaccggcaaaaattgctgtatcttccattaatgacacctctttgactttattattaatatcagctaaacatctattttaacagctgtacatatcagttaaacattggtttatactgcccataccctgcctcttcaagctcgtctgcggggatgaacttcaaggccgcggaattgatacaatatcgttggccgcctgcttctttgggcccatcgccaaacacatgccctagatgagaatgagcatcattactttgaacttcctctctaatcatcccgtgagaagtatccaaattcttatgaatacttgtttgctcaattggtttggtaaatgatggccatccacacccagcgtcatatttgtccttagatgaaaacaaaggttcaccacttacgacgtcaacataaataccctcttgataaaaatgatcatattgaccactaaagggtgcctccgtagcggcctcttgggtaaccgcatactgttctggtgttaatcgatgttttaaatcttttttctcaaccatgattgacctcctgccaagggtaaatagattgtgtgcaactaatgctttctatattataggtcgtcattgcttttatgtaaacaaaaaacggcctcagtgataaactgtggaccgaatttaacatgctattttaacttaatcaaatatacgtacgagtcattaacttaatgcatcagttaatggtggtactacctgtttctttcgagaaacaacacctggtaacggcattgtattgtcactagcaaacttttcgttgaaagctttttcaacggcatctaaagatgatccaactgcaatcaatttggaatcactattcaaaacgttcgtaacaagtactaagaataaatcgtatcccttatcggaagcttcggctgacattgcctttttaatatcatcctgacgcttatcaatatcatcaaagtcaacaacgttgatttgatcaattcgaacactcttgccacccattgtaaatgactttgcatctgagtcgattagttcctgatcacttttagctgcaacgttagttccagccttgagcatttcaataccatacttttcgtaatcaatatcagcaatctccgccaatgtcttaacagcaattttgtcatcatcagtcgttgtaggagacttaagcaataacgtatcggaaataattgctgaaagcatcaagccggcaagttgagccgggatttcaatcttgttttcgtcaaacatcttaaccaaaattgtactgcagcagcctaatggttctgcacgataatataatggtaattctgtttggaaatttgaaatccggtgatgatcaacaacgtgggtaattttaacatctttaatgtcgctaacactttgttgaaattcattatgatcaaccaacataactgaatcaacttcattactagctgtcttaatcactcgtggcgttgtttcatcaaagtaattcaaaacaaaattggtttccggatttggttgtcccaaagcgacggcctcagtatcataacctaattggttttgaagatacgagtacgcttttgcggctacaattgcatctgtatcagggttttggtgaccaaaaactaattctttactcatttacaaaatctcctttaatttttaaaaattaatctgctaatcgagatagataatccttagtattcaagaattcgtcaaatttagacaaaaaacgaccgattcttggaatttcattcttatttttccgataaacaaacttcaaatcaaatttaattttaggatcaaattcagagacaaaaatatcatcatttgtcagatcctttagattaatattgaccatgtatgattttggtaatgcagtatttgtaccagtgttaattgcaaacttcaaaatctgctcaggcatggtataacgagcagctgcagttggaaagtcaaccatttggtttttaaacgtttcccgtaacgtctggttcaagtaataatcttgtggatacatgacccatggtcgatcgttaacatcttttaaatgaactttctttttcttagaaagatcttgattatgatgaattaataacaaatcatccgaaatgatctttttagaactgtacggtttccagtttttgattgattcatctggaagatacataattgccaggtcaattttgttattttccaaactctcccaaatctcttttcgggttaacatatggaaattaacaaccagatctggattctcatgataaagttccaaagcaaaatcttcaaacactttagtctcaattgaagccaaaatgccaagattgatttcaccagttgttgaactggttgcttgttgaatttcatcggttgcatcattcagtaaatcatagatttgatgggtcgtttttagcataatataaccggcatccgttaaccgtaactttttacctactgaataaaataatgatgttccaacagtgcgctccagttttttgatttgctgagtcaacgccggctgcgtgatacctaaaatttgtgcagcctgcgtataattcattgtatcagccaactgaagaaaatacgataacgtttttgatgaaaaaatactttcctgagtggttttcattcagtctctccttaatgaagttaaggttaataaggtgtgaaccctacttccatatatgatcactaaactagtccaagaccgctttaaatcaccatttctggccgttaatggaagctgccttgcttataagataacttataattaaccattatgaattattataattctaaatgaaatgacaatcaattaagagaacacaaaattttaattaattgtcaattcagtcggctttcggcgaatcttaaccggcgttccttcgctttccacatcaatgacaaacgatccattggaataacgcccgccaagcgagaattcgtttggcaaaatatcatgaacccgttgatgatccgttaacacttcaagaggggtatcttcattatcaatgaccgtaaaatcaacaacacggtgagaattctgctttaattctctcagaatcatcacacctttgcgagcacgagaagtcgctggaatttctttaacggctaattttttaaaggcaccccgttgcgtgacaattgcaataacatcgtcatcgtttaccaacttcaggtttgttataacatcgccatccgccaggttttgggacttaacccccgttgttctggcaccattaataggaacttcatcgattccgtaacgtaatgccaatccaagtttagaaattaacaatagcttaccgcttgcatcgggatctgccaagtaatcaattgcaacaattctcgattcgggatcttttagtttttcatacatatacgcatgctttttatacgttctcccgggagccaaatcagttaacttggtacgcttgatatgcccatcatcagtggcaattaagaagacccctttttccttcaatgaactaaatgcaaatgtgccaataatttcttcatcattatccaacccgatcgtttgggaaatatgttctcctgtatctttccaccggacgtcggcaatttcaaaaatcggtcgatagattaaattacctttactggtaaacatgaataaatgatctcgagcattcatttgtctcataaagatcgggtagtcttcatccttgagcccgttctcgtttccagaagctttatatgaacgaatactactacgtttgatgtaaccatcgtggctaaccatcaccacaacgtcctcatcgggaataatgacatcagtgctaattttaattgtagcaaccttatcttgaatttctgtccgtcgagggttgcgataatttttagcaatggcccgtaactcacgagccaaaactttattaagctccttaggatcggctaagatttttttgaatccggtaatcttatcagataattcctgagattctttttccagctgtgtgacatcggtattagtcaagcgatagagttgtaaggcaacgattgcatccgactgcttttcggaaaactgataagtcttcaccagattatctctggcatctttacgatttttactagcccggattgtcttaatcacctgatctaaaattgataaggctttaatcagaccttccacaatgtgttgacgatccaatgctttttgaagatcaaactgggttctttttttaataacctcttgttgaaattcaagatacgagaccaatatttgttttagtgaaagtcgttcaggccgcatatggtcgattgcgaccatattgaagttatatgaaatttgcaaatcagtattcttaaagagaaaattcaaaataccggttgaatcgacatctcgtttcaactcgatcacaatactcataccctcgcggtcgctttgatcgcggacctcggaaatcccatcaacctttttgttaagacgaagttcatcgattcgcttaacaagttgtgccttattaacctcatacggaatctcagaaacaacaatttgagctttatttcctttgagaggttcgatctttgtctttgaccgaacaatcactttccctctaccggtctcataagcttttttaataccgtcaattccttgaacaatggcgccagtcggaaaatccggtcctttcacaaactgcattaaatcatccagtgttgctttaggatgtttttgtagatatagaaccgcgtcaataacttcacctaaattgtgaggaggaatatccgttgcgtaaccagcagaaatcccagttgatccatttaccagtaaattagggaaacgtgatggcagaacagttggctcgtactcagtatcatcaaaattcaagacccaatcaacggtatctttatcgatatcacgaagcatttcagttgaaattttgctcaatcttgcctcggtatacctcattgcagcaggcggatcaccatccattgagccgttgttcccatgcatttcaattaaaggttccctgactttccaattctgactcattctaacgagtgcttcataaattgaactatctccatggggatggaaattacccatgacgtttccgacagactttgctgattttcggaaagctttatcgtaagtgttaccatccttattcatcgcataaagaatacgtcgttgaacaggttttaagccatcacgaatatcaggaagcgcccgctcttgaataatcgaacgggagtatcgactgaatcgttctcccatgacgtcttcaagagataaattctcaattttactcaatttaaaatctcccctatatgtttatttcgcagtgttatcgaggatgcttccttcttcttcaaggttaaacttaacattttgctcaatccactttcttcgtggttcaactttgtctcccatcaatgttgtgacgcgacgctctgccaaggcagcatcatcaattctaaccttaataagtgtccgggtggcaggatccattgttgtttcccataattggtcggcattcatctctcccagacctttaaaccgttgtagactgtatcctttaccaaatgttttagaaactgaatccaactcttcattcgtccaagcatactgaattttagctttcttgcctgcacccttctgaagcttataaagtggtggcagtgcaataaaaactcgtcccttatcaatcattggccgcatatatttataaaagaacgtcaacaacagaatttgaatatgagcgccatcgtcatctgcatcggtcataataataatcttatcgtagttggcatcctcaatattaaaatcggcaccaacaccagccccaattgtataaatcattgtattgatttcttcatttttcatgatttcaggaagcttggcgcgttcagtattcaaaaccttgccacgtaatggcaaaatagcttggtatcgtcggtcacggccttgtttggcagatccgccggcggaatcaccttcgactagaaataattcatttcggctgtaatccttggattgagcaggcgttaatttccctgaaagtaatcgctcctgcttcttatgccgcttaccatttctagtttcatcacgtgcccggcgagcggcttgacgggcttggcgagctcgaagtgctttatgtaccagcatttgagcaaattcaccattttccattaaataatagccaagcttttcgctcacaacattatcaacaattgatcgagcctcaggtgttccaagtttttcctttgtttgaccctcaaactgtaaaatttcctcgggaattcgtaacgaaaggacaactgataagccttcacgaacgtcactgccctccagattcttatccttatcctttaaaaggccaaccttccgtgcataatcgttaaaggctttagtccaggcattacgcaatccagcttcgtgagtaccaccgtcttttgtccgaacgttattaacaaaggacatcatggtttctgaataaccgtcattatattgagcggcaacttctacttcaacgccatcctttgtcccatcgaaatacatcacatcgcctagagtgtgtttatcttcgttaagatactggacaaactccttaatcccgtcttcataatgaaacgtttcttcctgttcctgaccgggtcgttcatcaattaaaataattttagtaccctttaacaaaaaggctgattcacgtagtcgttcagaaagtgttgaaaaattataaaccgtattcgtgaaaatcgaagaatcgggtttaaaactaacggttgtccctgtatgctctttcgtttttccaagcttacgcaatgttccgaccggatgaccgccgtctttaaagtcttcttcgtacttgtatccatctcggacaattgtcacttttaaccaagtcgaaagcgcattaacaacacttgcgccgacaccatgaaggccacccgacgttttataaccgccctgaccaaatttaccacccgcatgaagctgtgtaagaataacttcgggtgttggtttacctgaagcgtgcatgccaaccggcatcccacggccatgatcaaccactgtaatactattatctttatgaatcgtcacacggatcatatccccgtatccggctaacacttcatcgacaccattatcaactatttcataaaccagatgatgcaagccacgataatcggttgaaccgatatacataccggggcgttttcgcactgcctcgagtccttcaagaatttgaatcgaggaatcatcatatttttgtttctgttttaccattttttgtgactccttcttaaaacaatctacttcatcataacctaaattaatggctttggaaaacaaattttgttggcgcatcgtcattatcatgctaatattaaaggtgctattgtattaacaaaacatgactgtagtggggtttaaaatggattctaatactgaagaaataatactaatgttagttactgcttatttactaggatctattcctagtggtgtatggattgggaagctttttttccatatcgatatcagaagacatggttctggaaatattggaacaaccaatacctaccgggttttgggaccaattgcaggatccatcgtcatggcaatggatatctcaaaaggtgcagttgcaacactattacctgtattttttaacaacacaactttcaatccgcttttatttgggttagccgccattctggggcataccttctcgatttttgacaaattcaaaggcgggaaagcagttgcaacaagtgcaggcatgttacttgcctataaaccgtctttcttcttcttggctgctgggatttggattttggtcattctcctaacaagtatggtcagtttagcaagtatcattgcgtttccttgtgtgacaattgccatattttttattcatgacacgtacttatttatattagcagccgttttaaccgtgttcattttttatcgacaccgagctaatatcaaacgaatcataaacggtactgaaaatatggttccctttggccttggtcacattctccgaaatcgtcattaaaaatggacacttgttttcgcaaagtaagtttgattctatcatactgtttattgatgaaacaacgctgagaaacagatttttaacatttttgactggataagccaatgaaaagcgagcgattcactactgaattgctcgcttttttgatttttatttaatcaatcacaattttagaagaaactgatttggtatccagcatcaaactgttgctccccagataaccgattaatcgcaaacttatcttcaagcttaccgtcagcatctacagtgtctgcaagtccccaccagggttcgatacaaataaacggtgcctgtttcggatagggtgaccaaacaccaacataaggggcatcctttaacgataaagcaataccgtgatcattgtgggtgttagcaagcattagcgtcgtttgctgtccttttaaatcaagaaccaaggcatcactatcaaaaagatcgtgattgagtgctaaaggcttggtaaaatccagctcttgaaggtcgttaggatcactataagggggcttcaacggaattcgttgataagccttctttggggcaacccgtataaagtaatcgttaaatcctccttcaccggcgaatgggacattaaagccgggatgagcgcctagtgaaaacagcatcgacttatcacttgagtttttcacagaaaaacggacacctaattcgtgatctttgagttcaaaacgaacgcgtaattgaaatttaaaaggatacttggtaagtgtctcggcattttcagttaacaaaagtgttaccgatgtctcttggtgatcttcgatctgaaactgattatcgcgtgcaaaaccatgttgtgtcatctcataggtgttgccctggtatgaatactgattatcttttagtcggccaacaatcggaaaaagaacgggtgcatgccgtttccaatatgtcggatcagcctgccaaacgtactctgaaccatcttcagcctttacactggttaattccgcaccaaattcattaacaagaaccgtcaaatactgattcttaagggttatcattttttacctccatcaacaatttttaaagaatgtaacgtgaaagatccttgttaccagcaagcttgccaaccttatcatccacatacttttccgtaattgtaatatcacccatctgcatatcggggccctcatataaaatatcctcaagcagtttttcaaggatcgtgtgtagtcgacgagcaccaatattatcagtattgtgattaacttcagtcgcaatctcggcaatgcgattgatagcttcaattgtgaaggtaactttaatattatccgttccgatcagcgcaatatattgtttggtgagcgagttagttggttctgtcaaaatcttgacaaaatcatctttgcttaaatcatccaattctacccgaattggaaagcgaccttgtaattcgggaatcaaatctgacggtttgctttccgcaaaagcacccgaaccaatgaaaagcatatgatccgtgttgaccggaccgtactttgtattgacttgtgatccctcaacaattggtaaaatgtctctttgaaccccttcacgagatacctcgcctgaattttgagccttaccgggggcaattttatcaatttcgtcaataaagatgatacccgtattttcggcacgaataatcgcattatggtataagtcagccttattgacaaggtcttctgaagcttgacgaatcaaaatttcacgcgcttcactcactggaacagtccttttaatctttttctttggcattaaaccagagagcgtatcatttaaatctatccccatctgattcatcattgaattttgtccggaagcttgttgtgaaggatcatccatctcaatttcaacttcttcattttctaaaaggccggcacgcaatttatcagaaacagacatccgcttttctcggatatcatcagtaacttcttcttgatcatcattttcagaaggcatctgaccattttgcatttgcgtaaacatgttcattaaattctgcatgtcgttttgacggttctttttcttttgagttggtaccaagagtttaaccaattgattattagcctgcttttctgcatcggtacgcacatctttatattcatcatttcgctcaagtaaaacggcattttcaactaggtcacggaccattgattcaacatcaccgccgacatagccaacctcggtaaactttgtagcttcaactttaacaaagggtgccttgactatttttgcaagtcgccgggcaatttcagttttaccaacaccggtcggtccgatcatcaaaaggtttttcggtgaaatctcatcctgcatggattttgaaagctgcattcgacggtatcgattacgcaaagcaaccgcaactgcctttttagcttcattctggccaacaatgtactgatctaaaacttcaacgatttcctttggggtttgtgtggactctgtcaattgaatctctcctctatatttcttcagaaatgacattttgatttgtaaaaatgtcaatatttccagcaatgtgaatggcagcttcggcaatttctctggcactcatgctttgcgcgtggtgcttcatagcagttgcagccgccagtgcaaagttgccaccagatccaatagcaagaatgtcatcatcgggttcaatgacttcaccttgtccggataccaatagtaaatctttatcattcattacaatgagcaaagcctcaagtttttgcaattgctgatcgccccgccaatcttgggcaagttcaactgcggaacgctttaagtcgccatcatactgacttaacttcttctcaaatcgttcttcaagattaaacgcatctgctacacttccggcaaatccgaccacaaccttacctccgtatatccgacgaactttatgggcagttcctttcataatgaccttttctcccatcgtgacctgaccatcgccggccattgctagatggccactatgacgaactgctacaattgttgttgcttcaaattttattggcataataagctccttcatttttttggttttaaagattgattgtttcttggaaaatatttctggtaatcattcatcaagtgagacttggtcacatgcgtatatatttgcgtcgttgacaaactgctgtgaccaaggagttcctgcaccgaacgcatgtcggcaccgttatttaacatttccgttgcaaatgtatgtcgtaacatatgcggatgaatattagtggtcaaactactctgcttgataattccatctaaaatatactcaattcctctggaagtcaacggttttccgaaatgattaataaagagataatcgtgcttttgatgatatttggtcatcaatggttcccgtgattctttaaggtaattttcaactgcctgtttagctggtttcccaaacggcaaatatcgttgtttgcgacctttcccagtcactaaaatcagttggttttccaagtcaatatccttcaactgaatcgtgacaccctcgctgactcggattcccgttgaataaaacacttctaaaatagcggaattgcgaaaagcaagtttacgttcccctttttttgccgcagaaaagagcgcttgcatttcggtaggataaaaaaatcgcggtaaacggcgattttgattttttaaatgaacgtactcgaaaggattatttttgataacctcgtttttaattaaaaaactgtaaaaggaacgtaacgcagacaccttctgggcaatactattgcgcgcatacttcttatcataaagccctgttaagtaggactcaacatcaagagaatcaatctttatcaaagacgtatgatccttggaagtttcatttaagaatttaagaaattcagtcaaatcattttgataagcctgaactgtgtcctcagaatagtgccgttcacttcggagatattttaaaaaccaatccatattttttcgatcatccattttaacaccgactttccagcaaaaaacaattctctttgacaaggtatcgaccctttttatcatatcaaattaccaattaaatttcttagtaaacagtcaaatatggttaatatttaaaaaatctcaaacatttgttcggcaacatgctctttcaacacaaaaaaccgcatccacttgggatacggtttgctttttgtgattagccacgtgggcgaacagatgccttaatacgagcagctttaccttgcaatgcacgcaagtagtaaagtttagcacgacgtacacgaccgtgtctgataacttctagtttatcaactcgtggtgaatgaagtgggaagatacgttcaacaccaacaccgttacttactttacgaacggtgtatgtagcttgaatgcctgaacccttgcgtttaataacaacgccttcaaataactggatacgttctctgttaccttcaacaaccttaacgtggacacgaacagtatctcctgcacggaaatctggcatatcattacgtagttgcttttcgttgatcatatcgatcaatttattttgtcgcataaacaaatcttcctttcactaacattcattatcttgtttgacagcggaatgttgttttgcggctcacgccaaaggaaagtttaacacaaagttcagtcctctgtaaagggctttttcttgtcagcctgcttttcctcttcttcaatacgaacatccgcaaataatttcttttgaatactggataattttcgatgatcaattaaatccggtcttcgcagataggtccgtcgaagcgcttctttctgattccataaagcaattttcttatgatcaccattcattaatacttcaggtactttcattccgcgaaaatctgctggacgagtatattgtggctcttccaacaatcccgtagaaaatgattcttcaacctttgactgattattacccaaaacgcccggaataagtcgcgtaattgcgtcaatcatcaccatcgcaggcaactcgccaccagttaaaacaaaatctccaagagaatattcatctgtaataattgatcgaattctttcatcatagccctcataatgaccgcaaacaaatgttagatgttcatctgaagaaagcttttcggcatcttgttgtgtaaatgtttttccagctggatccattaaaatcacttttccggctggataaccagctttttgtgacacgacttttgtatgatcatacgcatcaataattggttgtgcctgcaaaagcatccctgctccgccaccaaatggataatcgtcaacatgtctatgcttatcttccgtaaactcacgaaaatttgtgacttctaaatcaattgtttgattctcgatagcccttccaataatcgaatcgtgcataggcaccgcaaacatttccggaaacaaacttaacacatcaattcgcatcgtccaagccctccggaatctctacattaattttgtgatttttaagatcgacctctttaacaacggaatcaattttaggcagtaataaatctttttttgctttccgttgaacgacccagacatcattggctccgggagataagatttcttttatctggccaatcaaattatctccttcataaacatccagtccaataatttggtgataataatattcacccggttttaaatcatcatctgagagactggttgcgccaatcaaaagtgtcgatggttttaaaaattcaacatcattaattgtcgggtaacctttaaaatgtaaaagcacaaagcctttatgttttcggacgccatctatttctaacgaaattaaggccttggacttttcggtttgggcaaaaatcgtgttcccttttttaaatcttttttctggaaaatcggtaattgcgatcactcttacttcacccttgagtccctgtgtgttaacaatttttccaacgttatagtagtccatttaatcctccatccaaataataaaaaagctctcaaacaaaacattcgtttcgcttaagaaccactttactgtttttcatcgtcaacgattaaacgagcttttttaggcccattaactgggacactataaacaaccgttcgaatagtctgaatcacgtgaccatgtttgccaatgattcgtccaacatcctcttcgtttaactgaagatgatattccataaaacgatcagactcattatgcgaaatttgaatttcgtcaggataatcgactaacggtgaaacaatctttttaattaatctatcaacactaaccatgatgacaaatcactcacttacttttttgagtatttagcgtcgtgatatttcttcatgatacctgcatctgataataagttacgaacagtatcagatggttgagcaccattgtttaaccagttcatgattgattcctcttcaagagtaaccttagctggttgagttaatgggctgtaagtaccaacattttcgatgaaacgaccgtcacgagggctacgtgaatctgcaactacgatacggtagtaaggacgtttctttgaacccatgcgttttaagcgaatctttactgacatgcattttacctcctataatcatttaacgattaataatataccagtattttcagtgcttgtaaaggtttttttctttacaccgttaaaactctttaaaatattggtttttaatgctttttacgtttcttttttaatcgcttctttttgttctttttcattttccgaccaaactgtttcattgccaacttggatagcttaccgcccatcccggtctgccccatcatattttccattccagacatgtttcccttggaaactttattcatcatcgtcttcatttgaccaaattgcttaatcatccgattgacctcttgaatcggccgaccagatccccgagaaatccgccgtctacgtgacggattcataacatctgggtctgttcgttcctgttcagtcattgaatagataattgcttttaaatgatccatgtcttttggattcatattaacgttttgaagggctggattattagccatccccggaatcatcttcataatttcatccaaggggcccatcttttgaatctgatccaactgatcaagaaaatcattgaaatcaaatgtattttctttaatcttttcagataattcttcggcctgtttttggtcatattctttctgggttttctcaatcagggaaagcatatcacccattcccaaaatacgagaagccatccgatcagggtgaaagacatccaagtcttccattttctccccctgaccgacaaatttaatcggtttacctgtaaccgcacggattgaaagcgcagcaccaccacgggtgtcaccatctaattttgttaatacaacaccagtaacatcaagtgtcttatcgaatccctctgccgtcgcaacagcattttgcccagtcattgcatcaataaccagcaagatttcatcaggattaacagccttttttatgttactaagttcgtccatcaacttttcatcaatttgaagacgacctgcagtatcaataatcacatagtcattatgatcttccttggccttttcaagacctcgcttggcaatctcaaccggatcaacatccgttccaagctgaaagaccggcacatccacctgttgaccaaccgtttgtaattgttcaatagctgctggtcggtaaacatcatctgcaattaataacggtcgggcattttgctcgttctttaatttaagcgccagtttaccaactgtcgtcgttttaccggcaccttgaagccccgacatcatgatcaccgttggaattttttcggatttatttaaaggaacggcttcctggcccattgtcttggttaactcttcgtcaacaattttaacaatttgttgagatggatttaatccttcaagaaccttggcaccttttgcacgttcttcaacggttttaacaaacgttcgaacaacttggaaattaacatcggcctcaagcaatgccaaacgaatttcccgcatggttgcacgaagatcggcttcgctaactttgcccttgccacggagctttttcatagcgttttgtaaacgttcagttagtccttcaaaagccattatttcaccactttcattcttcttcggtagtctctaagctactgatcattttatttaactcggcatcatgaggatagtgttttgcagcatatgcttgaatctgatccaatttatcattacgttcaataaaactatgatataaatttaatttatcttcatactgctgcaatattttctccgatcgccgaatattatcgtacactgcctgacggctaatctcatactcttcagcaatttcacccaacgaaaaatcatcagcataatacaattgaatataatttgcctgttttctagttaataaaggctcgtaaaattcaaataacgaattgatgtaattagttttttcaagttcattagccatacttgaactcctctgattaagtgatctgcaaaagctaatggtccttagctataaattaatatgccattgagttagcttacacacttacttagattaccgacttttttaaatgccgtcaactctggatttaacaaccctattccgaaattaatcctttgaacagcccataaacaaaatcatttggatcaaagggcttcaggtcagtcactttttcaccaagtccaacgtacttaaccggtaagtgaagttcggaacgaattgccaaaacaatgccacctcgagcagtgccatccagcttggttaatacaattcccgtcacatccgttgcttctttaaacatttttgcctgtgtcattgcgttttggccagtagttgcatcaagcaccaatagtacctcatgtggtgcctcgggaatttctcgtgtcaaaattttcttcattttgcttaactcattcatcaggttgactttattttgcagccgaccagctgtatcgaccattaaaatatcatagtgttcatcacgagccttttttacagcgtcaaaaacaactgacgatggatcacttttgggcttactttttacaatatcaacgccatctcgttgagcccaaacatttaattgttcaatcgcacccgctctaaacgtatctgctgctgcaagcacaactttcttcccctgatctttatacatcttagccattttgccaatcgttgtcgttttaccaacaccattgacaccgaccattaaaataacagttggtccgctcttagccaaattgatggcgggattttcaccatttccagcctgatcatacatatcaatcagctttttcacaataacattttgaacatctttaggcttctttgcattctgaagcttaacctcttcgcgcaagtcgtccgcaatcttcatagatgtttcaaaaccgacatcagactcaattaacatatcttcaagatcatcaaagaaagattcatccacgtgtctaaaattagccaataacgcattgagcttttgaccaaatgatgagcgggacttagctaatcccttctcatatgattgagttgccccactttctgatgcggcctcagaatccatacctgctgtctcgggagcttctggtactttagaatggccatctacatcagaatccggttcttcgtcgattgtctgtgctttgtcagtaacgcctgtatcccgaggctcttctggtttcttatcctcatcatgcacattgcttttcgagggctcagtagttggctttgcctcgggttcaacagcttctgacacgtctggagtcgatgcttgagcaactggcgttgtcttctcggtgttctgtgagtcttttgaaaatgaagcacttgaatccttggtttcgtcagccattgagtcctcattcttacttttagcagcactttccggctcattctggtgagatgattcctgtttaacttcctgttcaacagatttggattcttcggtagcttgttgctgatcctgaacagatctggtttcctgttcctttttttctttttcttcgtccttattcttcttcgaacgacgtctaaagatatcaaataagcccatttaactcacctctgtttttaaattatccaaattaacacttacaacttttgaaacgcctgattcttgcatggtaatgccataaagcgtatcagcataaatcattgtttcctttcggtgggtaataacaatgaattgggtctcatcgccaaattttttcaaatacctagcaaatctatccgcattaaagggatccagagcagcctctgcctcgtctaaaatgcagaagggcacaggtgacaccttaataattgcaaaaagcagcgtgattgccgttaatgccttttccccacccgaaagtaggctcaagctccgataattcttaccaggtggtttaaccattatttcaatgcctgttgtcagcatattatcaggatccgttaggactaattttgcttcaccgccaccgaacatctcaacaaaaacctttgaaaaagactttgctactttgtcaaaggttgtttggaattttttggaaattgttgtgtccatttcacccatagtagacgtcagatgatttttggcatctgttaaatcctgctgttgtttcaataaaaagtcataacgatcggaaacatcttgaaattcctgaatagctgaaatattgacggggccaatctcattaatacccgttctcaataattttatttgtcgagaaatcgtttccagatcccaatgccattcggtgtgacttaaatctgatttgaggatcccgaaatcatgagatagctgattaagtgagccatccaatgatttttgaagattttgaaaatcctcccgattatttttcaattcatatgtggcattattcaaattcatttgttgatttcgaatgtcattttgtaattgatcgtattgtttatctgaccgatcaaccaactccttttgtgttttcaaagaagttgttaatgccccttgtttgtcagagctttctttaattaattttgtaatctcttcggggtcgatttgctcagcaagatcagcttgaagattttttaattgtgtctccaaatcctgacgttgatttttcaattgatcaaactgacttgagagtcttttttgatcgtcttgataatgctgcaactgttctttcgaaatgacaatttggtcatgtaatgattgcttttgtttttcaaaactttcagcgtttttctttacatcactaagtagtgactggttcttttctatggcagatgccacttgtgtaatttcttggtccaattgtgatttttttaaagccaggttttgatctgaagaatcttggttctgctgtttaacgttatgcaaagatagctttaacgcatcaagttcccgtttttgactggttttggaagctcttaaagaatctagcgctgatttttgtgcatcaaccatctgacctgattgaaacaccaattgtctgccgcgatcaaaggaagcctgaattttctgcagctcttgtttagcaatttgcagttgatgttctttgtcagtcaacttgactgacatctctttggttgaaacttcaagcttctcaagctcacttttttgaacaagaacgccttgcccctctgatctatttgcgcctccggttagtgacccaccagcattaacaatctgaccatccaaagaaacaatacgcgttctatgattgatttgttgagacagctgaacggcatcatccaacgtttcagcaatcagggttgtccccaaaaggaagtcaagaatcgcttggaattcttccggcacggaaactagattggaagcaatcccaacatatccggaaacttgttttgctgacgaaactatgccggcatttaaaaatctggatttgattgttgaaaccggcaataatgtgacacggccatatcgattcttggtcataaatttaattgccgccgatgcacttgtattatcacgaacaatgatatgttgtgcctgactgccaagtgcagtttcaatcgcttttacgaaccgatcatttaccttgacataatctgaaaccggcccatagataccctcaagagccgatcgatgtctaagcaggttagctgttccccgataaaaagccctgtaggagtcatgcaaattcttcaatgaattaactttagctttagcctgttcagcaatttttaaagcggacaaccagtttgactgcgtgtcattgacaagatcagtcttttgtttcaacaatcgttttaagtcggttaatttttgctgctcattttgcaactttttcaccgatccctgataggcttcatccttatctcggatttgactttcaagattttctaagtcgctgttagcacgtccaatccgctgttgctgagcgccggtttgttcattaaatcgctgtgcatctttttgattcattaagatttgattttttaaatcactctgttgctgtaaaaggtcaaagtatcgactatgtcccttcttaattttttcttcaataacgggaacactgttttcgtcagcagcctgttgaacttttcgcaagttacttctattaaccgttaacgcgacctgtgtctgattgaccaatttagacgatcgggccaatttcttttctaattctgaaagttgctgatcaatggtcccaagttgatttgaaactcgcttcatatctgcattcttaaaactactttcctgagaagacaattgttgtttacttttcaaagactcaatacgtgttgcaattgataccaacgtcgtattgagtttatcaacccgttggcgtccagaattcaatgtttttttcagcttatcacgctgttgctctttttggtgaacctgagccgtgagccgtttcacaacttgctgtgatccactcactttttgagccaatacttgttcttgaaggatctgacctttagcgttcattattaattgttctttttccaactcgtcaaggcgttttttttgatctaaataatcagttgcttgactgctttgctcttccaaaggttttaaacggaccttcagttcatgaataatatcattaacccgatccagattatcacttgtctggacaatctcagcctgcgccgtcgatttctggcgcttatacttatagacacccgcaacgttttcaataattgaacgacggtcgaccggtttactattaaaaatttcttcaacattcccttgagaaataattgataaactgccttggccaattccagtgtccataaagagactggcaatgtctttcaagcgacattgcttttcattaataaaataagaactgtccccattacgaaataattttcgtgaaaccttgatttctgaatatggtgagtcaagataatggtcagaattatccaatagtaaggtaacggccgccatattaagcgaccgtcgatcagccgaaccggaaaaaataacatcaggcatccgggacccccgcaaatttttggcagactgctcccccagtacccaacgaatagcttcggctatattactctttccacttccattagggccaacgattccagtcattccattcggaaaagatatttttgttttttcggcgaatgatttaaagccaataatttcaatggatttaagttgcacgatgtttctccaatctaaactaaattatcttcccgtttactaaaatgttttaaagcttcttgggcagctcgttgttccgcatccttcttagaatggccaataccgacccctaataatttatcgtcaattgcgacattaactttaaagagtcgatcattatcagggccgtactcatcaaccaattcataatcaatatcaactgggccatcggcttgagccaactcctgcagttcagtcttatgatcaaagaatttagcaaacatcccttcatccaacttgggaaagatcacttgttgaacaaagccctcgacaaccgttttgccttgatccagatagagtgcgcccacaaatgattcgaaaatatcacataagagcgaatcgcggtcacgggcgccggccttctcttcacctttccccaaccggatatacttattaaagtggcattccctggcaaacgtactgaaactctgctcattaaccattgcagctcgcaatctcgttaaccgaccctgaggaagtttaggatagcgtttgaaaatatattctgacacaatcaactgtagaacggcatcgcctaaaaactccagtcgctcataaaactttagatgctgatcacgatgttcattgacatatgatgcctgtgtaaaagcctcatcaagtaaatcctgatcatcaatatgaatattaaagtcctgctttaacatctcatttaatcctggtatcaaataattgcctccaaattaatgtgcaaattcgttacatcaacaatttcgaccatcaaaagttaatctttttgatgactcataacataatcaacagcttcgtcaattgtatttagcttttctgcatcgtcgtcagaaatctctgcgttaaatgtatcttcaagatcaagaacgaattcaacaaaatcaattgagtcagcatctaaatccttacgaaagttcaaactgccggtaattttttcacgatcaatatcgaattgatccgcgactaagtctgcaattttattaaatacttcatttttatccatcatattacacctattccaatttattaattcaaaaactattatatcaaactatttactgtttttaatagtctctttaatctcctgaagctgatcggtatgactgtttaaataattgtttagatcagaaatcatttttgaatcaatcatttgcttaatttgaccaattgtattcttaacagtcggtgctttgctactaccatgtgtttttacaaccggcgctttgacacccattaaaacagcaccgccatattgagaataatccattgatttggcaatttggccaaaggtcccttttagcatggccgcacccagttttgatgtcatgcccccagacatgatactccctttaatcaaatgaagcattgataaagccgtaccttcgatacttttaagaacagcattgcccgtaaaaccatccgtaacaacaatgtcagctgcgccatttagtaattcacgagattcaacattcccaataaagtgaatatcagagtcatcggctaaaagatcatgcacttttcgatgatccatatctcctttgtcagcctcagtaccattatttaacaagccaacacgcggattgttaaccttcataacgtttgaagcataatacttacccattaaagcatactgatacatattcaagacctttgtatccgcattggcaccaacgtcaagcatcacaaagtttttttgatcatccttcgtaataaccgggagcgtcgttgcgagcccaggacgatcaatgcccttaattcgaccaataataaacaggccggatgctaaaattgccccggtattaccggccgagaaaaacgcatccgcctgcccctctttaacagcagttgctgctaaaaccatgctggattgttttttggtcctaacagccttaaccggttcatcacccatttcgatgacctcgtcagcctgtttgatctcgattctggtatcatcctttaagtatttttggatttgatcagttaacccaaataaaagaaactcaatatcgggataggcatctctggcaagctcgatgccctcaacaatctctttgggcgcataatctccacccattgcatcaacggcaattttcatttttgaatctccttagtcataattaatagtttgattaaattgcaaatactttgctaattgtacattctctggcttgtttttccaatgcttttcagccgtaatattttgcgcttcctgattaacaactgtcaaaatatttaaatcgccaacagggtcggcaactttaaaatcgggcattcccgactgttttgctccggtaatatccccttgccctcttagttccagatccttttgggatagaaaaaaaccattagtgctactggcaacagctttcattctttccttgccaagctcatttttaggatcagcaattaagacacaataggattgggttgaaccacggccaactcttccacgaagttgatgcagttgagcaaggccaaaatgatcagcatcaaaaattaacatcgtgtttgcatttgcaacatcaaccccaacctcgattaccgttgttgcaaccaatacttgaaattgattatttttaaagctgaccattgtgtcatctttttcctgattggacatttggccatgcaacagcccaaccttaaattgtggttcaaatattgttttaaagcgctcaaaaatggccaccgcgtttttcatatcaacagcttccgattcttcaataagcggtgtcacaacatatacttgattgccattgtctagttgctttttaacaaaccgaatcgcactattggtctttgccgatgttatccatgttgttttaatcggctttctaccggagggaagctgattaataattgaaacgtccatatcaccatacatcgtaatcgcaagcgtcctgggaattggtgttgcagtcattgccaacatattggtactggttcccttttgacgaagtgcctgtctttgattaacaccaaatcgatgttgttcatcaatcactgccaaccccaaattgtcatattgcacgtcattttgaaataaggcgtgagtcccaactatcagatccacctcaccgctttgaatgcttggcagcattgctcgtcgagccgccgctgaagtatctccggttaataatgcaatattgacatctaaaccatcaaacatttttgcaaaattatttgcatgctgttctgctaggatttcggtaggtgccataattgcagcctgcttatgggcactgattgttgctaaaatagccatcgcagcaacaaccgttttgccgcttcccacatccccttgaagcagtcgattcatctgaattggacggtttaagtcggccaaaatttcacggacaactttttgttgtgccggtgttaaatcaaatggtaaacttttttgaaacttttctaacaaactctgttgataatgaatttgtgcgtgtggatccgtttttcgatgagattcttttaaaatttgcactttcaatgcaaataagaaaaattccataaattttgcggttctgaaagcacgctgtgcagcttggggtgattctggaaaatggatatttcgaattgtatccggaaaagattctaatcggtattttgctcttaattgatccggaatcacgtttgttaattgagtgtgatacatatcatatgccatcttaattaacgatttaattgtggcttgtttaacctctttatttgccggataaattgaatcgaatgaattggaactctgatcagttaaaattttcataccttgaatttgatttctggatcgattataagtcccgaatacaatgatctcatcatttgggttgacttcctttttcaaccatggctgattaaaaaaagaaaccgtgtagatattgtcattgattttcagacgaaagaccaaacgactttttttgcgcccaaaataggtaagggttggcggcgcaatgaccattccctttaccgttactttttgaccatcaatggcatttgagagatctttaattgataaatcatcgtatcggcgagggaagtacgtcagcaagtcattaatcgtattaattcccagcttattgagtgcaaccaaacgcttagtgcctactccctttagtacggccaccgaatcgtttaaactagtcaaattgaccgttcctttcgttttaaaaatatcttggtcattatccaaaatctacgagtttaaaaggccaaaagtccttagaagacaagtcccttaatgacggcagaaagaggttgggaaccaaagtatcataacttttgtcccagcctctcttcactgcttatactattctacagaaattaaaaacggataaaccggctgatcgccttcatgaacttcaacttcgagttcgtcatccaactgaatgatcccggcttggactttatcagcaagtctttcattggcgttatctccccaaatgattgtaattgcttcactatcatcgtccaacatcttgccgaccattgaaacggctgttttaatcaaatcatcatcgactgttacaatttttccatctgcaatacccatatactgatcttttttaatttcaagaccatcaatattagaatcacggattgccgttgtgacttgtccggatttaaccgttggtaaattatcttccattgccttttgattctcatccagcgcattttccgggttaaagcccagcattgccgtaattccctgggaaattgttttagaatgaacaataaccgttggtatatcaacaacctcagcggcctgttcagcagctaagaaaatatttttattgttaggcaacacaataacctgttttgcatgcgtctcttgaatggcattcacaatatcagcagtgctgggattcattgtttgtccaccattaacaatgtaattgacacccaggctcttaaataagtcattaagtcccttaccggaagaaattgagataatagcagtatcggaaaccggttggtctgctttggcgtcaatactttctgccttttgaatcggtgaaggtatatccttttcatcatcattttcgataattgtttcttgctgcaaacgcatgttatcaactttaacagttgctaaatcgccaaactcctgaccccaggcaaggaccttacctggatgctcggtgtgaacgtgaaccttaacgatttcctcatcattcacaaccaataatgagtcgcctaatttggcaagataatcataaaaggtttgataatcaaatttgcgatcaacttctttaccttttccaattcgaaccattatttgcgtacaataaccataaacaatatcatcaggatccagcttgctttgaacactttggtgatgggctgcatcaatcatttctgtcatttccgcatccgttggctgatattcacccttttcagcgtctatacggccgtttagcacgtcgtcaaaagcttccaagacaaacatgagcccctgaccgccagaatcaacgacacccacctgtttaaggacaggcaaaagatccggtgtcttttttaacgcgatttttgaattttcgtaaacagcatccattacagctacaatatcatttgtggttgcagctgtttttttaccggcttgtgctgccattctaataaccgttaagattgttccttctgtcggcttcataactgacttgtaagccgtttcggtaccagatacaaaggcgtcagccagatcctgagcgcttaatgtttccttattttcagttgattttgaaaatcctctaaagatttgagaaagaatcacaccggaattccctctggcacccattagcaaccctttcgccaaagatgagcaaagactgccaacacttgtactaacgtccttattaacatacttataaccgcttgccagcgacaagctcatatttgtcccagtatccccatcgggaaccgggaaaacgtttaaagaatttataaaatcagtatttttatttaatttattagatgcagcttgaaccatcgccgtaaattcggtgttggtaatttccgttactttcaactacttttcctccttggtcaattgtcgtaattttagtcttcgtttgctacttgaacaccctgaacaattacattgaccgaattagcggttacaccaagcatgctttgtaaatcatatttaacctttgcctgaacggctttggccacctcagaaatcttattgccataggcgacaataatataaacattgatgacgatttcgttgttatgctgtttaacctcgacacctttgaaatagttttccctattcaaaatatcattcatattatcacgaatttgattacggcttgccatgccaacgacaccataattgtcagtagcagcaccgccaacaacgttagcaatgacatcattgtcaatatccactgtaccaaactttgtttttattttgacggccatgtgtaacagcctccttaaattagtctatcaacatattaacgataattaatattaccacaatcccgagtaaaaccaaagtaagcaccattaagattaaaagccgtgtcaagtataattacttgaaagaaaagtgttgcaatatcaaggcaactatgataaattattcaagtgtaatgattcagaaattcagcactagaattcttatagaagggagatttgttaccccatggctaaagattttatcagtggcaaacgtactcactttggtaacaaacgttcacacgccttgaactcaagccgtcgcagctggaagccaaacttgcaaaaagttcggatccttgttgatggcaaaccaaaaaaagtttggatctctgcccgtacacttaaatcgggtaaagtgactcgcgtttagttaaaaaaagatcgattttatcggtctttttttgtggaaaaataaggaatccggaaaaccgaataaactggttttccggattttttgagcctctgttgcactttacaatgactttattcataacaactctgcgacacaccaatttataataccgacttaaacttgaaatgctaatcaagcgtttgcgtcttgattcgatccatcggaatatgacgctgttcatatttttcatttgtttttcccaagaccagacctgcaactggtatttggccctcaggcaacttcatttctttcataagcgttttgttttgattcaaggccgtaatgacgccccaaatatgacatgcgccaatcccgagtgccacagcctcaatattcatattctcaatgatagtcgccgcatttgaataggctgcattatctgctggtgttccttgaagtttcgttgatgctataataaatagtggtgcaccataaagcattgactgactgacattaaaaatttgctgtgcgttttgatccaagcgttgaagccaatcttgactagtaatcaccgtcagcgataaactgtcatattttcccattgaaaccggagatgcgtacgctgttatcaagatttgatttagatcattatctgaaatcatttctccggtgtaagttcgaacggattttcgattaataatggcatcaattgtcttcaaaataaaacttccttccctgcttcttatatataaataaaaaacacagtactgactgtaagttagaaaccgtttccaacgtcctcattgtaacatgtattgaatcggtggaattatcaccattaaaacaagcttgtgcttaaaagaggttgggcaaaataattgtccaacctcttttagtataatcacgcttatgaccaagtaagaatgtgagaaaagcatccttaattaaaccgattaatatccttactttgaatcacacacataaccccactggcaaatttaaatcgagccttgttaccgacaaactcattgctggcaagagaaacggggcgtttaacctgataatcatttagtttatatttctcatcaaacagtgttaaatgatccattggtgtcaaagcaacgaacgccaaatattttttatcgggttcttttttgatgtcatattcaccgggtaagaaaaaggtaatcgtattttgcttatcaatcattctgatcttaggcgcatattttttaaatcgcggttccaagaccatccataaattagcgaggaaatgatccaaacgaccgcctgtggcaccgtaaatatctaatcgatccgcatgatgttcttcaatagccactttcaatcccaattgggtgtcggtgtcatctttttcaggaattgactggcggatatctttgatatgtgtctttactaactttaattcctcggtctttaatgaatcaaaatcaccaatagccacaattggatcgattcccatatcaattaaatgtagatttccacgatcaataccgatccaatcgccatttattttacccgctttcaattcagcaggccacaagtcaactggcccaccgaccaaaaggtttaaaactttcattatctagtagcgtcctttaatgctttgatctttgaaactggatcgtcagcgtcaaaaatatatgaaccggcaacggcaactgtagcgccagctttatatgcgccaacaacagtggtttcgttaacgccaccatcaatttcaatatcaaagttcaatccttgttcttttttaatcttatctaattctgcaatctttttaactgtttcaggcaagaacttttgaccaccaaatcctggattaacagtcataacaagaacttgatcaaccatgtaaagaacgggtgtaattgctgatacgggtgttcctggattaatgaccacttcagccttaacattgcgatttttaatcatttgaagcgcacgatgaatatgtggtgttgcttcagtatgaacaccaataatatcagcaccggcatctgcaaagtcatcaatataacgttctgggttttggaccatcatgtgaacatccaacgttaagttagtaattggtttaattgccttaacccagcccggcccatatgatagtgcaggcacaaaggcaccgtccatgatatcaatatgaagtagctcagcgccacctttatcaaccttttcaatatctctttgcaaatttacatagtcggcactcaaaattgaaggtgcaatcttaatcataatcaacttcctcactttttataatttggtttacggttcttaatatcagtatacaactgtaaataattttcgtaacggcttttcataatttgaccggattcaacttgtcgtttgacctcgcaatccggctcattaacgtgcatacatccacgaaaacgacattttgaagatgctcgcttaaactcaggaaaatagcccgcaagttctcgaaaatctatatcaagtgtatcatacgatgagaaccctggggtatcagcaatcaacccatcgttgacatttaataatgccactcgacgtgtcgtatgtttcccacgattcaatgcagccgagatttcaccggtctttaaatccagattaggggccagatggtttaacaaagtggacttccctgcaccggtttggcccatgatgacattttctttttttgaaaataatttacggagccgattcaaagcctcatctgaaaacgccgagtccggtaaaataacttcatatggaatttttgcataatcagcagcgattgttgctaattcctgtcgtttgctttcgctcaataaatcggttttggtaaagtaaatgatcggctgaatctggctgatctctaatgcaatcaactgccgatccaataaattactcgaaaactccggttgcgttgccgccgttgtgacaattgcctgatcaatatttgcaattggcggtcgaaccaaagaatttttccttggcaatatttctaaaatataccccttatcgccatcctcgatttgaaactcaacatcgtcgcccactaagggcgtaatctttcgtttccgaaagttcccccgggcacgtgtccgataaactttgtcatcagcggtatgaacatcgtaaaagccggccaatgactgataaattttccccttggtcaatcaatcacctctgtcttagaataaaaaagttacttcgtccctattatacagacaagtaactttcttttgcagtttttatttttttaatgagaatcgtaagtaatattattatctcttaaaatggttttaccgtcacgaaccaccttgtaacggccaacctcattctttgttaatttaaacggcagcatcacggtggtatcccgtgtaatcaccatttgtttatacacagttgaataatcatgatcatgatctttcaagtaaatcaaaacaacattttcaccagaaccggtcgtacttgcttcggtttccggagccggcgtttcacttgaagacgtttgtggttgaacactactgctaaacgcagaactcgatgacgactgcgaattgttagaattgctaaaatatggaatagtaactttcacattaaagctctccagttgatcctttgcttttgcttggggacctcttgataaccaaacaataatattaccgccttgctgaatactattattagccgccggtgattgacgaacaacccgacccttcttttgttcgttggagtaaacgtaatcaaaagttggattgattttttctttatttgcgtaactaacgacctgagccttggtcatatcagtcaggtcttttagaatgacttgttgaataccagtggacacaacgaatgttaacgtatggcctttaggatttacccgctttccagatgcaaaatcctgttgaagaatttttcctgactgaaaagatcccgaaggagcatttcttctgcgaactttaaatccttgtgcttccaaacgggacttcacttcgtcataatcctggccaacataattgtccaaacgaacttttttgataccagagctgataatgagtgccacccgggtattttttttgactttggtattctcttttggagtagatgtaataacacgatttcgatcgaccttttcactatttcgataagaaatttttccaactctcaaatcagcatcttcaagtttctccgtcgcgtcatttcttaaagtaccgctaatgaccggtactgttgtccgggcacttgcgctgactataaaaataacggcgaatataagaactaaaaaaccaataataccaccgattagccatcgacgacgccttttatggttttttcttttaggccgtttttcatcgctttgattggtctcttgtgcttcacgttgatcagcattagcattgtccgtcatcgaattttcaggaaaagcagaaaacggcatcacccgtgttttttcattcatttctgcgttttcttcgggaacaacgaatcttgattcgtctgccctggatttgtccagtgatgtatttaaatccgctgctaacgcattaacatccgggtaacggtcatgtggatttttggttgttgcctttaagaccacattttccaatgcttggggaattcgggggtcaaaatctctgacagatggaatcggctgctgtgaatgcttaattgcaattgagacggctgtgtcaccgttaaatggtactttacctgttaatatttcataaagaatgattcccaacgaatatatatcagattgcttagttgccatttggcctttaatctgttccggggacaggtaatgaatagacccgatgattgatttggtctgtgtcattgtgtcttcactttcaagtcgtgagataccaaaatcagtaatcttaatataaccgtttttatcgactaaaatattttgaggctttaaatcccggtgaataatattatgatgatgagcttcactaacagctgaacaaatttgctccatgatgttcacaacttcggcatatggaattggaaaccgatccttaatataatgtttaaggtcttccccatcaacgtactccattaccaagtactgcatgccttcaacttcatcaacatcataaataccaacgatatgaggattgtccaattcagttgcggccattgcttcatgttgaaatcgttttttagctttgggattatcccgaaaatcaagcctcagcaacttgacggcaacttctcgatttaaaattaaatcttcagccagataaacatcggccatgccaccttcaccaagccgactaataattttataacggccatttaacacgaatcccttattcatccggcatcacctccgaatcataacgggcaactaaaaccgtgatgttatcgaggccaccatttttattcgcaagcgataccagcaaattgcattttgcttgaatatcttcatccatcgacagaatttcttcaatatccggatcatctaccatgtttgtcagtccatccgtacaaagaagaatctggtcatttttttgaatgctgtacgctttaaaatcagccgaagaatcatcgttaatccccaaacttttagtaataatatttttatagggattgttcttagcctgatcaggtgtgatatccccatgtttgacaagttcattaacataggagtggtcctctgttatctgagtaagcttaccacctgaaagaacatagccgcgactatctccaatattggcaatgagactttcatcaccatcgataagagcagccaccatcgttgttcccattcccttcagtcgcctatccgaatttgattggttaataattgcggcattttcctgagccagcttttctataaaccaggatttaatgtcggaaagactgttaatatcagttttttcaaaactactgccaatgtgagtaacgaccatcttggaagcaacttcaccagcattattgccaccgatgccatcggtgataagggccaaaattaatccttgcttgttctcgaattttccaaccgcatcctcgttcttatcgcgaacttttccggtagacgattgataggcaatttgcatattgtatcaactccgttacgatttcctaaccaaagaacagacaaagaatccatccgagccaaaatcatcggggtaaatattaatcatcccgttttcatcagttgtcagattcaggtcagtcttggttggttcgatttgaaaatcaggatgtgcatcaagaaactgcttaatcacttcttgattttcttgttgaacgattgtacaggtactatatgtaatagtaccaccagtttttactttcggtgcgacggcttcaagaatttgcagctgaatttgtgataaatgattgatatcagctaacgtcttatcatacctgatttccggctttctacgcatcaagccaaatccggagcatggtgcatcaactaaaatatgatcaaacatttcatcagaaaacttctcatcaacttttcgggcatccagcgcctgggtttcaaccacaccatctactccaagccgtttagcatttctaatcacatttttcaatttattttggtgaatatccagtgcaatgacgcgaccattttttaaatcagctgcaatttgagtcgtttttccaccgggtgcgctacaagcatcaagaatcaaatcatcaggctgaatcgacattgactcaaccggcagcatagcactctcatcctgaatagttaataaaccattttcaaagaatgcactatgaaccacttgccccttatcaacaataatgccttcacccgcaacaaggctatcttccgtttgaaatccagcctgcgtaagttgatcagtcaattttgatttggtcgtttttgctttattaaaccgaacggattgtttaggtgcttgattcaatgatttaaaaacttggtccgccttttgcttgcccaactggccttcaataagcgataccaaccactcaggaacgctatatttaatcgaaatctttttgactggatcttcaattttgtcaggttccctaacacccttacgatccatctggtgaagaataccggtcacaaaacgccgtgtgccatcatgtcccattgactttgcaattttaatcgattcgtcaaaaattgcgcgtttaggaacacggtccaaatattcgagctgatacatcgctgtatataaaagttctttcacccagtcttctgtcttttccggatctctcaaaaatggcaccaattgatattccagtgtcattcgatgttgaatcacgccataaacaatattcgtaaaaagcgctttgtctacatcactcattgacgttgattcaatgaccgcgttaatctgtaaatttgaataagaaccgccactggtacgcaatagtgttctgacagccagttcccgtggattgttcgtttgatatttcatttagttaatcaccttttggccaacttttaaggcctgccctgctccgtttaaataatctgtaatcgcttgtcttggtttaccagcaggttgaagctccaaaatttccaagattgaacccccaccggcagcaatttgtaattgatgcttcgttttttcaacaatcactcctggttcaaggggggtctgcccatcaactactgctgatttccaaatcttagttcgtttaccattcaaagtcgtatacgctgttggatccggtcgaagtgcccgaacctttgcatctaccaaaaaagctgattttaaaaaatccaatttctcttcttcaggcttaattgtcggcgaaaaaatgactttttccggatcctgtttaattggggttatctcaccggaaataactttaggcagcgtttttaaaagcaggtccctgccgacaaggctcaatttagcaaacattgaagccgtatcatccgtattattaattggaatcgcctgttgcgcaagaatgtcacctgcatccatttttttcaccatataaataatactgatcccggtttccttatcaccatttaaaatagcatactggacgggtgcaccgccacgatatttcggtagtaaagaaccgtgaacattcacagctgcaattttaacagcattgagtaatttggttggtaagaactgaccaaatgcggcagtgacaataaggtcgggatgcatctcaattaattgttgcatctcgtcactgccactgattttttccggttggagaaccggaatgttcaatgcttcagcctgctgtttaactggagatttttgaatctgatgtttcctgccgactggtcgatcaggttgagtaactgctgccaatacttggtagccctgatctaccaatcctttcaaaaccggaacgccaaaacttggagttcccataaacacaactgttgtcaacgctatcgtttcctttccattctaaagttacataaaatcgagcggttcattatcaattgagattaataatcctccttgctgctttgtttgagacttaactaaaacgtcatcaagtgcagctttaagtttcggctcctgacgatatttaataatgatttgataaaaataacgattattaaccctggtaattgttttaggagttggtcccaatacaatcgccttattcgttaaataccggcgcaggaaaccggcaatttggtgcatttcatatgccgtctgtttttcagatggtgagctgccggtaattttgatggtgaagtaataaggcggatacttgccaagatgacgaatccgcatttcagtatgataaaacttttcgtaatcctgtgttttagccaactgaatagcgtaatgatcggggttaaatgtttgtatcacaacttctccctgcttatcagcacgtccggagcgtccggaaacttgcgttaatagttgaaatgttcgctcactggatcgaaaatcaggaaactgaagcgctgaatcagcatttaaaaccccaacaagtgtcacttccgggaaatcaagcccctttgcaatcatttgagttcctaataaaatatcggctttgtgagcaccgaatttattgatgattgcctcatgagatccctttttccgggttgtatcaacatccattctcaaaacacgggcagttggaaatagatccttaacctgttcttcaagctgctggctgccgatcccgtaatgccgaatacgcttactgtggcatttggggcaaaccgttgggatcggttccttatgaccacataaatggcagtttagtgtatgcgtatctttatgcatggttaaagagatgtcacagtttgggcattgaggaacataaccgcaatctctgcacataataaaagaggagtaacccctacgattcagtaacagaataatttgctcatgcttttccagcctatcggtaatcaagtttgaaagtcgtttggacaaaatatgtcgattatgagccatttcatccttcatatcaacaatcgaaacgtggggcagtgcatggttgttgaaacgatgaggcaacatgatcagctgatagacccccttcattgctcgcgcacgcgattccaacgatggcgttgcacttcccaatacaacagggcaatgattgtacgctgcccgccatttagccacgtctctggtctggtaacgcggcgtatcggattgcttataactactatcatgttcttcatccataataattaaaccaatattctccaaaggcgcgaagattgccgaacgaacaccaacaacaacttttgcctgaccgctattaatccgttgccattcgtcgtaccgttccccacttgacattgcgctgtgaagcatcgccacttggtccccaaacctacttcgaattctgccaacaatctggggagtcaacgtaatctctggaaccagcataagcgctgtcttaccaatactcagtgcatgggccatcgcctgtaaataaacttccgtctttccggaaccggtcaccccttcaagcaggaaagtcgtgtccgtttgttttccaattgcattattaatccgattgacggcagtttgctgatcttcattcaggtcaagcggataactttttgacacgggctgcaaaaatggatttcgaattctcctaacctgagtttcggttacccatccctgcttaacagctgtatcaagtacctgtttaccgacaccctcgtgcaaaagcttggattgaaggaacgtttgagacggttgttcatacaacatcttaagtaatcggcgttgaccaaccgcacgtttctgaacatctatcaacacatgatcgatttgctgttgattaagcttacttttataggctctagacaatatcggttttgcatgactggataattcataatgaactttaatctgatttgattttcggagtgccaaaatttctgcaattgtcttgttattaaatttttgccgatcatagtcaatttcgttttgaccatgaaaaatagccgggtaggtgtcccgtatttgatcagtcgctaataatttctttttaaatttcgttcgcataccaccgggtaacattgtctgcaaacaactaattttaaaggaaaaggttttatctgccatccactcggacaattttaacaattccggcgtaataaccggcgaaagatcaacgagtgaactgatttttttaagcttgccatcaaaggatgttttatctgaaagaccaatcacaaaaccagtgactcttctgcggccgaaaggaacctgtacccgcatgccggattgaatctgtttttcaaggctttcaggaattaaatagctatatggattatttgtttgacgtgttggcacatctacaataatttgtgcaacctgcaagaattagtcacccccttgtaaatcattatcggcttattaaacgatgactcaaaatatgaatgagttgctgggctactttttgtttgctctcaactgctgttttttgctggtctccgttggcaaacaggaaagtgacttgattattgtctgcactaaatccgatccctttttgggaaacgtcattagcgacaatgagatcaagatgttttgccttgatctttttttcggcattcgttatcaaatcattcgtttcggctgcaaaaccaatcacaacctgtgaggctttcttagttatcgcaacttcttttagaatatccggatttctgaccaagtttaaagtcatcgtctcattgtgatcgttttttttgatttttctgtctgaaacagttgctgggcgaaaatcagcaactgccgctgccattattaaaacatccgcatccacaaactgctgctgaacagtttgcaataaatctcgtgcggtttctactggcaggacttttacgctttcaggctttggtaacgttgtattggcagtaattaaagtcacctcggcaccagctagccgcgctgcctttgcaattgcaaatcccatctttccggatgaatgatttgtcaaataacgaaccgggtccaaaggctcgcgcgttccaccagctgtgatgacaattcgtttaccctcgagttcctttgatcccgaattaaagtgctgatccacccaatctaatatttcttcgggctcgggaaatcgtcccttaccggaataaccttccgccaaaaagccttcggcagtgtccatcacattgataccggcgctagtcaatgtctgcagatttgtttgggttgcaaaattgtccagcatatggacgttcatcgctggtacaacataaatcggcgcggtggttgcaagtagcgccgcattaaccacattatccgcaatgccgttagccatcttggcaattgtatcagctgttgcaggtgcaacgatcgctaaatctgactgatcggcaatcgcaacatggggaattgttttaggatcgtctgttgaaaaatcgtctttgacaacccgattcttgcttagactctgaaaagtcagtgggctgacaaatcgttgagcagactctgtcatgacaacatgcacatcgttatgattcttcactaacaatcgagtcagaattaaagatttatagacagcaatactaccggttacatacagcgaaacgcgtttattttgaaacaaatcagtcaccaccatttttaaattcacacttaattgtaacaaggatgtatggattagcaaaagccaaatgctttttatgacctttaattattcccaaaaaaatggcctggaacaatgatctgcttgttccggccacttaattgacatcatactcatttaattagttcaaatcacgattcttgggatcaattttcaaaacaccggcagcaatctcttcaaaagccttaccaaccgattttctggacttataactgtccaacaatggctttgctccagcatccaattcatgtgctcgcttacttgcaagcataattaatgaatatctagaatcaattttatcaagtaatttatcaacagatggataaagtaacattattaatcgtctcctaacattgattcataatcgggcatcactctggcaacctttaatcgttcacttctgataattgatttaatccgatcaacggctaatggcactttgtcatttagaactgcgtaatcataatttcgcatcatactgatttcaccaacggcttttttgatacgcttgttaataacatccattttgtcggttccacgaccaattaatcggtgctttaacgccattaagtcgggcggcgtcaaaaatacgaatacagcatccggacaatttgcacgaacttgcatcgcaccatttacttcaatttcaaggaaaacatccttaccagaattcaaagtctcattgacatattttaatggggtaccatagtaattgtcaacgtatttcgcgtattcaagcatttcaccgttttgaatattctgttcaaactgctcctttgaaacaaaataatagtcaacaccgtttttctcaccaggacgaggttttctggtcgtcattgacgttgagtactcaaagtcaacatccggttcctcaaaaagtgcttttctgacagttcccttaccaacgccggaaggaccggataaaacaattaacattcctctttttgccatcgtcaaaatcccttcaaatatttgtagtaacaaccattatcgttcatttttaagatttttacaagtctaacatctgtttcgcaataaatcataaaaattttaatattaggggttgatatttcgaactgtcgttcgtataataaagtcacaaacgaatgttcggagtgaaataacatgcaaagtaatcaatcatatttaacagaaattcgagacacggttaaaaacaactatcgccgctttttcgcaatcgattccacaaagccgacttacaacgatcttcctcagatgccggaattccaaatccaactttttcttagccaaacactaaaaactggttttccaatcaaaatccaatttaataatcaatcaccggcaatgggtggaaagctcacaaaattatctaacgaaagatacctattaacaaaccaacagcataacatgacccgaattgtaaatattttagaaattcggtccattcaaaagataaaataatagcagtaaatatatttatccacgttaagaatgtttcaaaaagtgcaagtcaatttttaatcaaaaactcaatttaaccaaataagccaaacacccaaaaaaggtatttggcttatttgagtgtatttcatgttttacctacataaccaatttttcaactcaagttcgaattcgagctttttcttcatcggccattgatatgagttcactcgcgtgttctttagttaatttggtcaccgtcgttcctgaaagcattctagaaatttcgttaacgctatcctgcttgttcagttccgtgatggtagtggttgttcgcccgtcatgtatctttttttgaataaagtagtgatggtcactcattgccgcaacctgtggtaagtgagtaatacataagacctgggacttcgttgaaattgtataaattttatttcccattgcttgggctactcggcctgaaactcccgtatcaacctcatcaaaaatgatcgaagtgacaccggctgcttttgcaaacatcgtttttagtgccaacataagccgtgataattccccgccggatgccgacttaaccaatggcagcattttttcaccgggattggtttgaatataaaattcaacttgatctgcacctaaacgattcaaagttgtactttctttaaagcgaacttcaaaaacagctttatccatataaagatcacgcaattgttgatgaactgcccgctctaattccttggcaaagcgcctgcgaatatcaccgatccttttagcattcttaattaaggaagtctttatttcagcaagctgctgctctaaattatcatcgtcatccgcatccccagacatgtcgcttaattcattctttattttttttaggtattctaaaatttgagtaacggagtcaccgtatttatgctttaactgatatattgtattaagtcgctgttcaacctgatccaaacgatcttgatcaaattctaaattatttaactgatcggaaatctgacttgccacatcctgcaacgtgtaaaaggcaccggataaatcgtcggagatttgtttaaaatccgggtccaactcttcaatttcctgcattgaactcattgatgagccaatagaatccaaagaactggtatcttcaccactgatgccttcgtaactattaagaagagcatcatgaattttttggaaattattcaatcgatcacgttcagccgtcaattcttcgtcctcatgttcatgaagatcagccgcctcaatttctttgatttgaaattttaacatgtcgacacgttgcgcccattccttctcattttgatgttttttttcattaattgcccgtaattttacaaattgatcataatctttttgatacgttaccaaaaccggttgaatggtgtcctcggcaaagtcatccaacaattcaatatggcgttcaggcttcatcaattcttgatgttcattttgaccttgaatatcaaccattgtttcaccaattcgacgaagcgttgcaatattaatcatcatgccgttaacacgacagctattgcgaccactggcaaatatctctctttcaatgatgacattcccgtcactatggtcaatcccaagttcatctagaacttcatatgtaggattatcatcacttaaaataaagttgccttgaattactgattttttagcaccagttcgtattaaatcgtgagatcctcttccaccaaccagtaaaccaaccgcgtcaatgatgatagacttcccagcacctgtttctccggtcaagacagtcatcccggactgaaattcaatatctaaatgttcaataatggcaaagtcagtaatagataattcaagtaacatttttaaaccctttcaaatgataacaaattaactcagcttgctagctgcttaccatactattaatccgcccacgaaaatcagcagcgtcttcatctgttttgcaaacaataaaaacggtgctgtcgtcgccaatggtcgcaaatatttcactataattcatttgataaagcagtgttgaaataactggaccactccccggcaacaccttcatgaaaacaaatttatcctgagaatctaccgatacaaaagaatcacgaatagtttggattagcttcttttcagtatcaacatttttttgagttggtaaactatatcgatagcccccagtaatcgaaggaaccttaaccaattgcatatctttaatatcgcgtgaaaccgttgcttgggtaaccttgacaccttgctcactcagcaaggaaacgaaatcttcctgccgctgaatatcgttactgacaagcagttgtttaatcaagcgctgtctttcctttttacgcatgagaacacctccaaaaattaacgagaaatcttttattgcttctttaactcagaataagcgttttcaatcactttttcaattgaaacatttggattcattcgaggttgctcaactgactttaattcaactaaaaactcaatgttgccggccccacccttaatcggtgaaaaatcaaggttttcaacagagtaaccggatgcgaccgcaaaattcaatattttttcaagcaccattttgtgaacagccggatcgtgaacaatgccatgtttaccaacatttttctttcctgcttcaaattgaggcttaatcaaagcaacaacctctccattgggaattaaaatcgccttcaatggcggtaggattaattcaagtgaaatgaacgaaacgtcaattgaagcaaactgtggctgtccctgagagaaatctgccaatttactatatctaaaattggtgtgctccatgacaacaactcttgggtcttgccgcagtttccacacaagttggttactgccaacatccaaagcataactgagtttggcaccattttgcagcataacatccgtaaatccacccgttgatgatccgatatcaagaacggttaagtctttaacactaatgccgaaaaccttaagtgctttttctagtttcaatccgccacgactcacgtatggcattggttttccctttaaatgcaactcggtgtccaccgaaatcttcatgcccggcttgtctaaacgttcttcgttatcgccaagtatctccccagccataacggccctctttgccctttcacgagtgtcaaagagaccttgagttactagtaatacatcaacgcgttgtttttccattatgcctttcatccttaattacaaaataactgcaaaaatctaataataaagaggtatcgatattcaacttatgacttgctgtatttaaagcgtgacgggctcgatcaaccgtccgctgtaaagcttcataagcaccatccaatcccataagattaggataggtgtttttatcagcatcctgatgaaccggtttgccaattgccttttcatcaccaacaatatcaagaatatcatcatagatttgaaacgctgctccaaaattattcgcaaacgccaacaaatcttttttctgatctttaggtacttgtgccatgattaaaccggcatttaccgcataagaaattaacgctccggttttattgcgatcaagtttctgaagttcatgcagctttaatcgtgtaccttcgaattctatatcatcggcttgtccggaagccataccacgtggacctgctgcttttgccaaagctaaggccaactgacaacgagtatcagcagtcaaatcattatcaacaacccattgaaatgcaagtgcctgtaaaccgtcacctgctaatgtcgccattcctgcaccatatattgtatgattagtaggtttaccgcgacgaagaccgtcattatccattgctggaagatcatcatgaattaacgaatatgaatgcaataattccaatgcacaagttgcctttaaaattgaatcagttattgtttgattgaaagttattaaggttgctattgttaaaagcggtcgtaatctttttcctcccgcattaaccgaatagctcattgactcaaacaatttttgctgatcggtatcctgttcgattttactttccaacacttggttaatcctgggcgtccattcctttatgaactcattgagcttggttcccattattatcatcctttgtattatctggactttcaaattgaacttcgttgccatctttatccatcattttggccattgtatgctcagcttttgtcaaggtttcttgaagctcttcgcttagtttaataccggttttaaatttatccatggaatcttcaagcgaaacgtttccttgctcaagttgatttacaatttgctccaatttatccattttttgctcaaatgtttcgttagactgactatctgccatcatcctcatcctcttttccttttgtcattttattgatagatgcattaataacaccatcagagaagtgaacgttaatcgtcttcgcttttaaatctgccattttgctaatgaagtgatcattttcatcagttgtatacgtatagcctctacctaaaattttcaaaggacttaggtgatcaagcgaaccaaccaacatctgatactgttgcttgactttattcaaattctgcaattgattctgcttaagacgcaactgcaacacattcaaacgttgcttttgctctttaatcatataagttggcgcaactaggcgaagtctcatatgtaactgagacaaattattttttcgtgatgtagttatcttatctgcttgattttccaaacgttgccttagtaggtctaatttttgggaaaaggtctcgtaaatccgttgaggtgaagtgaaaaccgtcgattgttgaagccgcttcaatcttaacttagcctgttcaatcaactgatattccgcattaataatccgattttgggttgcttttaattcaaccaacacttgatctaaacgtggaaccgccaattccgcagccgccgttggagtcgctgctcgaacatcggctaccagatccgcaatggtggtatccgtttcatgaccaacagatgaaataaccggaattgtacttgaagagattgctcgagccacattttcttcattaaatggccataaatcttcaatcgaaccaccgccacgaccaataatcaaggtatcaaaatgaccaagttgattcacctttacaatttgcttaacaatatcggtactggcctcgtcaccttgcactaaagccggaaacagaacaatttgagcaatcggataacgccgtcgaactgttgtaataatgtctcgaataacggcaccgctcggagaagtcaccacagcaatccttttcggaaactggaccaactgtcttttaggttgactaaataagccttctttatcaagcttcttttttagttgttcataagcctgataaagttggccaacgccatccggttccatactgtcaacatagatttgatagctgccactcggttcataaaccgaaatgtggccggttaccaaaactttcatcccctcttcaggaacaaacttaatccgattaaacgccgacttaaacataatcgcactaattttagcatggtcatcttttaagctaaaatattgatgccgcattggtcgtaatctgaaatttgaaatttcacctgtcaaataaactttcataagataaggatcaacatcaaattttcttttaatatattttgttaacgctgttactgatagatactcagttgtcacgatgaatgctccattctgccaaatcaacactttgctgcattagagtcgcaattgtcattgggccgacaccacccggtaccggtgtgatataagcaaccttgtcaaacaaatcatcgtaatcgacatcgccaaccaaatgccccttttcattaatattttgaccaacatcaattacagttgcccctacctttacgtcattcttggtcaacgtatgtagctgcccagttgcagaaacgatgatatctgcgtctttagtatattccgtaatgtcttttgttagtcgatgaagaatcgacacacttgcaccttggtttagcattaacgctgccatcggctttcctacaatagcacttcgtccgagcataaccgcattttttccttttaattcaatatggtattcggaaaacattgtcataattcccttgggcgtgcaagaaacaggatatttggtggaatcatttaaaaataatttgcccacattaactggatgaaagccgtcaacatctttttcaggtaaaattgcacgagtaacatctttttcattgatttggtcaggtaagggatcctgaaccaagatgccatgaattgcgggatcgttgttatactgaccaacccactccaaaagctctttttcagaaacactctcaggcagctgcttcacaattgagttaatgcctaaacgttgtgcagtccgatgcttgttacgaacgtatcgctgacttgccggatcatctccaacaatgatcacaaccagtcctggtgtgatgccatcattttcttgcattttttgaacccgttcactggtttgctgattaagcttctttgctaatgctcttccatcaatcactgtagccatctttacaactctctcccttgtgttttatgacaatgcttaaggccgctatgttgcggatagattatgtcaaaagtcttttttgtaatcatgaatgtaaagaaaaaaatagatttacattcatgtaaatctattttaccagttcttcgagagcatgtgacaaaatcccattaacaaattttcttgaacgatcatcgctatacttcttagccagttcaatcgcttcgtttatagaaacttttgcagggagatcatcaacatgcagcatttcataaagggcaatctccaaaataatcagatcagttttagcgatccgattaattgaccagccactttttaaatacttctcaattaagttgtcaagttcttctttgtgatccactacgccagtagtcaattcatccagatatttcggatactcatcaccatacttgccatcagttagaacttcaaagaaattttccttgtttgtttgtttattcgcatttagcgcaaataaagtttgaaacgcgatttcgcgaatttggtgtcgtgttaattccactatgcctcaccattctcttcgtccgcaaaggggttatttggatcaacagaactagttgttttttccggaataacgccttgcacatgaacgttaacttcatgaacctgtaatccggtcataaaaaatgcctgttgttcaacttgttcttgaatttcaagagcaactttgggaacagaaactccgtaatttaaataaacataaatgtcaaaacttaattcttcattttgatacgtcagtttaacaccttttccatgctcttttttgcgtgaaaatagttcattaacactggacgagaaagaccccctcattcgattaaccccatcgacctgtgaggcagcaattcccgcaatgatttccaaaacattcgtggcaagttcaatcttacctagttcgggatcattcgcacgaagaataatgttagtgtcttcagccattctaaagcctccgtttctgttctaaaaaagttatgctcgtgaaatgtaagtaccatcagttgtgttaatcactaatttatcaccttggttaacaaaaaatggtacttgaagtgttaagcctgttgtcattgtggcaggttttgaaccacctgaagcagtgtcacccttaattccaggttcagttgaggcaacctcaagagtaaccgtattaggcaggtcaacaccaagcgtttcgttgccatattgaatgacattaacttccatgttttcttgaagatagtttagttcagatttaatttgggcagctggaatagaaatttgatcataagtatccatgtccataaagacatgcatatcaccatcagcgtaaagatattgcattttacgttgatcaatttgagcttgttccattttggccccagatctgaatgtcttttcttgaacagcaccagttctaagattctttaatttagaacgaacaaatgcgccacctttgccgggttttacatgttgaaaactcaaaatacgccaaattgcgccatcaacttcgatggttaatccatttttaaaatcagcagtagaaattgccattaaatagttcctcctaaaagtacatgtttgtcagcttaaaatcaataaattgttgatttttaaaacttcaaacagccttattgtaaagtagcataacttgattatataatattttgatcctaaatagccaatttttcgtgaaacaagtagggtcttaaaaattataacaatcaaaaagcataaaaaaaggaccaataggccctcttcatcaaagttagttgttaataaaattacttagcagcttcagtaactgggtaaactgaaacttgacgcttgtcgcgacctttacgttcaaagcgaacaacaccgtctaccaatgcaaataatgtatcatcgttaccacgactaacattagcgcctgggtaaatgtgagttccgcgttgacgataaaggattgaaccactgtgaactgaagaaccatcagcagccttagcgcctaaacgacgaccagctgagttacgaccgttggcagttgatccaccacctttatggtgagagaagaattgtaagttcattgcaagcatatctacacctccagattaaagtttagttttctacgttcaacttaatatatttactatagctcgttgcgatgtcagccatcccattctcaaacgtcttcaaaatggcatcagattgaatttgtttggttgaattagcaataactggtatttcaaccgataagtaaccaccgtttttctcatcactgtcgacattaacatccaagcccacaacttcttgtaagccattaactgtagtgatgctaagaaccgaaactgctgagcaaacgatatcttgtccatattcaccagcatctgcatgcccagtgatcgtgatccctgacacatgccctttataatggtggatagtagccttaatcatcttatcagtacctcatcattcgtaaattaagccttgatagaatcgataacaaccttagtatatggttgacgatgaccctttttagaacgtgagcccttctttggtttgtaacggaagataataatcttcttttgacgaccttgtttttcaacagtgccagttactgatgcgccatcaactgttggcgtaccaaacttaactgaatcaccgccgaccataacaacttggtcaaaagtaaccttatcgccttcatttgcgtctaatttttcaacgtaaatagcgtcaccttctgaaaccttgtattgcttaccgcctgtagtaataactgcgtacatattgtgcacctccttatagttttgcttagactcgccgaaacgaagcgccccataaaggggtcttatagcttgaaccgagcggttgtagctgtggaagccacaattacaacgttctaagtatacataaatgagatgcgttcgtcaaattaattgttaggtgaaataataaaaaaacaaccgacaccgcggttgctttaatttatggctatttacgctgagccaaatgctttgcattctctttcatggatgttggagaaccgataaaatactgaataagtccacaaattgcgaaaattaaaacaataaaaagaacgaatcccacaacttccacctcctaatatataagcaatatcaatactgcttagtataattatccagctgaagcgcaaacttttcaaatattttgcatgagaggcattttcatttaatgaaaaataaactttcttaagaaaaacgtaattaattccggaagtaacaaattaacccaatttcgcattgactagttccatcatatttcctataatggttattgttgatttgtcgcaatagctcagctggatagagcaacggtcttctaaaccgtaggtcgagagttcgaatctctcttgcgacagtaatacaggtcttaaccaatgtagtcggttaagacgaaagcttctcaaatcgttggtaatcttcgatttgagaagctttttttacactataaaaccatttcattttggctcttcaaaatcatttgcaatatagtatcgccaaagaaatgagtgcctgccggcatattgatagttcctcgtattattttaaggaagagtgataggtcctatatgccaaagaaataaatatgcaaaaagtctgcttcaatctaatctgaagcaaactttttaatcttatgacttagaactaagttcccaaccattatctagcatctgatgatatttccgaccaaccggaatccaaatcttttcctgtaatattttttccatcgattcccagaatagtgggtcttggctctccttctttgataaattgagtttccaatacttctgattttcagtttttacaatgatgtatgggaagaaaacttttgttaactgggccgccacaacatttttaatcaattttgtgtcatctaataattttttcatttggaatcccttcctaatttgtttaaatttattagtacgatcacagtatgccaaaaataggttaaacggaccttaaaatcagtttaagttagtttaaattatcttacccgtccctatatcaccaacgttcacagcgtccatttaactttcccaataaaaaatgactctcgactgaatggccagtgatatcaaaatcctgctgcttgctaataatcacttcttcaatagaaaatagtaaactccataagataccaatcaaattgaaaagtcaattacactttttaataattattatcctgtcgttttaaattaatcttatttttatcattaaaagcatcttgaatctcttgttcagtataaccaaaatcaactaaaccaaattttagaaaaagtcgccaagaatgattgaaactgtctccactgtgattaaaataagcatcaaacaacatgcgcttcattgcaagatactgtttatcaaggttatcttctttttttaaatgcttgatcttctcaaaatcatcctgcgacttaagaacaaagtggttccagtttttaagattcgaaataagaagaaagaaatccagtgcatctacatattcataaagaagcgtttcccgaggcgtcttgcccgcatcactctttccacgatgcgttttccaaactttaaaccattccgatgtattagccatttctgccaattcaacatctaatgaaacaaaggcattttttaaccgggcttcgttagaccagaaaatctgctttttttgttcaatttgacgatttaaataaactgatgaagaaactaatgcctgcagatccatattgacacctcttgtattcttaattaatcatgtcgcttttaaataaataatccaaatgcaaatcagaattgatcacatttgaattattgagtttaaatgaattttacaacttttcattcgcccaagaacacacttgattttttaaataatctacccaaaaataaattgattagataaaatttcgagttgtttttggttatttaaataccattttttgataaatggatagtctaacaataaatataaccaattttcattttgttggtcatcacgaatagtcgcaccccattttggtcgattaccattttgatttgcatcatacacagtcatcttagtaccatttcccaaagttaatgaagcaccaccattatcttcagccattaacacaaaatgattctctgctgatttaacaaaaagctcatccatgacatcctcagacaatgtaccggcagcaaactgatagaattcaccattaacaccgtccaaaacattaaagtcaatcttaaagccaaaattttctttgagaatagctgcagcctttgttagtaattccagtgcatttttaatggcatcaatttcgagtccatccaagtcaacaacaaaatactcaattaaagaagcaccatgaaacattaattctttattttttaaatttaaataaaaaagtgggcgattattcaaagttggtccgaaaaagaagccatccgaatttttagtcgattttgtaaatgtaaatgtttgatcacccagtgaatcgaatttacatagaagcttttgaactctttggggattactaatccgaaaattattttcaattccagataatgaaagcagccgctcaaagaaaataagctgcacatcctcatcagaaaactgatgtggaaaggttacaaaatctgaattcaacttaaaattcgttagcgaaacggccgccgataataaactctgaccgtcagtggtttcactcagcgtatgaaaggcttgtaaatatttagagccattatccaacccgttttgtacggaatcactatagtttgccagtaactcgtttgtggtaattgttttttcttctgtttcattactcaccatcactcacctgcgattccttagaaagactttggaggtattttgtgtaaagattattattattttcaatgaaggcatcgaagcttccaaaggttgctctaatattttgcttttccaaagacaaaatagtctcttccttcgataatgctaaaattttgttttcgttttctttaattgttggacgaccgcctgttgcttcctcatcaatttgagtcagttttaacatttcatcatttaaacgttgtcgttcctcttttacttttcctgcttcccaaggcatcggtgatttttcttggttctcttttaactgttcccgaatctcttccttgcgtttatcacgttgatcttgttcgcctattaatttagtgattctttcattctcatcacccaatttttgcattgtatcgtcattcacgcgacggttctcagcttcaagttgaaatgatttcgataacatttgatattcgttgtcgtcaaaattaaaacgaacattaattggatcaagttcaccaaacatacgatgatcccaccaattcccaaaataaatgtgaaatttgcctaattcgtactcatgataataaaagaatggatatgtagcccccaaataatcaatcagcttattactcaaatgatgactcaactgagcagttaaatctgacgctagaccaaaatggtccgtttgagattcctcagtctcttctgtcgccaattcatttgcatagcggtttggatccattaattggtaaatttgtaaatcatcaccatttttaacagaatcatttaaatcgtttagatactgcatcttctcattcaatgcagaggagagtagcgtatcattttgactgaattgatccgtttccatttgtctttccataatatagcctcgtttttccccgttatttatataatcaatgttatctgaaaaatgtagataaataaagaccaaacgtaattatttcgtaataatttataattttgagataaaaagtcccagaaatatgcattcagcatacttctgagactaaattaacaggttatttttcgacaatatcatttattaactaatacttttcaagatattgatcgcgttcccactctgaaacttgagttcgatatgaatcgtattcaagattcttagcttcgatgaaactgttatagagacgttcgccaagtgcacctttcatcacttcatcagcagaaagatctttcaatgcgttatgcaaagtgtctggcaagttttgaatatggctcttttgtaactcatcagcattcattcggtaaatatttcggtcaacactgtgttcaggttcaatttgatttcttaaaccatcaaggccagcttccaaaacagttgcaattgccaaatatgggttagcagccggatcaacgcttcgcagttcaagacgagttgaattgccacgagcgcttggaattcgaataagaggtgaacggtttgaaccggaccaagcaacataaacaggtgcttcaaatcctggtaccaatcgtttgtatgaattaacgattgggttacatacggcagtaaaggaacgagcgtgctttaagagaccgccaagaaaataataggcttcttgtgataattccaattcaccatccttatcaaagaaggtgtttccagaatcattaaagagtgacatgttgatatgcataccagaaccattgataccgcttaatggttttggcatgaaagttgcgtataaaccatatttacgagcaacagtcttaacaaccagtttaaaggtttggatattatcagcagccgtcaatgcatcagcatacttgaagtcaatttcatgctgaccaggtgcaacttcatgatgggcagcttcaacatcaaagcccatttcttcaagagtaagtacaatttcacgacgacaattttcaccaagatccatcggtgccatgtcgaagtaacttcccttatcattcaaatgtaatgtaggatcaccattttcattcatcttgaataagaaaaactctggttcaggtccaatattgaacgctgtaaaacctgccttcttcatgtcggcaagaacacgaatcaggttatttcgaggatcagctgcgaacggttcaccatctggagtataaacttcacagatcacacgggcaattttaccgcgatcagtactccatgggaagatcatccaagttgacaaatcaggatgcaaatacatgtcactttcttcaattcgaacaaatccttcaattgaagaaccatcaaacatcaacttgttatccaataatttatccagttgaccgattggaacttcaacattcttaattgttccgaataaatcagtgaacatcagacgaagaaacttaacatcttcatcctttacaatcttgcgaatatcatcttttgaataattgtgtctcgtggccatttataacgctcctatcactcattaaatttgtggaaattatttggattgtcaaacgtcgaagaaggcggcttcagcccaccgatattcataaattcatcttgcagaattttcctgacatcactatcagtgagacccttttgtaaattctttttccgttcatcttcgagttgttcttgcttcttataaacctctttaatcccagaaatgttcagaccatcatccaggtaatctttgatttcgagaagcctgtcgacatcattaagcgaatacatccgcctgttaccttcattacgaacaggtttaattaaatcttgctgctcataatatcggatttgccgcgcagtcaggtcggtaagtttcattacggttccgatgggcaaaactgacattgaacgccgtagttccttctctcgcatgtttcacctcctaaattcttgtaatcataataccattcccacaaacaaagtcaagggcaaatgtcatgttttgtgacatcattttttcaatccctattttcaagccagtttccaacatctgcttctagtcgtttgacatcgtcagggaagtctaaaacatcgtaccagtttggctttgttttatttcgaaaccacgtcaactgacgtttagcataatgacgggaatctttctttacaaggtcaaccgcctcagttaaactgatttggtttttaaaataatcataaaattcatggtacccaattccctttccggcttgaagcttgtcgccaccatttttatagagatagtctgcttctttaagcaatccttgtgtcatcatcaaatcaacgcgatggttaattctgtcgtacaatttttttctgtcagttgtcaaaccaataatcaacgaatcatattgattaggttgattctcctgatctgaaaaacgattgccggttttgatatacacttctaaagcccgaatgacgcggcgaagattgtttgccggaattttttttgcagcttgtgggtccacacgctcaagttgttcatgcaaagccgcgttcccatgttccttagcctgatcaagaagctgctggcgtagcgtgtcattttcaaaccgatccccaccaagatcaagaccatctagcaatgcctgcaaataaaaaccggttccgcccacaataatcggcaaattccccgctatggatatttcgttaattaacttggttgcttcactcacaaaatctgcaactgaaaatcgttgatcaatatctctaacgtcaatgaggtggtgaacgaccccttccttttcttcctcagtgatcttagcagtgccaatgttaagatttcggtatacctgcatagaatccccagaaataacttcacctcgaaacattttcgctaactttatcgacatagcagttttaccaactgctgtcggccctacaattgccaaaacttttttcaaatcaagccacctcgcatttctgagcgcaattgaacagcccttcccggataatcggtaataatggccgccatattccgctcaaagcaatattgcatgtcttcagtagagtttactacccatggtcttaaatgccgcgcagacgcatagaaagggtgttgtttaatccatctaatgtcaggatgaaaatcttcaaccactttactgcgttttaatgtttttgcctgcttggctgccgttttaaagagtctggcttcatatgcttttgggtcgatcttattcaaaatttccagtgacttgccattaaagctggaatagattaattgaaacggataaggcaacgctgcaaaatattcgtaaaccgcccgctccaaaccaggataatgaattttattggtttttaattccaaattaaaaatcccagtaaaatttattttcattaacatattgaccacttcttgaagtgttggtacctgggttcccctgaactcctcactaaatctaatacctgcgtccaattttttaatttctcccagtgttttatccataatcaaacccgttccattggtcgttcgatcaactgtttcgtcatgcataataatgaactgcttgtccttggaaaaatgaacatcggtttcaattccctctgctccctcattaattgcagtttgaaacgaaacgagggtgttttcgggacgggttccccgactgccacgatgagcaattattttggtatcaatctgcatcacaaattaagctccttaatttatatttaaaacaatcaattaactagaaatctttctgtaaataacgcataatgaaactataaaagaatttttgggagggattgtaatgaaacattttactaatggtttgatcgttggtgttttaggaaccgttgccgctggtttaggcgcattactaacatttaagaaatctgttgttgatcctattgaagatcaagaacaaaaatttgaaaataaccgtaaacgggctatgcgcaaaagtcgagcagctcatcacggataaaaattaacctaatttaataacattaacgtaaaaaggccggaacaaaagaagttttacttttgtgtccggccttttattttagtttcacgttagcttaatgactctttttttccttaccatcccagttttgatagccggtttttaaaataaaaatattctgataccccttttttctcaaaaaaagagcggcacgtttactgactgttttaccttgatcatacaggtaaaccggtaaatctggacgaagttgttgataaaagttccgcattgttgaatatggaacgtttcgtgcaccaagaatatggccatccttaaaggttttcggctcacgcaaatcgactacttgtgccttacgcatacctgattgaaaatccttatttgtcagatacttggctgcttgtttcacacgatagttttggactagcgtgtagataagccaccccaacaaaataacgattaaaataattgacatccaaccatttgcattcaacgccccaacaatcaatttcagcatctctctttcaaacttttatttttatttcaaggatttagctatctacatagctttatcatttttaaattttaaagccaatgatgctgctccaataacaccagcatcattgcccaactgtgctaattttaatttggttgaatcacgaaccgatttaaacgcattttcttggaaataacgtgttgttggttgcaataacgtatttccggcatttgaaacaccaccaccaataataatattttcaggattcagtgtgtttccaacatgggataaagccaatccgaggtaagaacaaacttcattgacaatttgattggccaaaatatcaccattgtccgccaagaagaaaaccatcttcgacgttaattcttcttgaccttcaatcagttctttaatgcgtgatttaccagtaaaccgctttgccaaactcttagctaccttcacaacgccagttgcagaagcgtactgttccagacaaccacgtttaccacaagtacataagaatccgttcttttggacacaaatatgcccaatttcgccggcaccgttattaataccatgaacaagtttaccgttggtgacaacaccgccgccaacgccggttccaagcgtcacgaaaacaacatcgtcagccttatcgccggcacctttccaatactcacctaatgcagcggaattggcgtcattatcaattgcaatgggtaatcccaatccttcagtaattgtcggaccaacttgttgtacttgatcccagccaaggttgaatgcaccgacgactgtccctttttcacgattgacagcacctggcgtccccattccaataccgataaaatcatcagtattataatcttctcttctcatttgatcggcaattgatttaatcatatttggaacaatcttgttgccactatcgctaatatctgtcggaatactccattttgtgagaatattcccgtcctcgtcaataaatgcgaactttgtggtggttcctccaagatcaattccaattagtctcttacttgccaagataagtccccctgctttcatgtttttcttcaatacggtgttcatgagtcaaaatgagtttggcatggataaagtcatcatggctaattaagtgcgccttatgcaagtgatcaagctccaatgccatcacctctatgtcccacaaccgtttgccaacatatacatatatgttgaattttttcagtaactgctgaacatcatacagcgttttcattatctcacatcctcagctaaatttctttcaattttagaaatttatcctaaaaactactacgcatgcccattataaacattgcaataataatcacaaccagcgtgataccagccacaatccgctttaccaagctgacttttccaaaagtaacgccagaaacatacgcaattaaaaagccgcctaccaaaccacctaaatgaccggcaatatcaatcccggatacaaaaatatccgttgcgatatttaagacaataaataaaagaaacgttctagccatcgacacaatagcttggtttctggaaaagctttcgccaagcatcataaaagcaccaaacaacccaaaaatagaggtacttgcaccggcagataaacttggactgaaagcaaaacttgctaagttacctgcaattccagaagccaaaaagattaataaaaatcgccaatggccaaataacgtctctacgtattggcctataaaatataaagtaatcccgttcattaagatgtgtgtaaaaccgatatggatgaaaatgggtgtcagtagccgccaatattcaccagcacggataagtggattgtatttagcgccaaaccgaactaaattggcgacgttttcggttcctccggaaatagtcatcagtaaataaacaagtaccattattccgagtaaggcataagtcatatacggtttatctcgtaatctgcccataaaactaatctctccctttccattaatggataattttatcaatctttatatcaaaggattcaattggccaaattggttcatcaaaaaattgaggcggtgttgcaattgaaatggaaaggccatgaaaatcagtaagaaagcggtcataataaccaccaccaaagccaacccgatagtgattacgagaaaatgccagcccaggaacaacgaggatatcaattgcggatttagataccacagatccacctattggttccctggtcccaaactttgtgattgccaactgtgttgaatcatcgaataacacaaattccatttgacggtgtggaagcgttcgtggaaccacgacttttttgccattcgacaatgcaaagtcaatcactttttgggtgggaacttcgccatccatgcttaatgtaattccgattgtttcagcctttaaataatctggatcagtaaaaagctgttgatatagttgtttaagaagcgtatcagcatttttacattgtaaaaagtgatttatcttttgcaattgctgttttcgcagattcatttttgctttattttgcattctccaacctactttaattgacttaactatcgtgtgttacgagaaaaaagagactggacaaactgattacagtttgtttccggcctcttctgtttaggttgcatcgttgtaaaatgaatgcggataggccttcgactgttttaactactcaaaaataattaaatcgaaattccgcatcattcaatttacaacttgacgctgttattttgtttctcgatgtaatgtcactttgcgttcacgtgggcaatactttttaagctccaaacggtcaggattgtttcgacggtttttgcttgataagtaagtacgttcgtggcattcagtacattccaatgtaatgtgtactcgcatggaataggacctccaaactttttctttttatagctagtctaatagcatcaactctgaatattttatcatcaatctttataaattactaggattaaattgataaatgttaagtatttttacttaacagtcgacgttgactgaacctctttccaatatgccgcataaatcctctttgccaactgcatgttattgctttcggcgtttacgcctaaattaggcatagccaaagcaacaacaacctggggatgagtagatggcgcataagaagctaaactaagtgtaactgtttcattaccattgtagaaggtctgagctgtaccggtcttagcagagatttccggtttgattgtatccaattctccaccggtcttataggtgtttgttccatgaacaacgtcataaaggccacgcttaacaaccgcacgctgcgcacttgtcatatcaatatgattgagaacttttggcatcacagttgccttcacagcacccaaacttccatttttgttggtcccgcgaattgattgaacaacatgcggtgcaatccgatagccgccattagcaatggtcgacatgtactgagcaacctgcatcgttgtataggcatcatagttaccaaaggcctcatcaagggcacttccgatgtgttgtcgcccactggcaccctttagtccagttgactctccaggaatatcgataccggtatcaacccctaacccaaactcattaaagtaacctctaagtttgctaaaaattgatgggttcatagttaaagcaccaccttcaacatacttgaaacgagcctctttcatggccaattgcatcatatacgagtttgatgaaacttccaatgccccactggcatcaacagaaatatttgaccccccgttatgattaaaccatgaagattttttcacgcctccggttgtaattggttggtctgtcagaacactgttagtcggtgtaatgacgccatccattaaagcaccggagaccattgcacccttaacgactgaccccataacgatcgagctgttaatatttccaagaacattgtcagtgattttagaagtctttggattacgatctacaccagccatcccaataactgcaccgttgttaggatccattacaactgcatacgtaccggttgagttaccgccggcaccctgttcagctgagcgaaccaaagattgaagggtcttctggaacttggcattaatggttaattgaaggttatcacccttttgaccaccgtattttttaatttccttcttaatctcattatcactgttcaaaacaacctgagtttgtgatttggtaccacgcaaaacaggctcatattgacgttccaagtaactttggccaacactgtcatttctagagtatccttcagccagtaactcatttacccgatcacttggcaaaccggtcttttcatttgaaactgttcctgcaagaccttgaattgccttgccgttaggataattacggctccagctggttccaacattgacaccgggcatttcagacaaatgctcaccgacttgcgcaatttcagtttcggaaacattatcatccttaatgttaaccgttgacagttgatacgcaccactcatttttgcaaagatttcggccgcatttttggttgcttgactaaatcttgaatttggaatcttttccacgtactcaagtgccttattgtactttgcatcttcactatagctatcaagaccacctaatctcttctctacagcagttaaacgattagtattagccaaatagtaatcggccaattgacgctttgttagactgctcttagaaactttaacgtactgagaaagcttcgtagccgtctggtatagatcactggacatttcattaacgcccttagtgtaaataatggcctgatgtgctgaatttccaaccaataccttaccggtcgaatcataaatcatccctcgctgaacgtttccagaaacgacggacgtatctgatcgattaacctctgccttaaatttcgagccgtacatgacctgaagataagccagctgggttaataatgcaataaataaaataccaacaacaataaaaataatgttaattctaaaaggcaatgacgctgccttagttttcttgctcttcttatttcgttttttaaagattttcaaagtcattactccttgccatgaattcaattctatcaaatttctattacaaaaactagaactgttggccaatctttaacttcttatgatattctaaacgttgacatttatttttttgagaaaaggaagttcaaaaatgaaatcaaagcgttatcctttaatactgtgctttttgattccaatcattgtcacagttgggtactttatcttcagacattttgcaccgtttggtaattcctcaatattgacagttgatatggggcagcaatacattgatttttttgctcactaccgagatacgttactccataatcccagcggtattttgtattccttcgcaaagggactgggcggcgatatgttcggaacttggagttattatctgatgagcccggtcaatctgttgattttactattccctatttcaatgttgccaagtgttttagcacttatgacaattttgaaatatggattggctggcttaagtttcggttattttcttcaaaaaaaatatcaagcaaccgactggcctgtcattggcttttcagtttcatacgcattaatgggctggatggttgccaaccaattaaatatgctttggatagatgcggccattttgcttccaatcatttttcttggaattgataatatcctcaagcaccaatcaactaaactgtacataatcagttttacagccatgcttgttattaactactacatgggctggatggttgccatatttgtgagcgcatatatggtggttttcggtatcgcaagggctttacctacttcttattcatatggaaaaatattctatagatggatcaaagcctcactaattagtgggattttatcagcttggatcctaattccaacttttttctctttattgacgagcaaaaccaattattcaaaaaatgaatttcgagtgcgtttcgaatataatccgcttgatattctcggcaaatttataaatggttcatttgattttaaacaactgccaaacggtaccgccaatatttttgttgccagcatcatcatcattttgtttgcttattactacctttcaccaacaattaagggacggcttagaatcgccagctttgccctaactgtcttttttgtgctttcgatgtgtttccagccactcgatcttttctggcacggcatgcagttgccggtttggtacccatatagattttcatttattttttcattctggatgattttaaccgcttttgaagcttttaaagacattttgaccaatggtcttcattggaaaacttttattggcagtacactgattattttaattggcatgatttacattggtacaaaaataaaatcatttgaatacttaaaaccagaaaactatgtttggggatggatttatttaatcttgagcatcggattaatcgtcttttatggtttatatcgcaaaaatatactgctttcaatcgcaatggctattttaatgaccggtgaaatgagcctaaactttgtcaactcgcttaataatatttcgtacttaaataatagtgattacacaaaattcgcctctattaccagaccacttgtggataaaattaaacaatcagacaagggtttttatcgaacgggagaaaccttctccaggaccaaaaatgatgccctaacggccggctttaacggtggttctattttctcttcgacattggaatcggcaacttcaaatttctttggaaatatcggccaacctaatggagatgcctacgtattctattcaaatggcacaatgtttaccgattcgcttttatccatgaagtattggatgaatgaacgtccggttacaataaaaacaagccaaaaaacgatgcctcaatttttaagcacgctcacaagcaaaccggatttgagtaaatacgacctgacttctcaaacaaagttaacaaatacctacaagaatccatatgctcttcctctaggcttcgtatcacccgaaaacagtctaaaaacgactgttgttccaaataatccgatcacatatcaaaaccaattggctcagcaactcgatcctaaaatcggcgacctcttcaagtcagcaagctataccaacgtttcatatcataatatttatccggttttggacttggataatgccgtccttcgaaagaaaaatatgatggaacagtcttacgtaacaattaaggtgccaatcgaaaagaacacttcatattacatgacaatggggccaaacatctcaaacacgcagttatcagtgttggttaatggtaatagtctggttcagtttaggcccgctaaaaaaaccgtagtcgcaaatattgccactggtggtactgcaaatgacacgattaacgttaaattctatgcaaacgcaaatgatgtttggttacaagatgttaaactttacaaagtaaatgatcaaaagattgccaactttgcaaaagatctaaaaaaatcaccttataaaatcgacagatggagtaatcataaatttactggcactgttaacgttaaagcaaagcaacaagccctcacaacaactattccttattcgaagggatggcatgtaaaagtagataaccattcggtgaccccaaagaaatgggctaaaatgtttatctacgtaccagtctcaaagggaacccatcatgtaacgtttacctattggccacaagggctgggcattggtgtaaccatctctttgattggcgtatgtttaatcgtaggggaatattactataacaagaagaaaaaagttatttaagtaaagtaaaactaaaggagctaataccgtcaatcaaaatcggtattagctccttaactttattaaaattataattcaccattgggtgtataagaataagtgacattctcaggatccttcttcggatcaaagtcgactcctaaatcatagcccttaaagaaccattcatcgccagcatccacaaaatatttgatgccatctttatcagtttccgtataaacctcttcaggattatcatcacgggtaatcgctaatgagaagccatcgtgtacgggagtcttgccataaacctttccatagaatcgaacgccattaccatcagataatcccatttcatcatggaaccatttacttgcagcatcggtaatctcaagtttcattaatcgcacactccttatagattttctctgaattcgcttacaacacattatatcatcgtttgtgaaattaacaaagaaagagcaaaaggcacccggttaagtatttcactaaaccgggcgcctttaaaaaatagtctatttaacttccaaaatttttactttcatatcaccagcagggatatgaatgactacctcttcatttaagcggtgtcctaaaagtcccttggcaattggtgaatcatttgaaattttgccagacattggatcagcttcagcagccccaacaatcgtatatgtttccggttcctcatcagggagttctttaaatgtcacagctttcccaacagtaacctcgtccttgtcactgtcatgagagtcaataatctgtgcatattgaatcatatgctcaattgtcgtaattcgactctctaacatactctgctcatcttttgctgattcatactcggagttttccgataaatcaccataacttcgagcaattttaattctttcaaccacttttggtcgttgatttaccttcaaatcctccaattctttttgtaacttgtcccgaccttctgcggtcattggatatgattcttgttcagccatctaaaaattctcctttataaaagattaaattgttgaatcaaaattctgtttgatttgttcactgccacgactctttaaaatcgagcgcattttggttgttaacagatcaattgcaacttggttctcgccaccctcaggcacaatgatatctgcgtaacgcttagtcggttcaacaaactgatgatacattggtttaaccgttgtcaaatactgatgaataatgctgtctaatgaacggccgcgttccttagtatcccgctcaatacggcgaatcagtcgaatatcatcgtctgtatcgacaaatactttaatgtccattaaatcacgtaatcgctcatcgtcaagtattaaaatgccatcaagaataataacttctcgagggtcctgatgaatggtttttttacttcgagtaaattgattataatcgtataccggtttttcaatcgcttgatactttagaagtgacttcagctgtttaaccaataaatcatagtcaaaagccatcggatgatcgtaattaacccgttttcgctgcgccattgtcatctcatcttgatctttgtaatacgaatcctgctgcaagatcatgattgaatagtttgataactcatcaaatatttttcggctaacggttgtcttaccacttcccgagccaccagtgacaccaatcacaaccggtttttttgctggttctgtcattaatcgaatttcctttcggttatcaactcttaattatttgaagcatgtttagcaatttgctgttgatgttcttcgtacgttttcgaataatatactttcctggtcttggtatttgcaacaaagtataaataattttttgaacgatcaagtggatgaagtaatgcttgaacagagctgatacttggactatcaaaaggtccagggccaaagcctgtatatttatatagattataaggagagttactctgaagatccttagttgtcagttgtttattattacgatgaatggcatacaacacggcgacatcagactgaagcggcatgttaatgtcgattctgttcaataacacgcctgacatcttacgacgatctgtctgattaaccccttcccgctcaattagagaagccagtgtcataaattgctgaacggtcaatttagtctttttaatttgttgatagtgaggcgctaatacttgattagttttggcaaccatctgattaacgagagacttaagtgacgtattcttcttaacttcataagttgctggatacaaatatccttcaagacggtatctgacttgctttgctttcatagcagaacccaataacttaggataagctttttcaagctgttccataaatgcttgatctttcatcacactaataaagttttgcttcgaaaaatctgtcgttaaagaaacctgagtagcaatttgatcaatatttgctccctcgcgaaccaaaacctttcctttagtactttggattggctgatcactgccacctttttgaagctgtttagcaattgttttcaaactcatcgatggtttcaactggtaatagccagcacgaaactcactcatgttattggatttaacatagtaatcaaaaaccatcccactctttacaactttcttgttctgcaagattgagccaatctgtttattggatgccccaagtgggatatgaacctgggtaacgtttgtattctgcggattcattggtttcagggcctcttgaaaataccgataaccaagaaaactaatggacaccgccagaataattaaaatcgcaattacggaaataatgatttttcgccctaaactacggttgggtttgggggtccgttcatttgagttgttactcattagatgctcctcctatattctcagctttcattataagtttgaaactacctaatttccgcatttagttcatcagttaaccgttttttaatcttttcaaaagcagttgtcacaacttcatcctttaatgtctcacgaggattgacataatgtaacgaataagccattgattttttaccgtcaggaacatttgcaccatcataaatatcaaataaacgaatatcatgaaggaatgcaccaccacgttttttcattaaattaacaatttgatcattagtcacgtcactgtcaactaagaatgaaatatctcgttcaactgatggatacttcgaaattacctgatattgatcatcactctttggcagatcgattaatgtttgcagattaagttcaaaagcatatgtttccttaatcttgaattgtttggtgatctttggatgaacttgtccaataaatcctacataatgaccgtggatactaatatctgcagttcttccgggatgcatttccggatacttatttgttgccgtatactcaatatcaccattaatgccaaggttctcgataaactgatcaacaattccttttaaatcgtaaaaatcaaccgatttaacatgattattccatgaaggatctgttaaattaccagtcacaacaccggcaacatgttccacttcatctggacgaacttgatcatcggtatctttgtagaatacccgaccagtttcatataaggcaacatcattaaccttatgagcatgattataagaaacatcatccaacaaaccactaagtagattcattcttaatgtcgaatgatcctgtgtcatcggagaaagtaattttgtcagtttactctcccgcatcatgaatagttgcgccttttcttccgttgtcaatgaatatgaaatagcttgtgttaatccaagaccttccagtatatgtcgagcagctctttggactttttgcgccgacgttaacacacctatcgtttgacgaccagtcggcaacgttgccggcaaattatcatagccataaattcgagcaacctcttcaaataagtcggcctcaatatgaatatcccaacgacgtgctggaattgtgacatttaacccatcgctttgtttttcactgataaatcctaaacgatcaaagattgctttaatgtcttcaattttaagattagtaccaagaacatgatttgttcttgcagctgttataaaaatcgttggtaattcgggatgatattctgaagcagtcacgattcctttagcaactttgccgccagcaagcttctgaatgagattaacagcttcattaatggcatcttcaacgccatctggattaataccacgttcaaagcgctgtgatgcttcggaatgaaggacgtgtcgttgagctgtcttccggattctaatagaatcgaaaatagcagattctaagacaacgtttgtcgtctgctcatcaatttgagtattgtaaccacccatcacccctgcaagcgcaatcggatgatcattatcggcgatgacaatatcttcgggagacaaatcatggtcctcttcgtcaagcgttgtgatcttttcgcctttttgcgccaggcgaacttggatatcgccatcaattttatcctcatcaaaggaatgtagtggctgcccatatttcatcaaaatataattagtcacatcgacaacgttatttataggtcgaacaccggcattccaaagggtaatctgtaaccatgacggactaggtgcaatttttacgcccttaatgacacgtaacttatatgtttttgcgagagaattatctgaagaagctttaatttcgtcattagcatttaatgctgaatcttcatgaacaaccggttttttaatatcaggatgctgatcgtaaatagcagctaattcatgaacagttcctaaaatacttaacatatctccgcggttgggtgtgacatccaaatcaatgattggatcatccattcctaaataatgataaacgggttcaccgactggaacgctatcatcaaagacataaataccatctgcccattcctttgggacgacatccttgctgaatccaatttcgtccagagcgcagatcatcccttcggattcaacaccacgcatcttcgatcgcttaattttaacgttgccaccaatacgcgaaccgggcagagctacaataactttttgtcctgcatcaacatttggcgcaccacaaacgatttggagcggctcctcttcaccaacatcaacagagcaaacgtgtaaatgatcggagtccggatgggaagtcattgataaaacgtggccaataactaactttttcaagccttcctctgcgatgtcgacagaatcaacttcaactgcagtccgttcaattttttcagctaaatctttagctggaatatctaaattcaagtatttttttaaccagttatatgatactttcattctttagttacccctcttatcaaattgatctaagaatcgaacatcatcaagatagaaatcccgaatatcatcgacgccgtatttcaacattgcaaaacggtcagggccaacaccaaatgcaaagccaccatacactttcgaatctacaccggccatttccaaaacgtttggatgaaccattccggcacccaaaacttcgatccaaccggtatgcttgcagacatcgcatcccttacccatacagttaaaacaggtaacatcaacttcaacagatggctccgtgaatggaaagtaactcggccgaaggcgaatatcaaacttatcaccgaaaatcttttgcgccattgtaataagtgttcctttaagatcagccatcgtcacatgacggtcgatgaccaatccttcaacttgatggaattgatgcgaatgggtaggatcgtcagtatcgcgacgataaacgattcctggtgaaatcattttcaaaggaccctttgaaaagtcatgcttttcaagtgccctagcctgcattggagatgtttgagatcgcattaaaaactctttacttaaataaaatgtatcctgcatatcacgagcgggatggtttttaggtaagttcatcatttcaaaattatatttatcagactcaacctcaggaccttgcagtacttgatagcccattcctaaaaacaaatcaacaaactcatcaatgatttgctgaatcacatggggctgaccttgtgcaacaggctttcccggtaaggtcacgtcaattgtttcagctgaaagctgcttatttagtgtagcatcttcaagcttctgacgatgttctgcaaccgcttgagtaatcgcatcacgaattttatttgcataactaccaacttcaggacgttcttccacaggcaagtctttaatgccgcgcaaggcagcagtgattggtcctttcttaccaagcagatgaacccgaatctcgtttagcttcttaagatcaacggttgaatcaatatccgttaaaccattttgtttaatttctgttaatttatcgcgtaacgacatggtttccctccaaatattttttattgcgtcaaaaacaaagtcaataactatttcgtcagcaaaataaaagcacaaaaaaagccccgtccatccagggacgaagcttcgcggtaccaccctaatttgtcactaaaaaatgacacacttaagaatcattaacggtgactaccggaaaatttttgttaatattaactcccattttctgctcgaaaaatgaattcgtacaaccaatttctctgttcacaccaaccacagagtctctaaaaaaattaattgcctactgcttttttctcaaacgcatttacttaatgaatgataatctaaaataaaaaaatggtcaagctaactttcagtgcttggataccatttttctgaccatgagtgaattgcatgcataattggtgccaactctttgccttgatccgttaatgaatactcaataagagatgagtttggataatctttacgaatgacaaccccgtcatcctcaagttcacgcaatcgttctaccaatacccggtcgctgcactttggaatttgtctggcaacttcacgaaatctcaaggcaccttcttgcaataaaacatcaatgattagaccgttccatttcttccccagaaacgaaaatgttttttcaaacttcggacagagaaaatagttgatgggttcacgtaatgcaatgttttctttcataagtttcccctccttaaacttacttggattaatacgaaaatcaaaaaaattatttagtcgttgcaattctgtcaatttggttcttaactttggttctaaatggattcacaaactctctaaccgcttcgtagtcatcaactagcgaaacaatcacactctcttcatacttcggacgggcaagggtaagtccccacatgtgctttaaaataatatccttttcaactggtgaaagcgttgtaatcttttctgcgtttctaagtgctacccgtgggtgaacaaatgcatgtgaccccaagtcaaacttagttgtccgccaatcataaaagaacaggtcgtgaagaagaccggctcgagcgaccgcccgataatccaaatctcgcttttttgcaattcgataactatcaaatgaaacagctaaggaatgttcaagtctggtagaatgatggtgttgtttatagttggctaatttttgaacagttgggttcttaatcagatcgccaacaatttgaacgtattcagaatcatttttccattcatctttgcgcatattatacccctttgccctttattacaagacatcatactagatatcaccaaaaatatcaacaaaaacgaacattactttacaaaatgaaatattaagattcctgtcgcaaccgcgacattcaatgattcggcttctccattcattggaatatacaaattttgatccgttttgtcaagtagatctgctgaaacgccgtttccttcatttcccatcaccaaagcaaactgtttggtaggctcaacatcatcatatgaaatagcctgatcattcaattccgttccatacactggtacattatgcttgttaaacgctgccatccacactgccaaatcacccgagtatagtcgaacatggaactgacttccctgcatagatctaacgacttttggattatatatatcagcagttccttttccaaaaataacaccattcattccagcagcgtctgctgtcctcaccatcgttccgatattaccgggatcctgaatattatcgagcattaaccacgacccgcccaatttttctggaattgattcatggtagttttccgttgtcaaaaccgcaaaaacgccctggggcgtctcagtggcagaaatatgtttggcaacttcgggtgtaattaaatacgtatcagtcactgcaggatcaacttccaactgatccaaaaaattggcatccgttacaataaccgcatcaatttgctgatcatgtttgattgcttcatccacaatatgccatccctcaatgatatattggcccgaactcaatcgtcctttcttagattgcatcttacgccattctttaactcgattattttgattagaagtaattgattgcattaagctcttccttttataattaatttattagtataaagtgaggtgacttttaaaatatggataaaaaaatcaaaacaactgaactgactatttttggaatcgtccaaggagtgggatttcgttgggcaaccattcaagttgcaaaagaaatgggcatttccggatgggtccaaaacaagccagacggttccgtgaaaatcattgcccaaggaaaaccaattcccctggcacagtttattatgaaaataaaaaattcaccaacaccatacgctcatatcagatctgtctctactaagtatataacgaatccaacgttaaaaggcttcaatgtcaaatattaataaagattaataagtttcgtcaagattaaattgaaaactttcccagtatcgagtaagatttactttgtctatgtataaataaagaaaggtcttaatcgatgaaaaaacttaagcgcataacgacattcggaatgctttccgggatggcgttactactcagtggttgtgttcagaccaccaaatcaggtaaaccatatggcctggtatacgattatcttgctcgaccggctcaatcaattatggaggcaattgcacaaattgtcggaagttatggatgggcaattgttgtattgaccgtcattgttagaatgtttcttttgccaattatggttcgtcaaatgaagagttcgacaattcaacaggaacgcatgcaaatgattcgtccacaaatgcgtaaattgcaacaacggcaaaaagcagcaaaaacgaccgaggaacaaacggctgccagccaagcaatgatggcactatatcgacagaataatatttcaatgacgggtggcattggatgtctgccgctcatcatacaaatgccgatctttactgccttgtatgccgcaattcgatattcgcccgaactatcccatacggtctttatggggattcggcttggtcaatccagttggcttctggctgttctttcatttttgtcttacttactacagggatatttaatgatgttaggaacgcctaaagcacagaaaaagcaaatgggtgccatgatgctcatgagtcctattatgattttgctgttcactatttctgccccggccggcttggggatttacttctttatcggcggattgtttgcttgcctccaaacaattattatgaatttatatcgtcctggcattcgaaaaaagattgccaaagagatggaaggcaagaaacccgtcactgtcgaagacttaatgccgaaagcacctataaatcaatcaaacggcactgataccaaggaaaatattcataatcgaaatcggcaacgaaatgctggaaagcaacaaactggtgaaacacagcagataagcaaaccggttgaagatgttaatcctgaaaaaacacaagccaagaatcaacctcacaagaatgacagacggcgaaatgccggtaagcaacaaaggcatcgttagaacataaattttacaaaaaaagaagcgtcgggaatctttttcccggcacttctttttaatgatcatttttttgattagattgattcggttccttggaatctgaactattaaggttaagtggcgtatctccttcaccgctgccattatcatcatcctcttgaggcatattcttcaaaattggtaaattaatttgaaaaattgacccatatcctaaggaactttcgattgaaatattaccatgataagcttcaatcaatcggtgagcaattgatagtcccaatccattgccacctttgtctcggctcctagccttatcaactctataaaaccgattaaaaaccttattaatatcttcttgggagattccttcgccaaaatcttgaatagcaatgtttaccattgacattgaagtagaaagcgacatatgaacctctttacgttttgcggaatacttaatcgcattatccaataaaatgactaatacctgttccaaatgattacgataaatttgaacatatacatggtcatcggtatcatcatcaaaagtaaacgtaaaatctggatgaatcattttgaaatcattataaacctgctcaaagacttcagtaatattagtaatctcttcgccataatttaattcaatctgttctgcccgtgataaatccaacatttcggacactaaactcttcatccgcttcgtttcttgaagtgatgcttttaacgattcttccaacacttcaggatcatctttcccccaacgcagcaacatgtctatatgcccctgaatgactgcaacaggtgttcttaattcatgcgatacatcctcaacgaactgctgctgctgatcaatgtaacgacgggtttgatccagcatgctgttaagcaagtccgctaaatcggaaagctcatcgtgagtcttaagatccggcacccgcgcgtcagaatccggatcagttttaaccttattaatcgtttcttgaatctgattaatgggacgcaataattcagccaccaatacataagcaagaatcattgatatcaaaaccgaaattaaaacaagaattgctaaaatagcagccaattttcgagctgttgcccgatagctacttaattcatcgataacttgtgcatagccaataagcgatccattcttcttggaaagcaatggttcaacaccgattaaaatatttttgccattctgcctagaagttatgatctttcgttttgaagaagacgcaagtttggaatcatttttctttgactcaaaaagccgcttgccattgatactgtacacattaacaagaatgctgtcgcgtgaaaaattaacaactaacgagtccgaataaatgtttctgtcgtcgctttgagagtcaccactattaagttgtggtcttaaataacgttcaacgtcacccttccccaaaggcgaagaataattcgttagtctcgaagaaactgttgataacgtattatcgatatgcattctttcttgttcaagtaaaacatttgtaaaacggttaaaaatcaacaccgaaaaagcaaccacaattgccaaaacaccgatcgaggtaaaaaaagcccatttccattttaacgaaatcttgcgtttcccagatttgttattggcttgactcatgacctcatcacatacccggtccctctaacagtttggatatagctattttcacctggacgatcgatcttattacgaagatatctgatatacacatcaacaacgtttgtttcgacttcagaatcatatccccaaacctttgttaacagaacatcccgtgccaacacaacgtcaacattttccatcaacgttaataacaactcatattcacgtttggtcaagttaatcacttcgtcgcctctgcgaacaatgcgactttctttttcgattgtaaggtctttaaaagtaacggatttcttgctactcttttgctgatcgttttcaatctgaatgcgtcgcaatagtgcccgaattcttgcaagcaactcttcgattgcaaacggcttcacaatataatcatcggcgccgtgatcaaatccggaaacacgatcgataacagagtccctggcggtcatcataatgattggtgtgttcttcttttcacgaaggcgtcgtgcaacctccatcccgttaagctctggaagcattaagtcaagcaatatcacatcaaaattttcatccaatgcagcttgtagacctgttcgtccattcaactcaacttgggtgtcatatccttcgtgttttaattcaagttcgacgaaacgcgccaaattcttttcatcctcaattatcaaaattcgactcataaataatcagctctcctaaagtatcttaatttatttattattgtaccttaaaacattttaacataattctcattttaacatagttatgagaaaattagtgcagtagtttaagaattcgaaagaatcttaaattttggaaatatttttcactttattcatttatgtgcattttttcacttgaatcattttcctttcttgcttataataaacttgtttgaaaataaattacaaaaaaggatgatctattaaatgaaagctgcagttgttagagacccagttgatggttacgttgatattaaagatgttcaattacgaccaattcaccagggggaagcacttgtaaaagttgagtattgtggattatgtcacacagatctccacgttgctgccggcgattttggtaaggttccggggagaattattgggcacgaaggcgttggaaaagttattcaagttgctgatgacgtcgacaatttaaaaataggcgatcgtgtttctatcgcttggttttacagaggttgcggtcactgtgaatattgtactaccggccgtgaaacactttgccgaaatgttcaaaattccggtttttctgttgatggcgcaatggccgaacaagttattgtaccggcagattatgccgttaaagtgccagaaggtttagatcctgttgaagcaacttccttgacctgtgcaggtgttacaatgtacaaagcattgaaggttggcgaaactcgtcccggacaatgggtagaggttgttggtgctggtggtcttgggaatttagccgttcaatttgctcacaatgttttcggtgcaaacgtcatcgctgttgatggcaacgaagacaagctcaatgctgctaaggaaaacggtgctgatattaccattaaccgtcatgaccctgatgttgctgaacaaatccagaaaaaggttggcggtgtgcataatgctcaaatcactgctgttacaactgaagcattcactacttcagtaaatgcccttcgtccagatggtcgtttagttgctgttgcccttccaaagggcgatatggcacttaatattgacaagaccgtcctagatggcattcaagtcgccggttcgttggttggaactcgacaagatttggcagaaaccttccaatttggttcagaaggaaaagttaagccaattgttaaaacccgtcgtttagacgaagttaatgatatcattgatgaaatgaaacaaaacaaaatcgttggtcgcatggttgttgactttaccaaataaagaattccatcattcataacaactacgctataaaaaggaatgtgaggggatttgtctcccttatcgcattccttttacattcggtcaattcatttctaagtaaaacttgtacacttttacacaataaaaaagcgaaaatttttttctaaaataattcttactacaaagcatcggttactcaaaccgtgaataaatgattccgatttttaaaatttagacagaaaaaaagcaatttagaatccatggcgttctaaattgctttttgttttacttattctttaaaaccttacggcctttgtacatgccagataatgaaacgtgatgtggtaatgtatattcgccggttcttgggtcaagactcaaattaggagtctgtaacttaatgtgaccacgacgcatccgttttctagcttttgaagttctacgtgctggtgttgccatgtctttccctcctcgtaactaaaatatccactagtgaatttttaagcccagctaattagagtccttatctttaaaaaagttctttaattttgccagacgtggatcaactgtttttaattctgccttctgatcttcgtaatcatcaactgaaagtacgttccaatcgtgtccgcttggcattgttttaccagcttcctcttcaggagacaaaatgtgcataggaatatgcaaaatcacgttatcaacgaccgcagaacgactatcaacttcgtcctcttcaccaagtataaaaacgacatcgtccttaccatatcttgattcagcagcttttgacggaacataatactcttcaaccgtaaaatccaacggtagatcaacaggtgttagtgaccttgaagaaggaaccaccaatttaccaacaatatgagtatcaatgatcacatcaccacgatcagagaatgcagccccatctattttaaaagtgcttgcatcgatcacttcatcagcgtaccgactcagcaagtcacttttaatatcaagggtttcattgaacgtgaacggatctgtatcggagtacttttgcaaatccttaaaaaaccatttcactgtaattcctccaatgcaacaaaattcattataccggcaacaaaaacgcttgtcaaggtgatttgcttgatagtgttaactccttaatgaagaatgattgggtgtttataaaaatcctgatgtgcgccattaaccatctcgattaacatcccagccttaaaatccaaatgaacaaacttttttacaacttcctgattcaccttggagatcattggcaactctaaatcatttttaatttgattcaaataccgtctcccttgacgcgtacaccctaacaaacgaatatactgaggattaatcaacatttcagatgaagttacatgtaatagcacgtaacagcacaaacgctgaatcctagtgtaagtataacgctttgttttcacaaattgtaaaaattgcgagaatgtttcagattcaattgccgcttgtttcaggcgatattcaattccctcagtcatttgatatatcgaatgcagtgtatcaataggtgcttcaataagttcaaatcttagcaacggccaaaattggtcccaatcaatcactttagctgttgaaaaagttcgccatgaagattcaggtacaaattttcgaacaatatcgaaatgcccatttttcagttgatccctaattgcagaagcactggatattaaccccgaacttagttgatgatcattatgtgcacttccaactcttttaatgggaaccagatgcaatggagagcctatcaacatattggcattagcatatccaaaagccaatatatcattgggcttatcaattcgaataccggttctgctatataaatattcttgaaagatcgaggcatatggacgattaaactgcttaaaggagtcgtctttcttaggttggttatcaattaatttttgataatcgatctccggtgtttcagctccaaaagccagccaatcacatttcatagcggctacaagtctaacggcccctgccgaaaaaatatgtgatggttgaacagccgcataaaacggcaattctatcaccacatccactcctgttttaagtgcagctagtgctcgagtccatttatcatacatagccggttcacctcgttgcagccagttaccactcattaccgcaacggtgacatctgcaccggttttttcctttgcttgtgtcatctggtaaaggtgcccattatgaaacggattgtattcagaaataatgccgactgctttaagcaaattaatttaccttcttacactcaaatagccatcgcttaacgtcatttttaaaagaatcttccccaaaatttgtcgttatttggatttcagagaaacctgcaccagttaacatttgagaataacggtctaccggataagtacgctctttatgaagctcattataagcatcgtaggcattcttatctccgtcataaaggaagaatgtcagctcatgctccacagcgtgagaaacgctctcagaggcataacttgaccacataaatgcccgatcttcatcctgataattgtacatatatccaggataaacctcatcggtttgatatggcgtaatcacatcaaataagaaactaccgccaggttttaagtgagtgctaacttgggaaaaagtttgtcgtaaatcagactctgatgacaagtaacacaaagaatcatcaaaacacgtaatgctatcataagatggcaattcgcttaaatttcgcatatccaactgaaagaagttaatttgttgatcagcttcccgcgctcgctgatcggccattgtgagcatatcttcagataaatcagcaccatccacattgtatccagctctggaaagtcttactgcaagccgtccggtaccacatgcaaggtccaatattttatccgaccgattcgtacgcctaagcgtatactcaagccatttatcgtataacgtttcatcaaacaagtcatcataaaacttggcaaattcgtggtaaatcatacctcaacccatgaatcaatgttaacaattggtgcatctgtccataatttttccaaattatagaaatcacgggtatccttttggaacacatgaacaatgacatcgcctagatcaattaaaatccagttagacgtttctttgccagaaacactgtaaacatggatatcatttgcctcaacctgatcgacaacttcctcagcaatagcttttacctgccggtttgaattagcatcggcaatgacaaaataatcggccatcaaactgactttttccatatccaggacaacaatgtcgtgagctcgcttactgtcagctgcacgtacaacaatctgtgaaatctctttactatccataaaattctccttatttcaaatcaaactttggtacccagctgttataagtgatgatggtttgcggaaaaacgggtttattatgtgccaccaaataacttagcgtctgcttagtttggtaggcaacgcctttctgcaaattagaaaaggtaattttcctcgcatcatcaactccaggaaagtcacgaccaggttcaatatagtcagccatataaacgatttgttccaaaggggtcatatattgatggcctactgtatggtatctaacagcattcaaaacctcaatatcattaatttgaagttcatttttaacaaatagccagccaaccacaccatgccaaattgagttaccgtaattcaacaaaattggatttagttgatactcatgaattgctttaataaaatctttatcaggccgttgtttggcataatcatgaaccaaaccggcaatgcttgcccgttcaatatcaatgttatttttctcagccaaatccattgcagtttgttctaccctcagaacatgctgataacgactatccgttaaggcatctttcaattttttaactaatttttttcgagaatatggcacaatttgttcatgatacgtcatttgactatttttcatacaactgattctcctttatatatttcaaaacagcatccggtgctagataacgaatagactgatgctggcgaattttagacctgatcagtgtcgaagaaatatcaatgtacggtacgtctacccaaattataggatattttgatgctggtgtataaccatcacgtttgactcctacaaaggaaaccaacttgactaaatcatcaattcgatgccactttggtaaataatttaccatatcaccaccgataataaaatagtactgattctccgggtgtcgacgtgttaaatccagcattgtctcgtacgaataactaaccccacccctgaaaatttcagtcatttcaatcgcaaatttagggttcccagtaattgctaagttaaccatcgcaactctatccttggcgtcaatcgcaaatttaggatctacgtgaggtggatttgcatccggcataaaataaacccgatctaatccaagttggtcacgcacctgttcggcaataattaaatgaccattatgaataggattaaaagtaccacccaagattccaacccgcttacgctttccctgagtgacaacctttgttttgggtaaagtttgtactgtttgactgacattaaccattttgaaatacctcgatactaattagattgaaaaaacgttgcttgatagatcacgattatccttatttgcggattgtttaaacagtactagtgttttccccaacttctggactactataatatcgctgtttccttcaataaagccttgaacatcatcagtggtaacagctgcattttgcaaaatattgattttgataagctctcgagtatcaagtgcttttacaacctcttcaagccatatctttgaaaggccatttttaccaatttcaaaaataggtctcatccgattagctgatgctcgtaaataacgtttttgcttccctgttaattccataaatacccctttagtcttctaaatcattgctggtcgaatcaaaactgaaacaccctttggtgcccatcctgaaacaacaacatcacttggaaccgttacccaacccaagccttcaatcactacatcacttttttgcgaggttttaaattcgtgacgttccaatggtggaaagtcatcttttcgattttcacttggaggtgataataggtctcccaaatgcttttcataaaaggcttcggcgttttccaactttgttctgtgaatatataagttgttttcagcatataccgtaaaaccatgttttccatcacctgaatcgtaatcaaaacgggcaacgccgccaaaaaataacgtctgctcagggtttaattgataaatcttgggcttaattgttttctgaggcgttaccaaattcagctctttaccgaccaaatgatgtgccatctgttcaggttgaataatcccaggagtatcaacaattgagtgcccatcgtttaatggaatatcaattcgatccaatgttgttcccggaaaacgagacgtcgtgattaattccttaataccggtagactgacgaataaccgcgttgattaaagtagatttgcctacgttagtaaccccaacaacgtaaacatccttgccatctcgatacttttcaatttgatcaagcagatgatcaacatcaaaattagtcttagctgaaattaattcaacgtcaattggtcggataccggccgcgttagcgcgttgacgcagccaatcgcgcaccttgcgttccttaatagaagccggcaaaacatccaatttgttacccacaagtaaaactggattatccccaacaaatcgatgcagtcctggaatcaaactcccgttaacatcaaaaatatcaacaacataaacgatcaaggaatctgtgccggaaatactggttaacaacttcagaaagtcatcatcagacaagctgaccggtgcgatttcgttgtaatggcgtaatctaaaacatctttggcaatatacctcaccattttgcagtcctttttccaaagctgattttggtgtataccccaatgcatctttattcgtcgtttggacctttgcaccacaaccaatacagtgaacaacctcaccatcaactaaaacttcattttctgacatgctctcctcctattcccaatgtaaattaggatactttttaatcagtttattccaaatgatcttttctagacaacgattaagtgtcgtgttccaagcgtcattgtcaaccaacggtttaacaagaatacttcgaacatgacaactgtttgcagcgacaacatctgttaaaagttgatcaccaatcataaccgtattttttttattcaaattaaacgactttaatgcatgacgaatgccaattgttaaaggcttcatcgcacgtggaacgaatggcagctcataatcttgaacagctttttgaattcttttatgactattgtttgaaacgacgatgactttaatcccatactttttgacttcatgaagccaggatcttaactcttccgacccttttttagaattccagggaactaaagtattgtccagatcggttagaacacagttgatattattttccaacaagaactgaggggatacattataaatactctcaatcatccaagttggtctaaattttgacaacatatgctcctccttagttttaatagtttttatttaaaaaaacttccaccaaaattatcggtgaaagttaattttagcatatcgaaattacttaagagccttttttgcttcatcagttagcgctttaaaagcatcagcatcattgacagctaattcagcaagcatcttgcggttcatgtcaatgttggcaagcttaagtccatgcatcaatttgctgtagctaagatcgtttaaacgagcagcagcgttaattcgggcaatccagattttacggaagttgcccttattggcacgacggtcacggaaagcataaacctgtgacttcataacttggtctttagcagtcttgaataaacgtgacttaccaccgcgataaccttttgctaatttcaaaacacgtttacgacgtgcgtgtgtaactgttccaccttttactcgtggcattttgaattcctcctatgataaatatcaatataattaatctagtcgcatgatgttacaagaaaattactttgcaagcagtttcttgtaagtcttaagattagtgtgatccatcatatgtgtaccacgaagttggcgacgttgcttctttgtcttaccgtgaaaacggtgacttgtatatgcatgggcactcttgattccaccgtttgcagttttcttaaaacgctttgctgcggcacggtttgttttttgtttaggcattggtaaaaatcctcctcaaaatttaaataattatttattatcgggttcctttggcgaaagcattaagaacatacttcttccgtccattttcggccgctgggtaacagttgcaacatcatctgtttccttagccattctttcgagaacgtttcgaccaatttccttatgtgtaatggcacgtcctttaaaacgaattgaaactcgaaccttttcgccctttgccaaaaacttcttagcattctttagtttggtgttaaaatcattaacatcgattgttgggcttaatcgtacttctttgacactgatgactttttgtttcttacgagattcccgttccttcttttgaagctcaaaacgatatttcccataatcaagaatcttagcaactggtggttttgctttcggagcaacaagaactaagtccaattcagcgtcttcagctaatttaagtgcctcggactttgacttaacacctaattgatcaccattaggaccgatcaaacgaacctcgcgtgcgcggattccttcattaaccatcatatctttagctatggtgcttcacctccaaataatttgaaaaagcagaaaagtggcgggtacgcaatgcacccgccaccattaaagaacctagttgaataggttcttactcgatatcatgcccagcaaaataattttactaaggcgagaagcgggttgcctctgctttcatgtcaactttaatagaatatcattgattaagaatcgtgtcaacaatcattaactatttgtgattaatcattgcgcgaatacgatgcaatgtccttttgaatttcatcaacaaacgcatctaacgattctgcttgtgtctctttttcaccataacgacgaacagaaacgctcttgccattgacttcttcatcaccaacaaccagtgtatatggaatcttgtgtgtttgagcatcccgaatcagatatcccatcttttcagctcgggtatcaacggacgaacggatcttcaatcgacgcaactgatcattaatctgtttagcataatccccatgtttatcctgtgaaaccggaataatcttaacttgatgcggtgccaaccatgtcggaaaagcacctttataaatttcagtcaggtaagcaacaaatcgttccattgttgaaaccaagccacgatgaatcatgaccggacgatgttgtttaccatcttctccaacataatgaagatcgaatcgttccggcaacataaagtctagttgaattgtcgacaatgtttcttcattgccaagcgcagttttagtttggacatccaacttgggaccatagaatgcagcttcaccttccgcttcgacataatccaagccaagctcatccatagcaccctttaacatgctttgggcacgattccacatttcatcgtcatcgaagtacttttcagtattttcaggatcacgataactcaagcggaacgtgtaatcatttatatcaaaatcatgataaacttcaaccattaatttcaaaatgttttggaactcttcttgaatctggtcaagagcaacaaatgtgtgaccatcattaagtgtcatttcacgaacccgttgtaggccacttaaagcaccagacttttcatatcgatgcatcatccctaattcagcaatcctcaacggcagctcacgatatgaccgaatatggtgattgtaaatttgaatatgactggggcagttcataggacgaagctcaagttcctcaccgtcgcccatgtccattggtggaaacatatcttcacgataatgctcccagtgacctgattgtttatacaggtcaagatttgccaagacaggtgtgtaaacatgttcatagccattagcaacttccttatcgacaatataacgttcgattgttcgtcggatagtcgcaccatttggcatccaatatggcagccctgcgccgactttaggatcaacaaagaataagtcgagttggttaccgattactcgatgatcacgttcatgagcctcctgacgcttctttaaatcttcatcaagttcagattgtttgttgaaggcagttgcgtaaatccgctgaagcattggatttgacgacttgccttgccaataagcaccggcaacagataataatttaaagatctttactttaccagtcgatggtaaaacagcaccttcagcaacagacttgaaatcaccaatttcgaagaacttaacctgattaccatcagcaatttcgttaataagttcagtctgatatgggtccccaacaacttgtttcagtgcatcgtctttacttaagaacgtgaccttaataggtaaatctttgctgataatttgttgcatcgattttgttaaactgtctaattgatcaacactgatttgagtctcaggtttatcggtatcaacaaagaagccatcatcatcggctgcactttcaccaaagcgaatatccttgaaatttgaagcaattgcagctttaagtacctgagctgcagtttctcgaagaacattcaggccatcttgactgtcgcctgtgacgatttcgactttaccacccttatgtaaaggctcgttatcatttacaaactgaccgtcaacttttccggcaacagcctttttccctaaactaattgaaatcgattttgcaatgtcttcagcggtaacgccgtcgtcaaattcttttacactaccgtctggaaattcaaatgaaagttttgacatatcctctaactccttttttctttctagaaccacaaaaaatccctagtacacaattgtatactagggacgttattagcgcggttccacccttttggattttggaaaagtatccacttcaccaaaaagctctcaagtggttgctaacgggaccatccgggatagcattatccgcaatccgattatcaaaaagtggtaacaaccattttctaaacaaacagcctttcagtctagagccgttctccctttgatgagaaatgattatcatatcttcctgattcattgcttttaagtataggattccttcttaaagttgtcaatctaaattaaacaatttacattggccgacgattttgacccggcatttctacctcgcgagataggaacctaattcgttgcatgagccgttgtgcctttaacggttcagcgtcaccgtgattgttaaatgtcagccactcttcctccaattgctccatagacaaatttgaactgaaaaacatcggtagttgctgttgcattcgatattcaaggataacgcccagaacctcatcacgtacccacgatgacaacgaaccggcaccaacatcatccaacattaaaatctgtgattttttgacagcatcaattttgtctagatagctgttatctgaaattgacgccttcatttcactttcaaagctgggaaaatgaaccaacgttgtcaatacgccactatccgccaaatcattggcaagtgcacctaataaataagttttaccaacaccgaagggcccgtaaatatagtaaccaggttcaaactggtctttagccatatactttgaagtgaagtgaacggcctttgcaaatgcccgatatcgactgtcggtttgatcaaaattatcaagcgatgcattgcgaatatctttgggcattgaaatagtcgtaacacgccgtgccagtcgttcggccttttgtttatcaagcgtctcagccgatggtgcgtaagaaacttcgatcaaatgatcactgacaacaagctttggtacatatcccggtacaaatgatttttgttttttcttcaatgtatcacgaaccattaaatattcacgaagttttgcaatagatcgttgagctgcatcctctgccaacttcgccttattttcttttaaaaactgttgaatttcaggatccgtttcaatttgcctaacagcgacttgaaagctttttcttgcgccttttccgttaattgttcgttccttcaaaaactgctgaatatatttgctaaccggttccatcagttctcacctcgtttctcttttctcttccgcaactctgccaactctttattaacacgctttcgttctgcttcatcagggcctgttttctgttgctcagccgactgctttgccttttttgatgcttccttagtctgttgtttttctttctttgcccagtcaggaagtgtttctgtaatctgtcggcggccgccggatgaatatcgtcgttgcgatcgttgtgtctctttttcctgcttttcttcagttcgtttttgaacctgtaaaatggctttttctgcattcgttacatggttttgagcccaattatccgcaattgtattaactaaattttgattgagagttgaatttccaattccgatgagaacatagtaaataagaacgttaataacctcacgcggaagcaatcccttcgaaaccagttctcgaatcattcgttgctcaccagcagttaccataccgcccttttggtctttaatttgctttaaaaagctaattggcgcattttctttactaatctggataacttgttgagtgggctgatcaaattgttgtaccagttgttgcccatccgcatcatcttcaggcttcttgtttattgaatccggcactctaacttgtggttgtgtaaagtcgcgtgcaataatgaatttcaaacttttctgattcaatttattcgtgtttagatttgtcgctttcttgatcaattcacccattttaatttcatctataccataaagtgaatactcagacaaaatcaatggctgtgccgctttaacactggcagcatcaacgtacgaattttctaaaatatccaaaagaagattaaaatcaaactcctcttttgaaggttccaaataacgatgattcagttcagcagaattccccgagatggtttgcttggcaatattaaccggaccaggaatatttttaacagaattttccggaatctgaaaaacatcaaggagcgaagccgagacattcttaacctggccaacatccggcattggaataaacagccgagcaacaattcggttataggtatcctcacccactcttcccaaaagtaaaatcgacaaaatatcagtttttaaaaactcggttgccgtgcatggctctctcatggaataaacataactatcaggtgaagtaagtgagacggatgtgactaataaattaactgcttcgagcttacggcgataccgtaataatttgtcaataccaatatccaaaatactttggagttcaaaatgtttatgaagaatcaatcgattatgatcgctcacactcaatgaccaaagtaaattataaagctgcactgcaccccgcccaataattggtaaatacaagttggtaagaacactctgatctacgcttttgtttgcactggcattcaaaacaagatatttcgaatcgggagttaatttattttccgaatttaacattacttctcctcaggatgctgtttagcagcattctttttcttatccttctccataacttctttgagttctttataaaaaacagacatatccttaaattgacgataaacactggcaaacctgatatacgcaatctcatccagattcaccagttcctccatcacatactctccgatttgacgactggtaacttcattttcacctgaagaacgaactttattttcaacccgatcaaccaaatcagtaatcgcatccattgaaatcggccgcttttcagccgacctcacgacacctttaagaattttttcgcggttaaactcttctcgattgccattttttttgataaccagaagtggtgttgcttcgacccgttcaaacgtcgtgaatctaaagccacagtgttcacattctctacggcgccgaatgacacgaccatcatcggttggtcgactatcgacaaccttggacccgttatatccacaatgaggacattgcatggctttcacctctaatatttcttttcttgttgtaaccaatcttctacttgcatatttgtattttctaaactacctgaattataaataattgtatcagccaaatcacattttgtctgcagtgaccactggcttttaattctggcagacgcctgactaattgttaaatcatctctgcgtcttaaacgtttcatttgagtcactggatcacaatatacaacaacaattgaatctgtcaaataagtatacccgttttcaaataaagttggggcgtctaggaccgttaattgcttatcacggtaacgatcaatttcatgaatgattttttctctgatgaagggatccatcacttgaacaagtcgttttaatttttggggatgttgaaaaacaatttccccgagtctggttcgatcaaggcgaccgcttgaagctaatacttcctgaccgaattccgctgtgattgcctttaaaccgttctcaccaggctcttgaacctgatgtgccacgatgtctgcatcaattatcggaatgcctttcctgccaagaaaagtgctcactgcagattttcccgttgcaataccacctgttaatccaatcactttattcatgacgatcaccgtgaatcacctgacaatttgggcaaaaatgtgtccccctttgggccagtttgattttttcaataggtgtcccacacctaagacaaggttctccctgtcgaccatagacgtttaaatgattttgaaaattgccagcttcgccataagcattggagtaagaatgaacagtagtcccgtgaccatcaattgcctttttgatttcatcaataatacttttacggagtaatttgagttctgccactgatagtgtattgacaggctgcttagggttgattttgcttaaccaaagcacctcatcggcataaatgtttcccaagccggcaatattactctgatccaaaagaaacggcttgaccagctttttacttttaccaaatatttttctcatgtaatctaaggttaagtccctttcagtcggctcaggacctattgtttttaatccagccacagtcagttcatgcccggtgtcaaccaaattcattctaccgaattttcgcgtatcattatatcgaagctgacgcccatcggttaaatgaaaaacaatatgagtgtgcttgcttagaggtgttccttcaggctcaacatcgtactttccttccattcgaaggtgggatacaattgttaatccattgttaatccgaataaataaatatttaccccggcgatcaattttttcaatgatctgatttttgagtgcgtttgtgaaatcctcaggtggtaaattgatcattttaggatataacacatctaccgtccgaatttgacttcctgcaaccagttcggtcaggccccttcgaacagtttcaacttctggtaattcaggcataatctatctccttgattctacttaattaaacatttaaaaattgttgcctaaataaagcaataatctgtcaaccaaacaataataatatcttgcatcatttagcctcataccaagtctttccccaatgactctctacttttaatggaatgttaagcttgattgcagaatccatcacttttggaattaacttttcgacagtttccatttcatcattaggaacctcaaaaattaattcatcatgaacttgaagcagcatgcgcgtttttaaaggcttcagtgcctcatccatattaatcatcgcaattttaatgatatctgctgcactcccttgaatgggtgtgttcattgctgttcgttccgcaaaggaccttaaattgaaattccttgaatgaatatcaggtaaataacgacgtcgatgagcaatggtttcaacataaccatgatttttagcgaattcaacaatatcttctgtatattttttgacacccggatattcctcaaaatacctttgaataaattgatgagcctgttttcgactaataccagtgttattagccaatccgtaatcactaatgccataaacaattccgaaattaactgcctttgcctgccgccttaactcaggtgtcacatcatcatttgaagccaacccaaaaattcttcgggccgttgttgcatgaatatcttctccctcacgaaaggcttcctgcatattcttatctccggtaatggatgccaaaacacgcaattcaatctgtgaataatcagatgaccaaatctgccaatcttcatgggaaggaacaaatgcctgacgaatcaaacgtccctcttcggagcgaaccgggatattctgcaaattcggatccacggaagacaaacggccggtctgcgtcaatgtttgtaaatatcttgtatgaacttttgaatcattcttatggatcacttttaacaaaccatcaatgtaagtcgattgtaatttcgaaatttgacgataatttaaaacattttgcacgataggcgcatcgggtgctaacttttccaacacatcaactgaagttgaataaccggtcttggttttctttagaatcggcaaccgcatcttttcaaaaagaatatgcccgagttgtttaggagaaccgatattaaattcttcaccagcctcttgaaaaatggtttgttcaatttcagccaggcgttctttaaatttgcttcccatttgttccagcgtctcgggatttactttgattcccgcaatctccattttagccaacacaaaagcaatcttaatttcaatatcccgatacaaagttgtttgattatgttcatcaagtgctttaaacatatcattatgcaattgatcaattgcttttgccttgtgaacaatatgatcaaagaattcgggtgcttcaggatcgattttcttcttcgcaccttttccgtaaacttcttcatcagttttaatgtttgcaaacccatgaagctttgcgactgtgccaacatcattactattattagttgtattgagcaaatatgaaaccagcaacatatcaaaatcaacattttgtagcgtgattgaagaccgataaagcccaacgtaagtccgtttggcatcaaacacatttttttgaacagttgaactttcgagaatcgctttaacctgtttagtgttcaataaagaaatatcatttgacgcaaaccactgagcctcatgcccaagcacaaagcccatcaaattggccgtatgataattttcatcatccatttccaagtaaaaggatacttcatccttaaattggtttaactgatcaagattatctgaagttaatttcgtatattgaatgttttcaatttcatttttatccgttgcgtcaacaccaagatttgacagaaaagatttgaaacccattcgttcataaaaatcggtcagcctatctaggttgtcgccctcatattttaagtcatccaaggacactttaatcggtgcgtctcgtttaatcgttgctaaaactttaccacgttctgctttatccttatcgtttagcaaatgttccttaagcattttcccagaaacatgatcaatatttgaataaatattttcgattgagccaaactgctgaaccaatttcattgcagttttatcaccaacttttgtgacgccagggtaattatcagaattatctccctttagtcctttaatatcgatgatttgtgaaggtttaacacccaacttttcttctacatgttgaggtgtatatttttcaagatccgttgtccctttttttgaaatttgaacagttgttttgtcagaagttaattgtgtcaggtctcgatcacctgtcaaaatgacaacttgataatctcccttgtcctctgcctcttttgccaaggtaccgataatatcatcggcttcgtaatcaggtagttcataagatgaaattcctcgagctttgactaattctcggataaaaggaaactgttccgatagttcggttggcgtttttgccctgtttcccttatagtcagaaaacattttagttcgaaaagttgttttgccagcgtcaaaggccaccaaaatatccgttggtttctcttcttggagaactttgtctaacatccgattaaatccataaatagcagatgtatgtaatccggatgaattggtaaagcgctccaatgaattataaagtgcataaaacgctttaaacgcaatactgttaccatcgattaataataattttttagtcattaaattctcctcacaagatagtcttataagttaattttaccactcgtaacaggcaataataagaccttgacaaacgaaaatccaagcatgaaaaaaccggggaaaattccccggtccatcgcttttaaatcatatattagcgttcgtcacccataccaaaaatctgcaataattgtaagaataggttaacaaaatccaagtatagttgaagggcaccaaacacggccaacccactaacagaaacttgaccagtactacccgcctgattgtacatttgcttcatcttttgcgtatcatatgccgtcagcgctgtaaaaataacaacggcaataattgaaaagacaaacgtaattagagtgcttctcaagaagatattaataatcatcgcaataacaagtgcaattaaagcggcaattgcctgccgaccaattttatccaggttctttctagtcactaatccgaaaactgtcattgtgataaagattgccgacgctgacacaaaggccgccgcaattgaagcacccgtataacgataagcaagggttgaaaagacgaacccgcttaaaacagcgtaccccattaacgcagcgaaagccaacgatggtcgctttaaggcctgaaaagacacaacaaacggtaaaataaaccaggcgattattgcgatccacatacctccgccggtcaatacagccggtgaaatcgccgtaacagtcagaaaagccgttgcagctgataccaatacagctaaactcatccaaccatacattttagttaaaaaagcatttaagccagcagcattgttaacaactcgccgctcatttcgttcatttgaaaaattgtccattaatttcgctccttctttcgaatccctgccttaattttacaacaaataaatcaaaacagttgcggaatttactccatctcttaataagtaatcttaacaaacaaaagccattaatcaagcaaaatatctcgatcaatggcttttcctaagaaatcttaattattattcttactaagatgacttagaaggtcttcataagtcttttcgtatttttgaatatcaccggcacccataaaaataatcacatcgttatcataatccaataaaggtgacatattatcagcagacaagattctgccgccctttgtgattttctttgaaagatcctcgcttgaaactttaccagagctttcacgcggcgaactgtaaatctgggtcaagaaaacttcatctgccaagttcaaactcttcgcaaaatcatccattaacgcgatggtacgactaaacgtatgtggctgaaaaaccaccgcaatttttttgcttgggtattcttgtctggcagcatcaatcgttgctttaatttcagttggatgatgagcataatcatcaataattgtcatcccggaaattttacgttctgaaaagcgcctcttaacgccatcaaacgttttcagctctcttcgaatttcttcaagatctacatcctcagagtatgcaacggcaattaccgctaacgaattaaagatgttatgttcaccaaataatggaactgtgaattcccccaagtccttacctttaaatctcacatggaaacttgatcccttggtcgttcgcttaacatcaaaggcttgaaaatcatcggtatcattaagtccataataataaatcggaaccttagcttttaattggcgaagacgcttatcgtcgccccaagcaaaaattcccttcttcgtttggttggcaaacgtctgaaaagcatcttggacatcgtcaatgttcttataatagtcagggtgatcaaaatcaatgttagtcatgatggcataatcaggttcggttgccaagaaatgacgtcgatattcatccgcttcataaacgaagaaacgagcatttggcacacccctaccagagccgtcaccaattaagtaatcggttggtgcaattccggacaaaacatgtgaaagcaatccggttgtacttgttttaccatgagcaccagatacaccaatacttgttttacccttaattatctttccaagaaattcgtgataacggtataccgtcaagcccatctctcgagctttcttaatttctggatgatcatcagtgaaggagttccccgcaatgacagttaaaccctcgtgaatattattggcatcaaaaggtaatattttaatacctgcctgttccaatccacgttgcgtgaatgtgtattgttcaatatcagagccctgaactttttcacctcgatcatgaaggattaaagccatcgcactcattcctgttcctttaatacctacaaagtgatacaccgtatctgaattcatattgcatcctacctatcccatctaatttagatttactctttctcgtcttttgattcatcgcttgtttcatcatccggatgatagtaaactgtccgaggttttgaaccacgttgttcagaaatcaaattccgatcctgcaaactgtcaattatgtttgcagctctattatacccgattgaaaatactcgttgaagctttgaagtagaaattgtgtcttcttgagcaataaatttcattatctgtggcattaaatcatcttgtgactcgttattatcaacagcagcctttaatgaatccggtgtaaataaataatgagggtgaccctgttgacgaacaaaatcaaccacattttccaattcttggttattgacaaacgcgccttgaagacgaattggttgactagctccatttccaagatacaacatatccccacgtcctaataatcgctctgcgccagcggtatccagaattgtcctggagtccacttgacttgaaaccataaaagcaattcgtgatggaatgttatttttaatcgttccagtcacaatatcaacactcggtcgttgagtcgcaacaatcaagtgaatcccagcggcacgcgccttttgtgtaattcggactatgtagtcttcaacctcactggaagcagccatcatcaaatcagctaattcatcaatgatgactagtatatatggcatcttcaagccatattcctcggcatcagttgcttttttattgaattgctcaatatttcgaacaccggcagcagataacttttcgtatcgttggtccatttcctttgtaacccaatgcaatgcggcagcagctgatttgggatccgaaataactggtgataaaagatgcggaatgccatcgtaaggggccagctcaacagctttagggtcaatcagcaatagtttcaactctgctggtgttgctttatacagtaaagaaaccaataaactattaataaagacacttttccctgaacccgtggcaccggcaatcaaaccatgcggcattttccgaacatccgcaattcttgatgtcccggaaaggtcaactcccattgcggtagtcagtggtgaacgactattagtgaagttactagtagaaataatctcagaaaggacaactggtcttgggttggggtttggaatttcaatacccaccgttgatttgccagggattggtgcttcaatacgaatatctttagccgctagtgcaagtttaaggtcatcggttaaattggtaattcgacttaccttaacgcctaaagccaacttaacctgaaattgggtaacggtcggtccatccgtccaatcaacaacttgagcattcaccttaaatgcatggaaggttttgtctaaagtctctatctggttttctatccagtcatccattgcattttcatcagttggttggggcttttttaataagcccaaagagggaaaatgatacccatcagctgatgtagatgattgagattggattgtagctgtctccgttggcaaaccggaagtttcaacagctgattctttaacgactggctgtcgcttttgatcatctttcacagagatttttttagtgtcggacaagccatcttttgtctgctcatgaaataaagacaaatcaggctttgcagcacgttcactatcaacaattgaaaccagcgattgtcccaatccgtgcttaattggatgtgaaacttccggtcccgaatttgtggctttcgaactatcaatcacatgatgattcaactcattctcaagatcatctttttcatgattaccaacgttctcttttaaatcgccttcatcggtttggttaactcggtcagtgtcagtattatgattcgcatcagaatcagatagaggcgcttcgagctgttccgtgtgtggtgtgatgttgtgatgctctaaaatatggtcatcagctttttttaatgttcctttttcactctgagtcactgaattcaaaggatcttcaagaacaattaaatcatcatcaggtgtcctcaactgatccattaattttgaataatatgttgatcgtcgattcttctgactaacaaaataatttgtctcaatttgttttttttgctttcttctttttgcattcacatcacgctgattcggcacaaaattacgaatttctttcaaaaaagcaggtgttttatcatcactaactctgttatctgtaaaatgcgtatcctctttttttaaatcacgagtcggcttgcgagaataatcaggtgctgattggtatttatttttcccctttttaggcgttcgcgacttgattaaatctcgacgacgaaaaaaggcgggtccgtcataatacttcatactttctcaccttttgttttctataattaactgaataaatgttgtgctttcttgaaatcgaacggttctccaaccgcttgataatcatccggtaaaattaatgctcctggaacttgtggtgcatgaggaatgtgaagctctcgtcctgaacaaatcataccatcgctttcaacaccccgaagttctccaggccaaatgattaatccgttgggcatcattgcaccaatttttgcaacaacaactttaatgccgacctgcatatttggcgatccactaacaatttgcacttcctgaccgttatcaacttccgtcgttgttatctttaaatgatcagatcgtggatgatccgtcattgttttgacataccccacgacaaaacgtgcttcttcatccgctttaaggtcacccggaaaaccatgtgccgtcaaaaattgatttaacctttgaacttgtccttctgttaaatcaatctgaccgttttgatcaataacttcaggaagaatttgacttgcctttaggaagttgtaccccaatgtttgatcggttttcgaatcatagatacgggcaacgttgtcgtgaacaaccgtttcctgattatccacgtcctgatttataattaccaccatcgtgtcacccgtgttcttagggttataactcgcaattaacattattttatccttccctatccatctttatttatttaatgaatcaataaatttttcaacctcttgtttggtcttgcgatcaggatttgaaaaacgaccgatctcctggccattatcataggcaacaaagcttggaatccccataacatccatttcaccagctaaatcaatattttcatctcgatcaacttttaaaaatgtatagtcttgatacttttgctcgatttcaggcattgcaggtttaatgaaccggcaatcagggcaccatcccgctgtgaagaacaacatatatttaccttcaggaatttgagattccaaggtagctaaatcggttttgggtaactctttcatgactttatcatcctttcaaactcttgctttcatttagtaagcaatcaaattatatcgcataaacccaaattgttatgtgcttttgctcaatgccttgttcctaaaagcgtatacttaagtttaaacaattatcgctaaagaggtgaacatctatggaaactaaatcattttatcaaagtgtcatgttcgcaagtattgttacaagcgtttacgtaatatttaatctgaataaagattaccagaaatcacgaattcgcgaaagccttttaaataaaatgattaaacaacatcgtgatttgactattgctggaaaatatcttggacattggagcgtttcttttgaaaaaacaaagtcaacgtccccagttttccactttggttataattatcagaccaatgacggtaacgttgaagttcacgcgttctgggtcaattacttaactaataaaacgttaaaagaagaagtctatgaattaaaatgagcaactaatttataaattggcccattcggactaaacttttcctcatactcggtttcaatgttagtttcattttctggtgattgatgaagatcaagaaatacatcatcaaaaatcatcgggaaattgttcattgtcactagtgtgtactcaaagaggccccggttatcggttttaaattcgatgtctccgtttgaagcaagtactttttgatacgttttaagaaaaccaggcgatgtcaatcgcctttttgcatgtctttttttgggccatggatctgaaaaattcagaaatattttttgaatttcacccaccaaaaataattcgtccaagtcagcaccatcggtcaaaacaaattgtagatttggcagtggatcttccatgaattttcgaagtgcagttgcaatcaccgatttctgaagttcaatgccaatgtaattaacttccggatgagcccttgcattttctataataaattgtcccttgccggtaccaatttcaacgtttaatggttgcttactttcaaaccgttcctgccacttgccaagccaatttttgggctctgttacaatataatccgcatgatctttaatgtaaccatctgcccaaggtttatttcttacacgcaaacttttcacctcttcatttaatttatcaaatttatcgttatctactaaattcactttttttgattcttcttggtacatacataaaaataaacaggccaacttctatggcttcaccaatgagtacgccaataaccgtaacgggcgctgttaagttcacggcaatgaccgtaatcgcaaaaatgaccgcaacagtccccatcatcattaacagcactctttggaaattctttaattgaaactcagttgtaactggataaatgtgaacaaacgcattgtcatcaaaatgaaagtagaacggaatcatttggaagccaattaaatagagaaacagtaaacacaaaacaattggtaagacttctcctttaataaaaaccaggagtaacgtaccaataactgttaatctgacatataaaccgctcatctcattatcacgaataatgccatgtgcataaaggtacaaataggtgttgtccggcaaaagcttaattttgtgtagcaaccagtccaaatacctccgccgttttacagaaccctttagggatggcacatcagtaaataaattaaaaaattggtaaatcgaatgcatgcgactattttcatcggcaatcagtgtttgccaatctacagagcgttttttccaagcattttgggtaaacagtccgccaatcatgacgatcgcagctaagacgacccctataaagtaattaacatagatagagattgccagcacaacaactggaatgatcaatcgaaagagccatcggtttcccatccatttatgctgcaaatgatatttcctggcaaaatcggcattcatccaagctacttttaagaatatgatggtgcctaataaggaaaatagttgaggcgcagaagcagaaactgtgacttgtataaagggcatcaaaactatccagaataatagttgcatcaaagctgcaagtattgtgctataccaaaaagcacgtttgagatagccgatcaactcggcctcttgtggcaataaaaaaacataatccggatcctcaatcagtgttgccatcctaccagtctggacactgatcagaagcacaatgataataagaagtggtgcccaccaaagaccggttgtcagttgtttaagcgcattagaataatagtaccctaatccaccaatcatgaaaacaagtgctaaaacaaagtaatcattaaaaacaagtctcaaatacttcgttaactcagttaaatgagcgcccaagcgttttttaaacaatgttttcatgaagcctcgccttcccttgctagcgtcaggtagatatcattgagtgaattgccggcttctggaaagagcgcttgtaattgggctaaagtaccctctgttctgaccttgccatcatgtaataagacaaagcgatcacagtaacgttgcgcggtgtctaaaacatgcgttgacattaaaatgcttgccccttgcttctttcgttcggaaatcaagttcaacaaatcgttaacggctaacggatcaagtccaagaaacggttcgtcaataataaataatttggcatttgtcaaaaatgcacaaacaatcatgaccttttgccgcattccttttgaaaaattatcaggaaaccagtttaatttattttccaatcggaatgtttttaatagtttatccgctcgtttccatgcctcattctgatccaagttataagcaagcatggtcatttctaaatgttcttttagtgtcaactctttataaacaatcggttgttcgggaatatatgcaatctgctgtttatatttttttacatcgtcattaattgctacaccattaattttaactgatcccttaaacggtgttaacaaaccgataatatgattaattgttgtggatttgccggcaccattaagtccgatcaacccgactaattccccatccttaacatcaaaggtaacatcctttaaaacgggaacttgggaatatccaccaacaagattggaaacttgtaaggtcattatttcactccacaattctaatagtttagtctttcaatcaacaaaaacagatacagaacaaattataacatagaaaattagtctttgaattagttcgggtcgacattgatgttataatgattgttagtattgacagaaagaaggtaaaacttttgaaagattgtattttttgtaaaattgtcagaaatgaaattccaagttacactatttacgaggatgatgttgtaaaggctttcctcgatatttctcaaggaacccccggtcataccttggttattccaaaaaaacatatcgcaaatatttttgagtacgacccggaactcgctgcagcagttttctcaagaattccaaagatcgccagagctgttaaagactccaatccggatataaaaggtatgaacattcttaacaataatggacaggttgcctatcagtcggtatttcattcccacttccatttggtaccacggtataccaaccatgacgacttctcaatgacctttaaagataactccaataaatatacgccagatgatttgaagaaaattcaagattcaatcgtagcacatataggagattaatcatgaaaaccggattgaaaatggctggtgcagctgcgtttttatttggtgtttacttatataccaataaagaaacgcctgaagctttcgcaaaacgagtaaggaaaagttttcgagtaaaaagacaggcctattctgattggcaagccgcctacgaagattttaagcaggcccttaataagtttaaagatcaaattcctgaacttgaaaaagttttaattgcattgcaaagagatatcgacgaagcgcagtttcaaattcagccgagaattgatgagattaacaaatacagctcaaaaataaacaaaccataatcacaattttatgaatttttgtttaagttcaacggtggcttaggtatgttgccaagaatatgttattattgtacggaacgtttgctttacaaacgaatactatatgtagaaatggatgtgtttttgtatgaaaaaatggctaatcgttttagccggagtactcatgagttttacgcttgcagcttgtggtagcaagtcagttgcaactactaacggcggtaagattactgaaagtgcttattacagcagcttgaagggtacatcaagtggtaagcaggtattgcaacaaatgattcttaacaaagtattggaaaaacaatacggcaaaaaggttaaggattctgctgtcaacaaagacttcaacaagtataagaagcaatacggctcatcatttaacgctgttcttcagcaaaatggtatgactgcttcacagttgaaagattcgattcgttcaaatcttttattacaacaagcagtgcgggataacaccaaatttaccgatgctcagttgaaagcacagttcaagtcttatcaaccaaaagtaactgttaatcaaatcttggtttcaaagaaatcaactgctgaaacggttatcaaacaacttaaagctggtaagagcttctcaagcttagctaagaagtattcaactgatactgctaccaagaataagggcggtcgaatttcggcatttgataacacaaacacttctcttgattcaaacttcaagaaggctgctttcaagttgaagaatggcgactacaccaagacacctgttaagactcaatatggctatcaagttattcaaatggttaaccaccctgcaaagggaacttacaaagaccatgaaagcgaattgaagactcaactcgtcgacaagcgcttagcagacagcgatacgttacattcagttgtttctaaggtccttaaaaaaggtaaggttacaattcaagataaagatcttcaaaacgtcttatctgattacctttcaagctcttcaaagaagaagtaatctctaattaattgtatgattaaaacggctgggagtttaaaactctcaaccgttttttagtgcctaaaataaactacttggatcttttccgctatcttgtaaatgatttggtgtatgcggcttataaaagcgccggttatccaatccaaaaattctatcggaataatcaccgggaacaatatttgtcagcgcaccttgaatcatcataattgaggcatccagttcgtcaaggtcatgaagtatctccgcttctaataattttggacgttcaggtgacccatactctagtaatccatggtgggacagaaccatatgtcgcaataaaagtaaatcttcattttgcccatcaatgcccaatttgtccgccgcttcaacaatttcagcatcaataatacttaaatgtcctaatagattccctgccaaagtatattccgttccaaccggtcctgataattcaaccgttttgcctagatcgtgtaaaacagccccagcataaagcagcggtgcatcaatatccggatactgtttaacaacagaatgagcaagtcgcagaattgaaattgtgtgaaacgccagtcctcctgcaaaatcgtgatgattactttttgctgccggataactgaaaaatgattttgcatgtctattaagtagtgctcgaacaattcgattatatgttgcgttagtaatttcaaaaatcgtttggttaatgtagtctttcatttcttgacttgtcataggagcacgtttaacaaacatcagtggatcatgtggctcattggctttagtcaagcgcatctcatatattttaatctgaggcgtatctttgtagttttctcgttttccctttaggtaaactactcttcctggaacaaattgttgcgcatcctgttcacttgcgtcccaatacataccggcgatttgaccggattgatcttgaaatgtaatagaaagaaacgacttcccgttttttgcgacccgtttgtcagcattcttaatcaaaacatatgtctcaaaatcttcttctaaagaaaaatccattaagtgttttgccattttaaaccaccctcctatatccttgttaaatcaatcgtatttaaattacctgataaatcacggtaagctgaaaaatacaatacctgtgtatgtttactaattgttttcatcacatcaaaggccgctttttttcgagttgcgtcaaaactcataaagccatcatcaatgatgataggcaacggatagtcatcgctaaatccaacagccatcgaaaatactagcgataaataaagctgttccaaggttccttttgataactcgttaacattaaattgttctccatccgctctggtaaccataatatgatcaccgaaccggacatctgaataatttccctgcgtcatcacactaaaatatgctttagcgccctttatcgcttttggtaaacgtcccttagttgcgatatcaagtactctctggagccattgatagctcagtgaaattgccaagaatttgtgaacattctccaaaatttccgatttttgattggccaattcctgttttaaatcgtaataacgaccgttactgataagatcattcatttgaatagtcagttttgtctgcttttgagttaagttatcaatctgttcatggagctgactcaattcattttctaatgcctctgattgcttttgaaaaccgtctcgatccatctcttgaatatcagacatgcctgccgatttcagttggtcaaacagctctttttttctttccaattttgcctgaatatgtttttgtctattcagcatatcgtaaaaaccatcttcggactttaaatgacgtttagaaaggaaatcaattagttttccctgttcgctgctgagctgatcttgaaggtgcgcaatagtctgttcataggctcgagcccctgccttcctactttgataattgtcctgctgctttcgccattgagaaactgtttgatcaataatagcaaggtgcgtcaaaacgtcgtcattagatggaatccagtgactcgcaaactgccactttgctaaaaaatgatttatttgttgaagataagacgtctgttgacttttcagtttattttcttgatcaattaaatccaacagacgtctcagaccgggttgaattgacaaccactgactttgtgaaatcccttctaatcggtatttcgacacaagagtcgttaactggtcgtcaaaccttcctacctgcgcgtactgcgactggacactccgaccacgaccggtctgctgctgactaaagccataccatgctacaaacccggccacaaagtaccccatccaactaaaggcaaaacggtgcagcaaaatagtcagcaacacaattataccggcaattaagtagattagataatttgatcgatcatttgaccgcccccgttgttgaagccgacttccaactttcgtttcaacattttgactttgatttaacattgttgttaccaatatcagatcagcatcattaaaaggagttggaaattgaccacttttattccttggcagatcattttgaattttagtgagttgttgctgattatctgccaattgttcacctataaatcgaaactgtggcaatttatttttaacttcaactaactgaactgtcagttcatcaattttcactttgttttgttcatagaatctttgtgatggcgattcaatgatttctgatgatatttcttccatttgttttttattagtttttaattggtcctggtaggatgaaatgcgggagttcatagtttgaaatgtcaaaacgtctgcatcggaaaatccctcttgaagctgcgattcattgaccaactgcaattcattatatttggccagaagtggaaatgatgaggcgattcgctgattttcccgacttctgccttgacgtttcttcaaattaagccgagcagttttcaactgattacttgtatttacagcttccttttttagcgtctgaaaatttagataatcttgtcgcgctgattgtactttatcttcaagttcttggtaacgttttagctgaagattaagttcaggctttcgtccacgctctgaataaattggcttcgcttgtttctccagttctttttgaagaccaaaccactggtttgaattggtaatcccaatctgttgaatacgcgtacgcaattcatcttcgctcatttgataggcagcttgttgatcttctccatcaaaataaaaaagttgttggtaggcgtttcgatccaaaggagaaatgattttttgataatcatcttcactcagttcggtatgttgatcttcatcaaaaaatcgaaccgtcccaccttttggtcccttagtccgaatcaaccgataacgacgacctttatatctaaagataatctcaccaccatacatatcttgatgatttttgggaatatattggccatggattgcctgccgtttactttgaaacccgaataagacagaaatgataaagtcaataatcgtacttttaccagcttcatttggtccatatatcatttctaacgattgattaaaagaaatttccgtatcaatccatttaccatacccatatattttcaaatagtcgatcgtcattatgaatcacccttttcatgatcgatattctcctgaagaatcgctattgaacgattaaaaatatcgtctaacgtatcttgagcatttaaatcatcattaataaagcttaatgccttcagcggaccagccaagtcggctaatgtttctttcgtaaatgtctccgactttgcttgatcaaaataggcttggtccagacgactgactatcactggtttagattggtgaattttgattgatgttatccagcaatttaactgctgccagttttgagcgtttaaattctgaagtgctgtcaaaaatgtaccgtcaaaaatggcctttagtatgtccgatggaatcgttatatgactatctagaaccactctaagaaaatttaatttataaaaattaagtgacgccaaatggctaaaaatggtttccggtagttcaccaacggattcaccatcgaattcaatgtggattgtttgccaaatgattggcgctgttgcaacaaattttggctttaaagcatgttgcactgcttccaccattaaataacccttctcaccagattcattaatgtgtcgcccctgcgtgttcccagagtaattaatcgttttttggggatttagcgactgccttttatgaatatgccctaatgcccaataatcatatcctttctcttgtaactgatttaaattaaatggggcataattggcctctggggagttcacagtggccaagctaccatgtaacataccaatattccaatctgcgtcacttgcttgaggataattctgtatgatcggatccttaatccattgactgccaaaactaaatcctgaaaccgctatccgttggccatcctttaataataaagtggtagttgctaccttattgctaaaaacataagtgttctccggataaccaagttgattaacacgaccactaaaatagtcatgatttccaaatgagatcaaaacgggaatttgatgatcattaagtcgattcagttgttggaccaaaaaagtttcagcatgaacactatgatcatttcgatcaaatagatctcctacaagtaacacaaagtcaacattctgttcaattgcatcattaacaattctttcaaaagaagtaaacgttgaatttcgaattttatcccaaagatccctgggaatcgtatggttttgtaaacctaaaaagggactatccaaatgaagatctgctgcatgaataaatttcatttcaaaaaccgttcccttctatatacttatgtacgtaaaaaatgccgaatttagttttcaatcactaaattcggcattctattaatcacgatataagtcaataatcggctgggttacaactctattaacatcattcaagaggtcgtttaatgccttttctttagtcatcaaattggaaatcgactcattttctttaacctgattggccatatcctgggctcgtttaatatcagtctcagcaggttgttgaccttgcatctgctgttgttgtaattgtaattgcagcttttgaaaagctgtaaataacttaaaagtgtccggatcagctttgatcttctcaaacgctgcctttaaatcagcaaactgagcagagtcttttaattcactttgaagttgggatgcggtatccattaatttatcagacataaaaatctccttaattgttatagtcagttaattttaacatacaaatactgatgttcacactttttctctattggccaaaccatttcttagcatcatcaataaaacgctttgctttttgtccaattgaatcagaatactgttccgttttcttttgaatcgtatcccagagattgttatgactattttgttggtcctgaacaattgtctgcgcatccttggtgttaaagctggaatttttagtataaggcagcattgtttgcatttcgtttctaaagagtagccccataccggtaccgcttaagttttccaaatgatgtgcttgactggtactgtcaaaaccttcccaagttgcaacaaccaagtctggtgtgtatccgataatccatttatcctttgtcgcatctgaagaaccggtattatctgcttcagtactaccagtttttccagcaacggaatatccgtaaggtttggcatctgcacctgtcccattattaaagacacccaacatcatactggtcatctgttttgagacagaggcgggcatgatttgtcgtccctgttgcttggccgtattatcaacgatcaccttgccggttgaatccacaattttgcgaatgtagaaaggcttcatgatttttccaccattggcaaacgctgtataagctcctgccatctgctgtggggatacacctgatgagagtccacctaaagccaatgcaaggttcttatctttttttgtaaccggaatattgaagtccttaacagactgatagccacgatcaaccccaatctggttaagcaaccaaactgcaggggcattcatactttgagcaagcgcctcatacattgggacttttccctgatacacattattgtagttttttggtgtgtaatgattggttccgtatgattttttcttatcaaccaattccgagtcaaatttataccccgcttctagcgcaggtgtataaaccgccagcggtttcattgccgatcccggttgacgtttgatttgggttgcccgattgtaaccacggaagacatgctgcccacgaccaccaacaacggcggtaacacctccggtagttggcgagaccccaatagaagctgcttgtacctccgtcccatctgaagcattcgcagggaacaaggtgttatttttaaaggttgcctgcatttgttgctgttgagattgatttaaattggtataaattcgatatccgcgattcataatctcagattccgtcaagccatatttactaatcgcttcatcaataacagcatcaaagtaatacgggtatttatatccatcctttcgaacgtaagtatctctgacctcaatgggcgtttttttataatagttagcctgagcttgcgttaacttgtgattctcaaccatcaattgaagaacaacatcccgtcgccatttggccgctttcggatgatcaatcggattaaatgcacttggcgacgtcagcatccctgctaagactgcagcatcagggacagataattggctggcattctcgccaaaatatttttgagaagcatcttggacaccccaaacaccgtttccaaagtaagcattgttcaaatacatcgttaaaatttcattctttgagtaaacattctcaacttgaattgctaagaacaattccttgaatttccgagtcatggtttgctcttgtgataaataagcattctttaccaattgttgggttaatgtacttccaccgccactaatatagtcacgatgaagcaatttattctttagaagcaaaaagaaggcccgtccgatccccttaatagaaaacccatgttcatgatagaagtttcggtcctcagttgaaagaaccgccttaggaatatttcgagataccctattcagatgaacatatgtccccttttgggcatataattcacccgccttttgattactggcatcaaaaatttcagtcgtttttgacaaagatgattccagattttggacgtgggccgttttagcaagaaaagttaagtaaatgcttccaaccagtgtcaccgttagaaaaaagacaatcaaccatttaataagatgaaattttctacaaaaccgattaaatttcctgataagtgatcccaaccactttcgggaagatttagttgaattgttgttattcattagtctctcctttgtagatacaacacattgtatcacaagtgttaatttcaaaaactgaagtgttgtaaattttaagggggatttaaaaaacagttcgcctgccgaacaaaaggcaaacattgcaaaaccaaaaatggcgtactcaatcttaaacaaaaaagaggcagggcaaactgatttttgtcccaacctcacgtttattttttaaaattacattgcgtccggtgctttaacacccaacagattcaaagattccttaagcacgatcgaaactgatttaactaatgccaaacgggcacctaatttgtcatcttcaaccaatacctttgaatgagcataatacttattaaaggcttttgccaacttcagtgagtatttagcaacttcagaaggctcaaagtctttgcatgcactttccacaacatgtgggaattcattcaaagccgtaacagtttcccatgcagcaggatcgtccagttctttgtcagtggtgtggaagtcaatggatgaagccttcttaagaatgctctcagcacgcgcatgcgagtattgaacataaggaccagtctcaccttcgaatttaagttgatcctccaaaacaaaatcaatattgttagttcgttcattctttaaatcaccaaagataatagcgccaacgccaacttccttggcaacttcatctttatcttccaaatcagggtttttggcctcaatttgttttttcgcaagattaattgcatcgtcaagaacttcatctaaaagaatgattcttccagaacgagtcgataattttttgccattgactgtaatcaaaccaaatgggatatgatgaagattttcagctgactgtaatcccatttcgagtaaaacggcctttaattgcttaaagtaataggtttgctctgaaccaaccacatataagttcatggctggtttgtatgtgcggtcacgataaatggcagtcgcaatatcacgggtgatataaagtgttgccccatcactcttaaggatcaaagctggattcaacttatacttatccagcttaacaacctgggcgccttgtgattcaactaaaagacccttatccttcaaaatttggataccttcatccattttatcgttataaaaggcttccccattaaacgtatcgaaagtaacgcctaatttgtcataaattttattgaatgattccaaagatacccggcggaaccatttccaaagctcggtttcctcttcattgccatcttccaatttcttgaaagtttcccgagcttcgtcatcgagttcgggatgttccttatcttctttatggaatttgacataatacttaaccaaattattgatggggtcttttttgacgtcatcttcattgccccacttcttataagcaacaatcaacttaccaaattgggttccccaatcccccaaatggttatccttgattggatgatatccatttttaacaagtaattttgcaattgaattaccgataacggtagaacgcaagtgtcccattgaaataggctttgcaatgttaggcgatgacatgtcaatcggaacattaccgcctttaccattatcattttgaccataagttgagccttcttcaatgatagttgttaaaacctgtccgctaaacttacccttgtccaaaaagaagttaatgtatgcgccctttgcttcaactttttcataagatgtctggtcaatttttgaaaccaaatccgcagctatctggtttggtgctttatgaaaaactttggccagcgaaaaggctggaaatgctaaatcgcccatcgatagtgacttcggttgttccaacttttcgtacacttctgctgatgaaagttcatcgtttaaaacgctaagaattgaattagtaacttgtgctttgtaatccattgctgttccctccatagatatctatacaaaaaatcccttacaacaaaaaattgtaagagacgagtaaccccgcggtaccactctaattgatataaatatccgctcaatttattttaatttagtattctaaaaagcacgcttcgttggataagtattccggctttcaccatcccggaatcgctcattacttaattaaccaactactcctcttttattattgaataatcatcatgtaccagatgtatgttaacttgttgtcactaacttgtcaacaaatacaacaaccacctggatcgtacatcatactttgtacgaagcgggtaacgggaatcggacccgcgacacaagcttgggaagcttggattttaccactaaactatacccgcatgtcaagaataactaataaatattatatcatgccagcgggcctttgtcataaacattttttatctataaagaaaatgaaaaacaattgcaattttcttacaaattaaagatacttaatattaaaggggtgatcgcggaatgtggattacactcaattacgtgtgttgggcaattttacttattaattttatttggggacttactcgaaatattaaaaaacgggtcatcgattctatgatgatctctcggttattttattggatgattgttatcagccaagttgtcattggactgcgctcattccatcgccatccactattagttggaattggtgccataataacgctgattatcattgctttatccgaaacagcatacggcagaaaacaggaaattaattacacaccccgcttactttggattctcatcattttgggagtcatcggtgcgggcatacaaacaacggtcaacttttaaaaagctgaccgttttacttttgcataaactatgcaattaattaatttatgaaactattgcagccgatttttggagctttttaatccagttgcttatcagcaactcctcgattttttagtgccaattcaattgttctctttgctaataccgtttgtgcgtcaatcactggaaatgaatgatcgcctgcccgctgttgagcaacggatagttcagtacaaccaagaataacaacatcacaggaaaacttattaaccattgtcgacaggatttgatgatacagatcaccgtcaacctgattcttttctttgatatcatcgtagatcaattccattgtctggttagccgttttttcgtcaggctttaccaaatcatagcccgcatggcgaatctcccgatcatatataccatcatgaagggttccacgtgtcgcaatcagcccgactcgctttgcactgggaacatcatgtttaatgtccttcacagtctccctgggcatatgcaaaatcggaacactggtcaacgcctgaagatcgtcaaacgagtaatgagcagtattacacggaataacgaaaaagtctggatccaattgactctgctgcttaatatcttcggccaacggaataaatgggttgggcttactatggtccaagatatagtcagttcgatcaggaatggttgaatggttaaccaatatataatttaaatactcctggtcttttttggcaggtgttcgttcatttagaatatggataaaaagttctgtagcctcagttcccattccaccaataatcgtaaaaaagtttttcatttaatttcagtccttatttggcgacaaagtaacgtttatagtctttaacatagttatgcatcatccatttatataacgcaaacctctttaaacttttatccttagcgtaccaaaatgtatcaccatagcgaccttcatcaattaattgcatggcatgtttttttacgtcgttttcctttgcatacttttcaaaaatctttggtgttacgcctaaccaaaggaaataatgctgtttatctttatttgcataaaccgtttgttgatctgtcaatgaatcataaacataatcctgtacaatccaatcggcaaggtgatagccgttaagggtcacaaagaaactgcttcttccggtccgcaaattaatttcaaacaacttataagattgatcacgtgtatcaaatttaatatcgaaattgcaataaccggtaaactcaatctcttccaaaaatttctgaacccgattatagatatcttgattatattcaggaataattgcaacataattcccaattgctgccggtgcaggatcttccaacaacgggtgtcccaaacacatcaacttgacttgatgattcctatcaacatagacgtttaatgtccgcatatgactgtcatccccaggaatgaaatcttgaagaatgaaatccgacgtataaccgttagtataactttttgcgacaacgtctttaaattctgcttcattttgaataataaatgcctttttacgtccctcaaaatgaatatcaagccactcaacactatttgcaggtttgagcgcaaccggatatccaaagggttgtgttatttcctcaccagactcatacatcgcttttgtgatgatctttgtctttggatatggcaagtcatacttatcacacatcttgtaaaaattctctttgttgttcaaattccgaagcatttcataatcaacatatgggcatacaaaaacgtcttcgagttctgccttatgttttgaaataagttcagcataaccatcgccacaaccaattaaaataacaggttccttatgatcagcatatcgttttttgattttcttcatctcgtcaatccaaaccggatcttcactgaatccagggatcaattccaaatcaacgattttcgtataccgggttggtgccaaacttacctcggcaaacgctttaaccggtttgccataaatatcgtacaagcttcgagccataccatagacattaaaatcactgcctaataaaactggggtgaagtcggtgctttgattagtcatttaaagtcatagtcctttcactaaatttgctactattgtcgcatcgcccgcatacggcacattttttccattaattttttgaaaggcatcatgacccttgccggccacaacaaccagatctccctgtttactttccaaaacggctttttggatagcagacgttctgtcagcaatgtaacttgttttaacgcgtgctggatcaatatgagccgcaatttcatccgcaattactttggggtcttcagttgccgggtcatccgttgtcagataagctacgttggctgattcattaattgcctttcccagcccctcacgacggtcaattcccttgtctcctgtacttcccgtaataacaatcacgtttccgtccggcgactgctttttaagaaaatccagaactgaatgcaaactgccatagttatgcgcataatcaacataaattgtgccatgttgctttgttgaataaatttccattcgacccggaaccgtcgtatgagacaatccatattcaatctctgttggatgcgctcccatcatagcacttgtaatagctgcagaaacggcattaccctcgttgtaatcaccagcaatgctgatttcataagtaccatctattccaagtcgttttgctttatcactaacagaaataagttgaattttattctcacttaatgaatcagcaagcgactgatattcaaaatctttaggcaattgttcgttcattgtcgaccctttacgatgatacacaaaaatatcttcgggctgactggtagcttttgcagtatagtaaacgtccaccatatgatcactatcagcattgatgacacacttttttgaattaaccaacaattgttccttacaatgtaaatagtcggcaaacgtcggatgttcatttcgaccaatatggtctggtgagatattcaagaaaacgccgacattataatgaaggttgtaaacccgctgctttttatatgcctgtgaagaaacctccataatcaaatgagtcatgttgttctgaactgctttattcatgtttgtaaacaaatctaaagactccggcgttgtcaaactggatttaatcacatcttcagacttatttccaacaaccgtattaattgtggaaaacaatgccacttttcgatcataaaccttatccagtatcgatttggtaaagtaggcagatgtcgtcttaccttttgttccagtgtatgcaatcgttggtaagttattctgcggaaacccaaaaaatgccgcacttagcagcgacattgatttttggatatttttaacgatgattcctggaatagtgacattatgatattgcttttctgaaacgtatccactggcaccacgttgctgggcgtctgccaaatacgcttctcgaaagtttcccttacaaaaaaacaaacaattatcagaaacaactttagaattgtaggcaactgattggaaactttggtccaagcgactaaattgactcttgactagtaaatcatgttccttaagaagcattaacacttcatcaacagtaatttgtgccaatttatgcaccttccattctaatcaaattctaaatcttggtacggtgaaccaatttaactgtgtcttcagtggtatcttcagggaagtaaatttgataccacaagataaacgtatagatcgtaaaaatcttttgcatattggacttaccctcggcatgttgcttaagtaggaaatccaactgatcaacgttaaagaactttttggctgtatctgaatggaattcatgaacaatccgttcatgatatttcggatcattaatccaactggcaattggtgaagggaaacctaatttttcctttaaagcagtctttttaggcatctctcgctcagcagccgttctcaacgcaatcttagtctcttcaggtgtaattcgagtcttaaccggcattgtagaagcaaactcagcaacctttttatcaaccaaaggtactcgaacctctaatgaattacacatactcattcgatcagctttgtgtaaaatgtcgtatggcaaccaggtattaatatcaaagtactgcatctgtgtcatctcatccttaccagcgacatcatcaaaaatgtgcttggtataagaaccggaatcaacattaattgaaggatctttaagcactttgctgcgatcatcataattaaagacgtaattaacccggtagtatcgttcgctcaagggctgtgcccctctaaccaagaaacgtttaccatggaaacgaggcaatttacgggcaacagcagccagtccttttctaaccggtttcggtacatatttttgataacggtcaaaaggaatcgattccaaatacgtattgtagccaccaaagaactcatcggcgccttcacctgacaatgcaactttaacgtgtttagaagtctcttttgacaaataataaagttgaattgctgctggattagacagtggctcatccatgtaatacatcatggttggcaggaaattaaagtaatcatcgccatccatgtaaatcggggtgttcttttgtttaattgtcttggcaaattctgtcgaccatgccaattcactatatttagaatgatggaacccaattgaaaacgattgaattggcttaagctttgctgcttcatttaatacataacttgaatcaataccgcttgataagaagctaccgacttcaacatccgcaatcatgtgggccttaaccgaatcatcaacaatcttttgaattttatcagcatcgccttcaattgtttgactgttatcaatatgatcataattgaatttatagtaacgatgtgtttcggtcttgccatctttatgaaggaaatattgaccggggagcaatttataaacgttcttaaacatcgtttctcttgaaggaataaactcaaagctcaaatggattggcaagaggcgtaaattgagttcctttttaaaattcggatgctcgagaaaagcttttatttcagatccccaaaggaatgtgtctccatcgtcatagtaataaaggggtttaatgccaaaatgatctcttgcaccaaatacttcattattttttttatcataaataacgaacgcgaacattcctcttaatttatcaagaagtgctggtccccattcttcatacccataaactaaaacttcagaatcaacatcggtcttgaattcgtatccaagatcacgaagttcttctcgaatttctttgtaattgtatatttcaccattaaaagttagtacctttgtctggtcagcattgaacatcggctgacggccgtgggctaaatcaatgatggaaagtcgtcgaaatcccattgatacgttttcgtctgcaaaataagcctcgtcatccggaccacgatgcttaattctgtctgccatgtcattaattgtaccttcaggaacatctttttggttaacataaccaacaaatccacacataatcaattccccttttgttgtaaatctaactttgttagccttaaataccgaacataacggtttttattttatcagataacggccacagctaccagtagtataatgttttcttaaaaaaccggcgtcacaatgcaaacaaaccggctttgaatttcattttaccaccaatataagttatactggttttaagagtatgaaaaagcattgaagggagcggtacctatggatgaaatagtattctttaacccgggggactcaattggtaattttcatgaccataatgaagctgtgaaaactgcacaaatttataaacaaaaacaagaagctgacaaaaaagtgttggttgttcatggaacgaacaatcaatcatttgatattttccttgctgatgacgcgataacgcacagtaatgaaaccagtacagattccaaatcaaatgaaaaaccgtatcgtgtttctgataaactttaatcattcgtttaaaatccttttgtttttaaataaagagcatctatcaaacatttttcattcaaatgtttgatagatgctctttatttaaaacattcaataatccgctcttaaatgaaccgcattgtcaatctgactagtctttagtgttaacaaccaatactttggtcgttgcatttctgacaacataagcagtcgttgaaccaattagtaatcgatttaaagcgtccaccccagacttaccaatcacaatcaagtctatcccatgttgatcgggataaatatgcgcaataatgtttttgggattaccaatatctgccgatgtttcatatgagactccctgctcatcaacatattttttagcatcgtttaatatcttatcagccatcttcttctggtcatcatacatgctgggtggcatccccgccgcacctgcaccataataaaagtttgtattattaataactgttaacaaactcagctttgaatcaaacttttttgccaaactaattgcttcttcgagtgcctgcttcgagttacgactaccatcaagtggtacaagaatgtgttcatacatcgtgtctcatcctttctgtgtaagcgtaatcaacgtctctacaattattataatgctgtttttattaaataaaagcaattagtagggcttaaattatacaattaatcacaatagaaggtgattacaacgattcttcatttttctagaaaaatggcattgttaatcattaagaagtctttaaatatgactaaagaattaaaaataaatacaataacatgatattctagcaaacaattgtcgctaaagtgagacatcaatatttagaaaaacttttttaaatggcaatagattattagttaaaagcaatttacgaaggaggagaatacaacatgcgtttcgatacttcaaaatatccagaaggggaaaaagcccttaatcccaatcatgtcaaaaagatcaaactattaggcaaaatagcaaccttcacctgcatttcgatgtatgtttcttatatcccagaaatcatagctaacttttctggtcatccggtttctccgattcagccgcttgtagccatggtaaatgccattttatgggtcggatatggttggtttaaaacttataaagattggccagtcattatatctaacgtccccggcgtcattttcggaatgataacagtactgacagtttacattcattgataagcatgatggagtggttgtgacaaacctaaattttgtccaaccgctctttttatgttttctagtgttaattaaaaaaggaatctcgctaaacgttggtttaacgggatcctcttttaaaaaaatcttcaatacgttatcaatatgccccaagcaggattcgaacctgtacttgattactcaaacagcgacctgaacgctgcgcgtctgccagttccgccattggggcaacaaaacaacatatcttattttacactaaaagttgtaacttgaaaagatattttgacgttttgatcgaaataccaaaaatcggcttgcattaggatctctcttcatcaaaagatatccaataactgccattaacagtgccccaactacatcggaaatcaaatcagtcattgtatccataagtgctgctctaccaatcagcatccgacctgcagcttcataccgctggagattcaatccggcaaggccatctgctgtaaactcataaaattcccaaaagacaccacatgtaacgccaaatgtaaatgaaaacagactcatcaaaaatggcatatcccaggcattcctttttgatcgagaaataccctgaaaaatagcatatcctaaaccagccagcataattgcagataagatatgttcatatttgtcccaatattgaacaccatagaattgcaaacccgaccctagaaagatagacatgtataggaaaatgtaaaagaaaattaattccacttgtggaaaataaaaatggccaacccattcaatgaagaagggtaacattgcaattataatgccaatgccaacctcaattagcagcagtgattggtttgaaaactttggctgacctttaaaaagccagtacccataataacctaaatatccaatcatagaaataacgctaataacacaaagccatgtgctgaatctaattttgctcatttgcattatgtaaaaatcccccttgaccaagttagataatcgactacaatttaatcgttgttaaaataaatgccttgcttttaaaacaaaataatttacaatgttattatacactacgtgaacggagttgaaccaaatgccagaaacacaaccaatcagacttgacacccagttatgttttcagatctatactgccaataaaaaattcaataagttttaccaagacgccttaaaacctttcaacttaacctacccacagtacattgctttgttaaccctttgggaaaacgcaccaatgtccgttaagaagatcggtaaacatcttcatctggatagtggcactttaacacctttgttaaaacgacttgaaagtcatggatggatcactcggactagaagccctcaagatgaaagaacggttattattcaattaaccgataaggcactggagcaacgagatactgtctatgatcgtgttaacagttgtcaagatttactgcaactgtccaatgaacaaattgaagattgtacaactgccctaacaatgctggatgaacatcttgattcatacaacaatgcagacaaataattaagtttaatatttttaccaataaaaacgtttcgaatcggttcattcctactactagcagggactgccattcgaagcgttttttagttattttgctatttacaaacaatgcctaatgtatataccatcccactggtccaggatttaaattgatattaatttgttttgtttcttgatactctagaagaccatcttcacccagttcacgcccaataccactcattttatagccaccccaaggagcttcgttaaatgttgggttgtaacaatttatccatgtaatgcctgcacggatttccttaatcactcgaagtgccttggcaccatcttttgtgaaaacggctcctgcaagtccatattgcgtatcatttgctaatttaatggcttcttgttcgtttcgaaaagtctgaattgtcacgactgggccaaaaatttcttctttaacaatcttcatacttgaagtgcaatcgtcaaaaatagtcggcgcaataaagttcccaagatcatagggtgtattggttagttgataaccgccacaaaccaatttagcgccttcatcctttccaatttgaatatattccaaaacccgcctcatttgatgcctggaaacaagcggacccatgtcgggattatcaagcccattaccgatcgttagcgcctcagcacgttcttttagttttaaaacaaatttatttttcaagctttcttcaataataattcttgatcccgctgaacaaatctcgccttgatttaaaaagatacccaacatcgcccattcaattgcgccttcaaaatcagcatcactaaaaataatgttaggagacttaccaccaagttccaaaccaatctttttaacgttatcagcggctgatcgcatgattgaccgtccaacagttgtactacctgtaaacgtgatcatgtcaacatcttgactacgtgccagttcagcaccaactctttcaccagtgccaatcaccaaatttgcagtgcctgcaggaagaccaacttcgtcgaaaatgtcaaataatctaacagtagaaagaggtgttatttcgcttggcttgaaaacgacactgtttcctgccgctaaagctggtgccaacttccaaacacccattaacaagggataattccagggaacaatctgggcacaaacgccaaccggttcatgaaccatatatgaatgcattttaccaaaaccgtcattcacaccataactaccaccacttggcgccttaattaagcctgcgtaatacaagaaacaatgataggcatcgtccacatccccttgtgcttctcttagaggcttcccattatcaatggtatccaaatatgccaactcttcgcgattctcattaaccttctcagcaattttatatatcatatcagcccgggcttgtgtatctgaatcacgccattcacgtgtttgataaaaagatttctttgccgctgcaatcgcttctcgggcatcactaacgctactctcagcaacttcgccaataagatcaccggttgccggattatatacttgccttctatcaccaaaatgagctggttgccaacgtccatcgatgtaattacccttaaattccgtcttcgttgcaaaattttgcatccatatcagcctactttccaaatgattaattatgacactgataaaaatagccaattgacgttagataatctaacattaattggcttttatgctatcatttttcaaaattgttaacaagtcatttctcaaaaagtttttgtgccgcttaaaagggaatgaaaaataaaggtgtaaagaaaaagcaaactagcgactaataaaatcagcacctaatttcccaacgtcattaaacaaccggattgtgttcattctacttcttgagccaaatgttaataacgcaatggaaatcaacttattgccatatacaaattctgctacatcatgatcaatctgataaccttcaccggttttattataaacttgaatgccattacctgtctcatcaaaatcaccgggtagcttatatcggaattgttgattcaaaaaccaggtctttgtcattggatgattagtaatggccatttctaacagcctttgactttcggcaggtgttgtatagttgtctttcccactttccaaagcacttgtatccatcaaatacctattaagacgggttttataaaatcccattttagacaagtattgattaacatgctccattccaatatgggcaataaccaaattagtagctgaattatcagaaacactgatcatcaaagccagaagatctttcaattggaatgttctttcggaaagaagctgtaaaacaccggccccgccaactaatttatccctccgtacatgaatttctttatccaaatcaaaatgactatccaatacatcatttaagatagccagtttaatcaaagaagccgaccgaaatgctttatttgcattaacggccagcctttgctcatgattaactttgataatcaaaccagtcgtttcaggagcttttgagactaaattttgaattagctgaaactcatctttactcatcgccaatatctccgaaagcctgcaaattcagaagcaaatttgggctcagttaagcttgcaatatcaatcgtttttccaggtgtccgtgattcaatcattttaccttcacctatatacatgcccacatgatggacatagccacgcccatgatcatagccgaagaataccaggtctcccggtaaaatagcttctggtgcaaccggcattccgccctcacgttgatcatcagcatctcttggaatatcaaatcctaagacccgatgcatactataaaccagtcccgagcaatcaaatccgtaagaactgatgccgccccaaagataacgcatgccgagaaattggcgagccatttcaaccattgtttcaccggaattttgacccgcaacaggtaaaattgatgcttgtttatcaaggtacgccttgcctaaaggtgttgcaacttcaagataattaccatcgatgcctatttcaggtaaaattgtccctaaactaatttctatcaacggctttttatttgcatcatacaattgtgcagtcttgacagcaactcgaactgtcgacgtaactggcggataggtaatttgctggtcactcaacagctttgttggtacccatccaggatatcctcttgaatccgagtcatccttctgattgctgacaaagacttttgcccaatcgccatcaaaatgatcaataatcaattcatcattaaacaatgcctgggtctccaaaaggtcatcgtcactgagctttacagattgctcattactcatttgagcaacccatttcttaccatcaccatttaaggccggttcatcgaccggacgcggtgcactttttgacttccagatagttgccacaggtactttaacacgtcttgtttccaccgtgacacccccattcgttttttattatgataccacgaatttgactttcaataaataagttcgacttcctggaccaattgagcctgttttatccaaatagataatcataagcaaattaaaaaattggatcaaaaataatttcgacccaacttcccataaaaaaatcaattatttatccgtatagaaacacgcgagtacagctaaatcattcaatagttacattaaatgaacaactttaccctttatattttgatataaattgattcaaaattttttgccgttaaaaaccaattattttgacagttgtgcaaatccaagtccagcaaaatgcggcaagaaaatttgattagctttattggatataccacccttaacgggattgctggaaaacatcattgacgcatcaagatccacgtatttcacattttcttttgcagcggctaaatgtgcagcagccgttaccgaaacagatgactcgatcatactaccaaccatgcagggtataccggctgtctcggcaagcgtattgatcttcaaggcattatcgatgccaccagccttcattaactttaaattaatcaaatcgcagccgttcattgaaatcaagcgttgtgcatcctgaacggaaaaaatactttcatctgccatgattaatgtttgcgtattctgagtgacgtaagccatcccttcaaaatccgtagcagcaaccggctgttccaccaactgaatatccaagcccagcttcgccatttgattaattgccgatacagcctgtttatgatgccatccttgattcgcatccaaccgaatattgatcgatggaccaaccgcttttcgaatggccgcaactttttcaacatctgaagattccgagtcactgccaaccttaatttttaaagttgaaaaaccggcattcattaattctttagcttgcgcaatcattttgtcggttgtcccgacactgactgtgtaatcggtttgaattctgtcggtatgtcctcccaacagttgatacaaaggaacctgatagtgctgggcaattaaatcattaaccgcaatgtttaatgcagcctttggacttgagttatgaaccattgattggtcaattgtggccttaatatcttcggaatttactaaagattttccaattagttttggtccaatgatttcattaactgcttctttaatactcgacacactatcaccagtgataacaggtgtcggtgcagcctctcctaagcctatcaggccgctactgtcttccacctttacaatgagtgtccgagcagttgtaaccgtccttagagcggttacaaacggtctttttagaggaactgccgcctcactgatctcaatttttttaatgaccggtgccacgaatagctgcctccttacttgatataagcattcttaaaattatagtttgcgccggccgtattgtaaacgacatcctttacgcttgatttgatcatccatttttcaccagactgataaagtgggattatagcttgatcattcaatgcaaggttttgggccttgaccatatcatcccaacgggcttgcgcattaccaccatcatcattattacttgcatcgattaatttatcatattgcgcactcttccagcgcgaaatattgcttggattagtcgacgttaaaatattcaggaacgtaattggatccgaaaaatccgcaaaccaattagcaaccgtagcttggaattgatgatccgcttgtcgtgataggatgacacgtcccggaatattatttaatgtcacatgaagtcccggcaatttttcaagtgcactttgtaaatactcacttaattgtttttgatcataagtatcagagtttaacaacgtaaagtgaagtgacttgagacctacctcctgcaaaccttgtttaaagagttgcttggctttggttggattatatttcatagaagccggagcagtgacgtctttcgtaaaatcagtcccatctttcggtgatactgccagtcccttagacacgaagctatcattactgatggcaccacctgcaacaactttatcagctaacattggtcgattaataatcattgacatggcctgacgaattttcaggttcttgaaagctttaattttttgattaaaagcaatgtaataattagaagattgctgacgtgaaacaaggtcctttttattattcatttgcttagattgggttgcggacaactgagccatatccagcttaccttcgttaaacaagttcaatccggttgatggatccttaacaacgctgaacttcacattatcaagtttgacgtttttcttatcccaataatgattgtttttctttagtgtccaacttaggtttgttcctgtccatttagttaaggtaaacggaccattgtaaacctgtgtcttggatgaagtcccgtatttatttccatatttattaaccgttttcgaatcttgtgggaaaaagactggaaagcccattaacaatttaaagtatggaattcgttgctccaatgtcaccgtcagcttatattttccgttagctttaatgccaagtgacgaaacggcagcttttttatcttgaattttatccgcgttcttaatgcccgaaaatagatagccatactgcgaagccgtcttagggttaagcgttcttcgccacgaataaacaaagtcttgggcagtgacaggatcaccgttactccacttagcatttttccgaagattaaacgtatacgtcttaccatcctttgaaaccgtagaggacgttgcaattccaggttcgaccttactgtctttacccaaacggaataacccttcatcaacgttattcaaaacgttgaaagtcccaacagccgttgttttggaaggatcaaccgttgtcaattcagaatcagtagacgttgtaatcgtcttcttttgttgactggaattttgaccacatccaacaagaatcagtgaaatgccagcgacactcgctaacaccgatatgttacgagatatatgcattataaatcactcctcaaaatatgtgagattcttaacgaacctaacttaaagtctaatttagcataaatattataaaaaaacaggcttttttaatgaatttttcatcaagcctggttttgttacatatttatttagttagtgaaaccgccatcttacgggaatagtagattgtctcaaatttttctttggccatccaatattttccatcaatcggatcactcacatgaacccgattttgatcaaaaccatctaaaatgaccgcgtgattattcacaggtaccagcccaaaaggatatttttcccattttggctgttcgaaatggaccgttacgtatgttaaaacaggatggcccttttgaacctcgtcaaataaccaactggaatcagcgccgcttaaatccctaagtctcccatattttcgaccccattcaatcaaaggacgggtaaagatcgcttcaaactttccagactggtttttaaagggagagccgccaaaaccatgataaggattgccatcctgactgattggcatatccaataaaaatttgccataactaacttccacggcttcacgattaaaatgaaacccttctaacaagctggccgcttcacaaccgttaattgcgccccacgatagttggctgatgttttctactccaagtaaaacgcgctgagtcattttgccacccctaattgtttgaacatcatatcaagcatttctgtaaatcgaggctggctttcttctagtttttttgctgcatcaatcaagcttaggcgcaagcgtccctttcggtctacaacagattttgcatgtaccaaggaacttaaaacggactcatcgacagcagccgccgttgccctgaaaaataagtcaattttattatcattaaaccgaatcactttatcaaactggttctcagaaaaatgttcaaccaaattggtcgtcgaaaaagcaaaaacaatttcaccgctaccgtttccaataaaaccacctgttctgttaataccgacagttgcccgtttggccatccgctttagttgacgtgaatttagtggtgcatctgttgcaagaatggtaataatcgatcccttttcttctttttctttatcggccgcaagcatctgtgcaagtggttgtcctactggggcgccattcacaacgaaatcagttaaataaccatagtttgtcatcaccaaagcgccaaccgtatattgatgttggtcatcaattttaacaattcttgaagatgaccctatgccacctttcaagtcataacacatcataccccggcctgcgccaacggccccctcctcaaattgatcggctgccgcgtccaacgcactatacacatcatcttcactcaaatacatttttcgaatatttgatacatcaccatcattgcattctgccacaaccggattcaccgtactagtagtatcaccgatttcaatattttgagtcagcatccgctttgttaaagcgttaattgcagttccaacgccaaatgtgtttgtcaatacaatcggtgtttcaattgtgcccagttcatcaatttgaaccaaaccaacacttttgccaaaaccgttaatcacatatgacgccgccggaactttacttcgaaacacattacctgtatgtggcaatatggcggtaactccagtgtggacatcaccatcattaatggtaatctgacccacttttacaccggaaacatccgttattaaattaagttttcccttgattccttgcgatacatcatttaaaagcggcacttgaagtcccatcttagttgcctcccattagctcaacgactatttaatacaatttgcgccagcatcatgcccatcgcaatcaaattatttaaaaaatgtaacccgattggcacttttatgttcttagttctaacgtacaaatacgctaaggtgccgcctaatattgcgtatgtcaagaaactgatcacattgaaatcttccatatgtggaaaggcaaataagacaccactgacaatcactgcagcaacccgggtatttgttgtaaacattgaaccgattaaaaaaccgcgaaatactaattcctccagaatcggtgaacaaaagacagccgtgaaccccatcaaaattaatgtcagatggttcgtattcatatattgataaataatcttgttattagctgttgaactttgatgataaattgcctgatttaatagccctaagccgatttgtacaacaaagaaggacacgtaagcaataaagatcatcgaaatatctcgacttgttaatgacattttttgaggatgcgcatattttcgataaaaatatccagcaactgcaattgcaaggatgaaccctaatatatatatcactgcaatgatattgttaaccagttgtgaaaaatgccccatcatgataaatgatagtgggaattgcacgaatatcacaataatcactaatccaacaaagataccgatacgttcaaaataatctcctgcttttaatcttttattatcgtccatttaatcctcccagatttttatgaattaaatagtttatctaatttactgaaatcagctgttcccaaacccgttgcctggttatatcgtttaccgggctgacctgtataatacaagtttgtgttatttgtccgactatccaacactgtaaaaggagagttggattgagacgcaaagcgataaatttgagggttccaaaagccaagtctaccagccgaattatttgacattaaaacgcttgcggctgcgatttgtggcgctacgacactggtaccacctgatatttcccattcacctgtcgcggaagaatcctttttaggcgtaataaagatagagtaacccgtatttggatcggcatttgctgacaaatcaggtacattgcgcccctggctcttaccacttatattaacaggcgtatcgagcagttttgctttaccatttttaaaagaccacagtctagtcgcatcataggtaccgataccactgaaccctgattgatatttaggcactgcgttatacttactaaacccgccacctcctcctgcaaagaaggtttctacccaatcttcaaaccccaaaaatttttgacttttataattaggatatagaaactcagacgcccaagcgcgttctttttcaatctttaccgtctgcttattaactgtatacgtccgaggcaacgttgtcccaccgacggcggtaacatacggcgaattggcgggtgtatcgacgctaagagatgtattaccgccggaaatcccatcatacgcaccattatcaccactagccgcaaaaacactaatgccttgggcggcagcctgctcaaacagcaggttcataatttgattatattttgcaggggtaactccctgcttaatttcataagcaacttgagcttcactttgcccccagctgagggataaaacgtcaacaacattttgtccaacggcggcagcaagtgaattcaccattcctgtgatatccgatttacctatgtatgttcgaatattactatctggtgcaattgcccctgcctgttcaacgtcaatcgttgtttcgttatacccgttccatgaccccttatagccattagtccgataattacttagccggcttgatttgacatcaatccccatgccgttccaataccgataagcatcacttggatgatagttggcaaacgaaataatgccaatcgtcttgctccgaccggttgacccattgttataaagctgcgaaataccataacgattaacgaattttgaaggagaataatgttttgcaatttctccctggctaagagtcgttgcagccctattgtataaagacgacggccgaaattcccgtgaactctttgaaactgtcgaataacttgacaatcccataatcgcaagtactgatttggaaactgatttcggtacagtcggctttttagttgctttttgatatctgatcttgtttttggataccatcacaagtttcactttaaaagctttttgaacatttctggtcgatcccttaacagccattaccagattccctcggtatacttcagtcctcaaatgatatttttttaagtattgacgaagtttttgaatattttttgttgattgtccaaactttgaagcaaattgaccggaactaacgaattttcgataattggtactcgtcggatcaaccgactgatacacaaactggtctaattttttttgacttttaggtttcaatacaatgtcaattaattgttgtttagaaccagaaacatttgttgttgaggattttgctgatacaggagtcccattagtaacaccaatcagtatggtaaaggccaacacaaaagtaaccatggctattaattttttcagcgtttgtttttgcatctgtttctccttgattcagacagttttaattaatctttggaaatattgcctgattgttgtttggcagcttcttcttcggctgcttttctttgatccctcgcacgaacaatcgaaataactaaaggtgtaatgaccacatgcattgcaataattgcaccgacccatatcatgacaaattcaagcgacgaccatgtcataccgcgggtcaaataaaaagcccctgctatgattaagacaataaacactaaaataatgctaatactttttttcatgttcaaattaaacatcctcatttattaaattgaccgtttccgtagccgtagtttgtacacgtgttcttggtcaagtataattgatgtaaatacaataacacaagcttaacctggaggtgaaggaattgttgaaagaatttaaagcgtttatttctcgtggaaacgttattgacttagctgttggtgtcattattggcggtgcttttactgctattgtgacgtcactgacaaccaatttaatcaatccatttatcggcctattcttgggccaaatcgatctatccaatctaatggttaaagttggaggggctactttcaaatatggtgcctttattaattcgattatcaactttttaatcattgcttttgttgtcttcgtaatcatcaaagtcatcaaccgagttattaaaaaagaaccagctaaagttgttcctgacaagaaagagcttcttcttgaagaaattagagacctactaaagaatgaaaatcgagagattaaataaaagcttagaggcttccatgtgcaggattgagcaaatccgcaaatgactttgaaacgccaatttattgcgcttcaagccccattgttctagaattaagttattagaaaagctttatactgtcaaaaattcgagaagaggttttgttatgagaacgtttgctattagggcccgtgacggggtcatggaattaaattattctgaggattccaacaagccgcccttcagaaagttcatgatcacatacaaccccaaattttcaattggagataatcttgagaacattaaagtggcgttaaccggattaccggttgacgctgcaatcattgaaaattcacttaattatgaattttcagacacaattattggtatcaatcatcaaaaaattgatattggtttagcaattgctaacatgatgaatgttccggttgtgaatctgaataaagttaaggaagttggtttgcagaaagccgtttccgacaagtccaattacttaaagtggcatttggactattatggtgaatatagcggtaagcgtaactacggtcaagaagccatgctgactattggaaacggctattttggcttgcgcggcgcttatgtcgaagcaaatgcagatcaagacaattatccgggtatgtacgttgccggcgtttataaccagctcacaaccaagattaacgatcgtgatgttgtcaatgaagacctagtcaacctgcccaactcgcaatttatcagttttggtgttgaccatcaacaaccgtttaaaatcaaaaaagaagatatccaagacatctaccggagtttaaacttaaaaaccggtgtcctgacgacaacacttcatattcagttatctactgggcatatcctggaagttcgggcaacaaaagttgcaaatatgactaactggcatcgatatgcaatcaaatatgaattaaaacctatcaacttttcaggaagcctacaaatatattcggaaattgacggcagcgtgcttaatggtaatgttgaaagatattccgactttaatcaacatcacttggacattatcggcatgtctgctcatgacaaccaaatttcaatgagtggccagacaaagacttcaaaagttgcctttgtcatcaattccaaacttgacagtcaagattttgacaccaccagttcaatcaacacagatactgaaaatcaattaattcggcaaaccttaagtttggacgttgaaccagaaaaaagttacgaatttgaaaagtgtgtttcaatttttactggtaacgccgatgatgataagcttgaaagtgctgctcaaagtgaattaaacgactcatcttttaacgacacacttaacgatagtcaaaaattctggaaagacgtttggaataaatccgatatcaagatcactaatgatattaccagtcaaaaattgacccgggttaatatttatcacatgttggtcacaagtgcagcgcttgcttcaggtaaattagatgcctcagttggcgcccgtggtcttcacggagaggcctatcgtggccatattttttgggatgtcacatttgatttaccgttttacgcaatccactacccggccatcgcaaaacagtgtatgctttatcgttacaatagaattgacgaagcaagaaaatatgcaaaatcagagggtaaagatggtgccatgtatccttggcagtcaggaatgtatggggatgaacaatcccaatttgttcatttaaatccagttagcggtgaatgggatccggacaacagcagattgcaacgtcatgtttcgatctctgttgcttatgatgttcttaaatacgttcaaattaccggtgatcgtgatttcatggaaaaatatggtttggagatgctcctctcaatttgtaaattctgggtaagcatggtttcttatgacaaagacgccgatcgctacgatattcataatgtcatgggaccggatgaatttcatgaagaatatccaaacgctgacgaacaaggtctaaccaacaatgcgtatacgaatattatggtttcatggttatttgataaagttgcaactgttgtgtcaaaacaaaaggcagacgttttaaaagttgccaataataaatcaggaacagacagtaatttattaacccagatgtccgacatcgctcacaaattacgattagacatcaacgatgagggcatcattggtcaattttccggttacttcaatctttccaaactaaactttgattcgtatcgtaaaaggtatggcgatatttcacgaattgaccgtttgctaaagggtgaaggaaagtcaccggattcttaccaggtcgccaaacaggcggatacattaatggcttattatgaattaccattttctgaagttgaagatgttattaatcgcttgggctataagcttcccgctaactatttcacaagtaacctaaggttttacctggacagaactacccatggatcaacgctctcaagaatcgtttactccgtattggatgaaatggacggtaatatggatcaatcgtggcagctgttttcaacggcattattttcagattactacgacattcaaggcggtacaactgccgagggcattcaccttggcgtaatgggagcgacacttcaaattgaaaccggatgttacggtggcgttcgctttgataccgatgaagtttcagttaatccccacttaccacaaaattggaagaagatctcgtttaagcaagcctaccaaggaattaagtatcaatttgaaattacacatcacgaaatcactgttacggctgatgcggaaactcacattaaagtcgcagaaaaagattattccctaacaaaaaacaaagcaacaacaatttcttataaatagttttgaggagtgaattttaatggcaaaattttctgatattaaaggatttgtatttgatttagatggtgttatcacagatacatcagtctttcatagtcaagcttggcatcaagttgctgataaagtcggtgccccatggtcaaaagaactggaagatggccttaaaggaatcagtcgaatggattcgttggaaatgattttaaaggctggtaacttgtctgatcagtatacagaagatcaaaaagttgctttggcaaccgaaaaaaatacaaactacttgaagttggttgatcagatgacgcccgacaacattcttccaggtatcaaaggctttttagatgatatccaaagccatggttatctcttatcactagcttctgcttccaaaaatgctccaaaagttctcgaaaaattacagttaacaacttacttccctaaaatcgttgaccctaaaaccttgtcaaaaggtaaacccgatcctgaaatttatctaaagggtgcagaattaattaatttgaagcctgagcaatgcatcggtgttgaagatgctgctgcgggtgttgaatcaattaacgctgccggagaaacctcaattggtatcggcgataagcagattctaaaagatgccgacatcaattttgaagatacaggtgaaatgactttaaccaatattcaaaaacaaatggcatagttaacaactattttaaatcacctatcataattgtttgatgtaaaaaagataaggactgagacaaaagtaattttgtccagtcctttttaatttcatcacgactattaccgatattaccgagaaaaaacgggcaaaaagggcaacttcctgctatgcaatcggaagttaaccgccttttggcctactctctattttccgtatgaaccaatctatagaaggaaacaaaaactaatcatttctatacgttactgaaacttgaaagtatgaagacagactgatcccttggtatcacagggcatattttaattaatttaaccatttagcttgctgttaacagcgaaactaaccgtttcggcaaaaatgtgagaactgattcatcatctgaatatttgggctcttcttgctaaacttctgattaataatatcgtttttataatacgaatttaaagccatatccagtgcttgagaccactcatactggcatggctcgtccattctaaagaataaaccccaatggtgcgatcatccatcgattttgtttttgtgttgcccgttcctgccaaagctataaggtccataagtcatcagacaattgctaatgccacaaatcccgtcatattttgaacttgtgtatttggccggagccgcaatatttcgcttggcaacttgaaagtaattcctcaatttggccatctttcgggcgtatagttaatcatctctgtgtgctgaaggcctaactgatcgttgcccattactaggtagtcatcttgacggtctccgattagccacaaatacaagcgaacttgaatttttggttccgacgttgcgctttcgaacaaagcagctgtattgataagcttgcttgggtttgatatttttgaggcctcagtcgcttgtatatatgctttaattactgaaatgttgcgtcctgcgatatgatagtcaaattttgctgggacaaaacctttaagcatccacacggcgccgtttaataaataccccaacttgggttaattcatgagacattttttggtgagctgtacgcgctatcaatgaacactagtcatcatagaacgccatttgcgtatgggcttgctgacaagttgtcaatgaaacaggtttcattattttgcgtgttgcttggcgacgttctccggcgcacattgttcgttgattcggttcgttttagctgattttccaagtgacgttttgtggctcttggaagacattcaattgtcaagttgatcggtaagatttttgcgtcactccacccaaagttacagcccggtatccttaatatatactgtttgtcatgggtcaaagactcgcgctagtagtatcggtttggtggcgtactcaggcaaaagagtgtatcgtcaatgatcattctaaccaaccgcggcgggtccaataacggtcgtaaatgcttgattaaatgactccactgacacatcagcgttggccaattgaatccggccatcgtcaaattatttctgacggcgcgacggtaacgttaggtgtttcaatgggctcgataaagcgcgagcgtcccaggaactttggtcgtgaaggcagccattcatgacccttctcaagccaagatttctgaatgcggcgataatttcacccacttggtgagtttagatagaccaatggagggaattaattgattgaagcactattgtgaagcgcgtgttcgtatttttttttgtcgtataatattcatgactagtctcctttgtaatctatgggttttggtcgactaaagtatacaacgcaggagagcttgcgtttatttttttgccaaaaaagccaataaccacacgcctttggcgtgattattagctttcaagtttcagtacgttatttaatcaacccataatgtcttaggccattcacgataccgtggttaatattagacgtggtcacaaacgaggcctttgccttaacatctggatgaccatttcccattgcaaccggataatcaacttcttcaaacatttgaagatcatttaattgatccccaaaagcatatgacggaatatccgccaaattagctttcgataacatcgcctgaatcccggtttgtttagaaacaccccacttcattgtatccagacagcgtggattatttcgaaccaaagataatttccctttaaattgatcttggtaaagtttatctttatcataattaaaaacattcaagaaattaacttcatgcgatttataaaacgtcggctcaacgtgaggcgtcaatctcaataatcgataattaaccttggttaaatcgttttcagcagtcaaagcaaatccttcattgttatagaatgaaatgacgtcaccctgctttttagcaaaagccagaatttcttcaataacttcatcactaatttcttcagcttttaatttttttccttcatactgaacataactgccattcgcactaactaaagaattaataccggtctcgtcaatcacatattgaatctcgaaaatgtttcgtccagttgaaatgattggtaaaatattattttcacgtaattcattaactgccgatatgttttctttagaaacgtttttctcattatcaaaaaaagtgccatcgaggtcaaaaaatacaaccgctttatacattaggttccctccattcgattctttaaccttattgtactacttatttaaatcccctcagtgaaaaggagcccgaaaatttccaacttatatatattgtggtgatacaatctgtggtacactatatatcgtaattttattaaaagaggggctatcatggtgataataacagcaggaatgatcggcgttggcaaaacaacgttaacaggaaaaattgcagcacatttaggaacgaaagctttttttgagccagttggtgacaaccctgtcctaccgctctactattcaaacccaaagcagtatggttttctacttcagatttattttttaaataaacgtttctcaatgattaagaaggccctgagtgatgataataacgtcttagaccgttctatttacgaagacgctctctttacccgagaaaataatgcggacggtaatatcagcgatacagagctctcagtttaccttaaacttttggataatatgatgactgaattaaaccagcttcccaagaaggccccagacctattagtttatgcagatagtgattttgataccatcaaataccgtatcaaaaaacggggacgtgattatgaacagttcgataataatccaggcctggaaaattattattacaaaatgtggaaagcctatcaaaaatggtttgatgactattccgttagtcctaaaatcaagatcgatctccaacagcatgatctatcctaccaaaaaaacattgattttgtccttggcatgatcgatgatgagttggcaaaaattcgtcaacctcaaagagaagccatgtaagctttaaattaggctgatcctatgcctgactgatcggataagtcgtcaaatcaatgaacttaatacacaaaacaaacgaggtgagacaaaaatcaatttgtcccacctcgtttttgtaatcacaaccattatctattaaacagcttatcggaattcaactatccctactacccaggtctttgtcttagaatctgatcgaacttacacttattttattctcagcttaatataaccggctgactgccccactggtttttcataccaaagttcccgtttggaaattaaataatcaattcgatggcgataccaccaatccggtacgccacttggcccatccccaatcgcctgaccaatcacctgcaaaatatttgtaaaaactgttggactcacgtgcgaaagaagaaaacgatcgtaaaagttaatcggctgactcattaaatgaccattaatcataattctaagaggcgtattatccttgcgaagatctcgccaaagataactatgcgaaatgcgggcatcccttcccaaagattgttcataatcaaaaagatgatatttatttaaatcatcaatgaccaattctccaagattattaagctcatataaaaagcgagagtgactaaaggttagcggcacatgaacagatgaaatctgattaccgatatccttcaaataatcacacaaccaggcaaagccacaactatcatccggcaaatccgtccaccagatccgaagagatttttgttcaaaaacaactttatccagttcttttaaccccaaaagaatcgactgataccattcatcagtattgtcacgtccttcatgggtatttcgaattttcaataacgttttccgagtttctagcaggttgacttgggcaatatccccgagtcctagtaataacggtaatacaatgacctgtcgatcaatgcgatgagtcatgtaatagcgttttaaagtcctggcaaaactgtcattgaacacaatatcaaccacactaatccctcatttttccaaatttttggtacatcactcgaaaatgacaactctgaaaattataaacgttcccgatacataattgcaaattaaatcgcattaaaaacaacgtgattgctataagaaccgtcttgaattaaatcctaggcaataataacatcaaaaaatcccgcaagaccagcagatgtttgcaacgactgactttacgagacctttattgttttatagatatccaaagctcagacttaacacattaatcatgatcaccttttttgggccgatgcacaataaatacatcgcaaggtgcgtgagcaatgacgaacgcagcggtagatcctagcgtgagccgagtaaaaaagttcacacccgtagcgccaattacgattgcatcaatttttttatcagcgacaatttcagttgccaactcagttttgggatcaccaaaagttacaaacgcttcaacattcgtcaagcctgcatcctttgcctgtttagcatagccattaaccagtttctcaaaattatctttcaggctttcaattgttgaaggatcaatgttgccaaacccaattgaggccgattttgagacaccaataaaatcgcgattattgataactgcgacaataaacagttttgccgaattacgatgtgcgactgcaattgcttttttaaccgcttttacggctgtctttgaaccatcaaccccaacaaggatattatgataattaaattccaacatcgtaagccctccaatcaattactattttgccgtcaattcataaattgattgtccatatattgccattgcttttaataaatcattaatcggttgaaattcgttggcttgatgcattgtatcctgcgtgcctgggaacaatgccccgaaagcaacaccgcgtttcatcatcctagcatacgtaccaccgccaactacttccggttttgcatctgcatcaccggtttgttgcgaatagacacgaagtaacgttttaacaattggatcactcggatcaacgtagtgcggtaccatatggccgacctctttaacccggcctgctagtttatccgctacttttaacagatactgaagaattttggtatcatcagtccccttaggataacgaaagtttgtattaaccaagccgccttttctaaaatcaaatttcataataccaacattcatcgttaagtctcccatgacgtcatcgacgtaatctgccccgatcttatgggcccgtgtatcatcatgtaaatagtccgcaataaacgaaagaaagtttttggcatctttttcgaaattaaactgatttaaaaaggctgccaggtacgtaccagcattaacaccattttccggtgccatagcatgagcctgttttccaatcaagtgaacggcaatcccatcacccgttgctttaatatcaccggataatggattcttatccaaaaaatcggtaaatgcatcgacaaacttttcattatcatcagtttcaactaaagcagtagcgtttccaggcaccatatttagtcgcaaacccgagtcaaattcttttagcgtatactcagaaccattcgagctgccaaaagtcgtttcatacgttgcatttcctttttcaccattgattaatggaaattcagcgtctggtgaaaatccaagtgttggttgaggttcaacatcgaaataatgtttcatcccagtccaatcactttcctcatcggtgccaatgattaaccgaatcttcatgttaggaacaatcccattgtcctttaaaatccgtaaaccatagtaggcagccaaacctggacccttgtcatccgaagtcccacggccataaagattaccatctttttcggtcataacaaatggatcagtttcccagccatcgccagctggcataacatctgcatgcgattgcatcgcaaaagtttcttcaccggcaccatattcaatgtaaccgacaatattatccaaatttttagtaacaaagccatcccgcttaccaaatgataaaaattttaggagtgcttttgtcggaccttctcccaatgggtactcatccgttttatggtcatcatcacgcacacttggaatgctgattagttcccttagatcttgtaaatattgatcacgatactttttagcttgttcttgccaatcgattgtcattaattctcactcctgtcatcttatgtgactattttagcacatataacaggtcttgcaggtcatgagcaatggtatactgggattgaaaagatctttaagaataggagcttttaaatgatgaaagaaatcacaaaaaatattttaacaaaagttattcgcaaacgaccagccgacagttttaagggaacttatggcaagattgctttgattggcggtaaccgaaactttggcggtgcgatcatcatggcctctttggcagccgtttattccggagccggattagtcacgacaataaccgatccgaccaaccaaaccagtttgcatgactggttgcccgaagcaatgtttgttgactataacgactttgaaacggcttcaccaattattaaaggtgcggatgtcatcgtcattgggccgggattgggaacggacaatattgcactatctttattaacaaagacatttgaggtagctcatacaaatcaaacactgattatcgatggttcggctctgactttactcgctcacaatcacctgtcattacctaaatcatccctcaacattctgacccctcatcagatggaatggcagcgggtttccggcattgaaattgcggatcaaaatccaaccgccaaccaaaaaattgcagatcagctcaaggcaattgttgttgttaaatcacatagaaccgaagtctatgcaaatggaaaagtttatcaaaacactggaggaacacctgcacaagctactggtggaatgggcgatacccttgccggcttaattggtgggtttaccgcacaatttgaaaataaaacagctgcaacgttagccgccgtttatacccatagcgcaattgctgataaacttgccaaaaaacaatacgttgtactgccacatcaaattagtgaagcactccctaaatttatgtttaaaaatcaggaaagcaaaaacgatgattaaaggcaatctgccaacttattttatgagtaaaccaaaacggatttggcacattggatcctatctccaatttgtcgaatccgtttttagtgccttttatttaattctcaatagctgcctaaatcgtgcactcctcggtcccaaaaccatatctgcgactctgcttttaaggcagaagtaagcgtaaacgtacccaccgaaagcaacccctatgaccgtcacaacaagactggcaattctgccaaaaggcgttgaaaccaaccctaccaggtaattcgcaccatacacagctgcaagtgtcactacatacatgagcagtgaataaaggccaatttttctaaaagcccaatttaaatttttcctttcgaatccaaattgacgatttaacgacctgataatcagccagttggcaatcgtcagcccgaccgccgttgataataatggaccaaacgcaccaagatagtaaacacaaggccattgaataatgaatttaattaatgttccaactgcaaaaaacttaacagcccgtctattttgggaaagcccctgcataacagccgagatgaccacaaacatccccattggaatcgaaatcatcgatgaaaacgtcaggatatttgctcctaacgcttcctcattaacaccatagaacaaacgattcagtgggccggcaatggcagccatcccaagagccgccggtatcatgacaaacataaataaaaccataatcgttgaattttgcttggcaatttcttttttatcgccatttgtcagcgcaacggataacattggcacagcggtaatagcgagtgcggaagacagcgatatggtaatcataatcaacttatttgaatttacggcaaacattgcgtaaagatccgataacatgtcattggaataatttgtcgccattctcataattttaaaaaaggtaaattggtcaatcaacatgaaaattgtaatgcccgcacctaaaataataaacggaaccgcttgggtaatgatttcatggtaaagtgtcctgggctccacatgtactttattactgctatttgaaaccagagagcgaaatgtatcacgccgactgacataataccagcctaacgtcaacaggcctgcaaccgcaccgataaaagccgcaaaagtcgattgagagactgcggttacccaattaccattgaacactctcataattagaaaagccgttattaacatgtaggcaacccgagccagctgttcaacaaattgtgagattgcagaaggcgccatttgttggtaaccttgaaaatatcccctggttaaactcatcgttgggataattaaaattgcccaggctaaggaatgaaggaccggaacaacattggcgtttccgccatctatcaacggtgcaccaaaataaagtgctgcagcacaaataacaccggtgccgatcgctaataccaagccccgtttatatagttgaacgccaatgccgtactcattcaaagcattataatgcgcaacctgcttcgcaattgccgaaggaataccggcaatcgctgcaatcaggaaaaagctgtatatgttgtaccctaacccatatagtgcatttccccgaaaaaaataatcgccaaaccatattccccacggaataatataaacggcacctaaaaatctgcttaaaatactgccagcggtcatccaagccgatccggacaacatttgttccctggaattatccgagtggctttgattattatcaatcatgattgttcctgctttcgtctgctttactacactcgttatattttaataaagattcagatcaatagcaatctggcgttaacatattaaaaattacttaagcatcggccgatttatggaactgtaatcaaaaagtattgtcattaaggctctaaatgcactaaaatattgctatatgtgttaaaaaatcgtagaggtgaaaagtttgtgagtaaaaagagaatcgaatggattgacgttgctaaagcaatcggtattgttgcggttgtgtttggtcacgccatgacacgccacggtacaatgtttcattttttatattggtggcatatgccgatcttcttcattatggggggatttttcttaaagccgattatcaataataattggtgggggtttttcaaaaaacggattctgccgctattaatttcttatttgatttgtggtggcggtttaatcctactatcccattttgttaggggggagagttggtcatatacaacattttattttgtcagactgctttggggcggccgaacactcaatcactacctgagtgtcttctggtatattaatgtttacttattggctttggtacttacatcgatcgtaattacatacgttaagactcgcgaataccaaattatcattgcctttatttcattaattgtttcaaccagttacaaacacgtctggttctttaaatggaagtacattccatgggattttgatgttgctttcattgcattattcttcatgttatttggatatttgtacttccataaaattcaacaatttgtcaaagatttatggattatgatcccttgtgcgctaattacactttggattttctggatgcagcatatggaccggttcaattttgcactctttctgaaatccaaaattatccatgcgacattccatcatattccaatttcccgtgtttcttacattctgtttattccaattttagtctgcatggtcgtctttagctttagttactacttctgcagattcttcccacagtttattattaaaccggttcaattactcggacaacagacacttggtattatgtatctgcataaagcagtcattgatattattgacgaaatgggatataaaagtgctatcatggaaactattttggcagttattatctcgttcgctttatcattactttacggttatattaaacgaaaagttaagggaacttcaaataaggcggtcagttaaattcaatgatgtttaacaaatggtcaagacataattgcattttgtattgcatcatcgattaaatgaacttgaacaatagtcaatataaaaaagtgatgcatgactttacggcatatgccccaagaagtcatgcatcacttttttatattaacttgttgttattgaccttaactctactttacaacgatattaacaattttatttggaacaacaattactttacgcactgttttaccatccaaataacgtttaacattctcatcatttttcgcagccgactcaactttgtctttagctgcatcacgagcaatctttagatgtgaacgaaccttaccattcacttgaataaccatttgaacggtattctcaaccaattcacttgcgtcataggtcggccacttctcataagtaatagtgccatcatgtcctaataggttccacaattcttcggcaatatgcggtgccaacggcgaaagcatcttaacgaacccttccatatattgaattggaagtgcatctgccttataagcatcgtttacgaaaaccatcatttgtgaaataccaacattaaatcgcatatgggcaaaatcatttgtcacaatcttaacggtttgattataaactttgtcaagatggccgtcattaatcgttgtcactctgtctcgcaagtgattgttatcatcaatcatgagacgccatacccgatccaaccaatgatgggcaccattgataccttcagtactccatggcttggcagcatcaattggacccataaacatttcgtaaactcggagggtatcagcaccgtattcatcgacaatatcatcaggattaatgacattcccctttgatttagacatcttttcgtggttggtacccaaaatcatcccttggttgaccaatttttggaatggttccggtgttgggactacgcccagatcgtacaggaatttgtgccagaatcttgcgtatagcagatgcaaaacggcatgctcagcaccaccaacataaaggtcaacgggtgaccaatacttcaatttctccggatctgcaatggcatgatcattatgtggatcaatataacgtaaccagtaccatgaacttcctgcccattgtggcatcgtattggtttcccgcttacctttgcgcccatttttatcaacaacgttaacccaatctgtcaagttggcaagtgggctttctttcccgccggaagtttgaatgtcctttgcttttggcaatcgaagtggtaattcatcttcgggaaccaaggttgtttcaccatcttcccaatgaataacaggaatcggttcaccccagtatctttgacgactaaagatccagtctcgaagtcgataattaactttctctttgccggcatcatgatccttaagccagtcaattgccgctttaatggcatcttctttgttcatgccgtccataaaccctgaattaaagtgaggaccgtcacctgtataagcagcatcagctacatcgccaccttcaataaccggcacgattggtaagccgaacttcttggcaaactcataatcacggtcatcatgagccggaacggccataattgcacctgtaccatatgattcaagcacataatcaccaatccagattggtacctcttttccgttaataggattgatcccataagcacccgtaaagacaccacttttatctttatttaaatcggttcgttccagatcagatttacgtgaaaccttttccttgtacgcatcaacctctgacttctgatcgggagttgtaatttggtcaaccaattcgtgttcaggagccagcaccatatatgtagcaccaaataaagtatcgggccgggttgtgaaaacttcgatttgatcatcgtcatgaccttttaccttaaagaagacacttgccccacgcgaacgaccaatccaatttctttgttgttctttaatactttcaggccagtctacagtatccagatcatcaattaaacgatcagcgtaagcagtaatctttaatacccactgacgcatcggcacacggtataccggatagccaccacgctctgttttgccatctacaacctcttcattggcgacaaccgtaccacccataaaatccggagcccagttgacttctatgttgtcctcgtaagcaaggcctttcttataaagctgttcaaagatccattgtgtccacttataataggccgggtcagtcgtattaatttcgcgatcccaatcgtatgaaaaaccaagcgagcgaatttgacgtttaaatgttttaatattttgagcagtaaaactacgaggattgtgccccgtcttcagcgcatattgttccgcaggcagtccaaaagcgtcccaccccataggatgaagaacattcttcccctgcatccgcgccatcctggccataatatctgttgccgtatagccttcgggatgtccaacatgtaatccctgtccagacggataaggaaacatatccaaaacgtagtacttatctttactggtatcatccaacgttttaaatgttttatgttctttccagtaatgttgccattttcgctcaattacttcatgattgtatgccatttttacaacttccacctttcaaaattcttcaaattaacgaaaaaatgccctataagaagccatatttaacttcctataggacgattaatcgcggtaccacctatattcttaacgtcgactacggacattaagcacttaatgatcgataacggcgattaaccgacctgacttactgaattcaatcaagcattcgacgatgagttcgtcacaaattaatccgaattctcaacaaccatccggtttctgaaatcaacttgtcattactaattcgtctcttcattttcactaatattgagattattgcctattatcataacaaatcattatgcaaaaaacaatacgtgtgcgtgctataataatggtattccagctaaaaacgaaagtagcgaaagtcatgatcttaaaagtacggaataagtcatttttattaggcgttagtgctttcattgttttcttgatctttatgagcggcgtcttaacccacgctgattggataagtaactttgacagtcaagtgagtcagtttgtaagaagtgatctcacacctaaattaaccttgttaaccattcattttacacaattagccaatgtcataccggtcatttcattcacactcggcatgacgctgatcttgactttaacagaccatttccgggctgcggtctttctagtcatcaacagtctggggctgtctggccctgtcaacatgttagtcaaacactatgtgaatcgcccacgtcctacccttcatcatttagtaaccgttcactccaccagctttccaagcgggcattcgatgagcgctatgatgattggagggagcctcatcattatcgcaaatcacttgttaaaaaagcgaagttaccgagtgatctttgatatcctaattggattacttattttcttcattggtattagtcgaatttacgttggtgttcattttgccagtgatgttgtaggcggttggtcgttaggtctatgcctattattactaagtcaatttgtctttaatcgatttttgggagggacagcatgaaccaattaccaaatgcactgcaatttagtcatcagcttttaaaagaagctgtatcaaccggtgatcaagtgatagacggaactattgggaacggaaacgacacattattgttggccaaattagtaggcgaaaacgggacagtgtatggttttgatattcagcaacaggccttacaacatactattagcttactcaaaaaaaatctttccagtctccaaaatgttcaactatataaaaaaagccatgctgaaattgacaatattttagacgacaacgttagaatttcagccgctatcttcaatttaggttacttgccgggtggcgataaatcaattatcacaaaaagtacatccacattaacagcattaacagcgtgtttaaaaaaattacagataggtggactggttgtgatggtgatttattacggccatccaggtggcaaaaaagaggaaaaatctgttgttaatttttgccagaatttaccacaaaaaaactttgctgtcttgaattacagttttgtgaatcaggcacatgaaccaccatttgttctcgccattcaaaaattaaaataatttcataacgccttattttcagccacttcttcacttgattggaaataaggcgtttttatggcctttgatcctgtacatctgtcttttttcgatcaaaccaattaatggcgtatgcggttaaaatcaatattaatcctacaacgaaaacgttgtgaagcgaactatataaaatcatccttaattttggtaggatcgcgccggacagttcattagcggtttgcggattaatgagcttatccatcatttttagcgttgcaccatctgtttgacggacacctcgaagcattgtcatattcatcacaattccaaaaacagaaatcattaacgtctgcccaagcgtccggcaaagcgtattaaaagaagttgcaactccgatttcagtcggtttaacaacgttttggacactgataatagacgtagtggtggttaatccaaatcctataccacaaatagtcgatatcaataaaaatgctgtaaatggcgtgtatgcgggtatcactaccatcgtaatggcaccgatcagaataaaagccaaactaatattaatgatttgggagggtgataattttaccaataattttcccgctacaaatgatccaacgatccacatcaaggaacttggtgtcacagcaaatcctgccattgatgcccgaagtcccaagattccctgcgtccagtccggtaaataaacttcgtaagcaatcaaaaagccactcattaaagcaattaccaaattttgaacgacaaaagtccgattcccaaaaagttccattggaattaatgggtcggatgccagtcgctcttttctgataaacatcattgccgacacaattgtcagtattgtacagcctgctacgatttcccagcgaatcggcgtttgtccaatcacttgaaaagcgtacatgacagctaacaacataattgtcagccaagccgttccgccaatatccattttgctttcaatctttctcttttcctcatgtaagaaaaattgaatcattaataatacaattatcccgattggcaagttaataaaaaagatccagtgccagctgagattatcgacaataaatccaccaagcaatggtgcgataacggaagcaatgccccaagccgaactatttagccctaatacttgggcccttttttcaagaggatatatatcagcaataatcgtattagcgaccggtaagattgcgcctcccccaataccttgaattgcccgccaaaaaatgagtatgatcattgagttagaaagccccgacataaccgatccaataataaatatagttgtcccaatcataaagattggtttacggccaatgctatcggctaatttaccgtagatgggtgttgcaattgcattggttagaagaaagatagaaaaaacccagttcatcaaagcgaccccgcgtaaatctccgacaattgtcggcatcgcggttgaaacgattgttccttcgattgcacacataaaagtagcaacaaaaagtgcgattgtcaccaaaataatatttcttttagaagctgttgcagtcattaaatgacccctttcattattataaaatgattaaaatcgaatccagttttgagacagaaaaagagccggcacaaaataatcttttgtaccagccccatcccacgtaattaaatacgtaattaaaatatttagttagttattaaaatattctttcagagcgtcaaccttgtcggtatgttcccaaggcaagtcaacatctgttcgaccaaaatgaccgtacgctgcggtttgttcgtaaatcggtcgctttaaattgagcatcttaatgataccagctgggcgtaaatcaaacaatgcccgagttgcctcaatcagcttttcttcggatacctttccggtcccaaacgtattaatatcaattgatactggttcagcaacaccaatcgcataagcaagctgaatctcaacttgatcagccaaatgagctgcaacaatattcttagcaatgtatctggcagcatagctcgctgaacgatcgacctttgtcgcatcttttccagaaaaggctccaccgccatgatgcgcatagccaccgtaagtatcaacaataatctttcgaccagttaagccggcatcgccttctgggccgccaataacaaagcgtccggttgggttaaccaagtatctggttttatcgtctaagtacttttcgggtatcacttgcttaatgattttttcaatgacatctttacgaacttggtccagttcaacgccatccgcgtgctgcgtgctcaatacaactgtgtcaacgcgaaacggtttgtcatcatcattatattcaaccgttacctcagcttttgcatcagggccaaggtagccaatagtcccattttttcgaagttcagcctgcttccgcattaacttatgcgaaagggagatcggtaatggcatcaactcaggtgtttcgttaatggcatagccaaacatcagtccttgatctccggcaccaatcttatcaaatggatcggtattgccgtttctttcctcaagtgctttgtcgacaccttgcgcaatatcaggcgattgttcatctaatgcgacaatcaccgcacaagaatccccatcaaaaccatactttccattacaatagccaattcgtttgattgtgtcacgaacgactttttgaatatcaacgtaagctttggtagaaatttcaccaaatacgagtactaatccagttgttactgaagtttcacaagctactcgagcgtcagggtctttagttaacaaggcatccaaaattgcatcactgatttggtcagcaatcttatccggatggccttctgatacagattccgaagtaaataaatgtttttcgcgcattttatttccccctatatattttttaggttacaaggcttcttcacgtctggcgtgaatcctatcgggaactcataacctaaccatattatcataaattttttatttttggaacccaatttaaagacttcgttgaccgaatccaaaaaaacaattaggattaattttaaagacttttaaacgaaggtgaaactttgactaccaaacgttcagctttgactcagttatcaattcggattctgatcccactttttgtgtggatgctcttttccaacgttggactaaaaaatttttttatcaactaccacttgctgtatctcttttttatcggattaggattctccggcctgttgagtcaagttatctctaaaaataaaaatgctattattttcaccatatgtgatgccatcgttgttctaatgggaattaaaatactattgagtgaccattcttttaacggctggctgctgctgttggattttgttttagccaatatattaattctgacaagcattatcaacgagccacattgccagtggatcatttatgggatcatcaatggcagtggtattgtttttttatttaacattacttaccatcactacttttctttaatgtcattaatgagtattaccctattgatttttgcaaatatctttttttcttttcctgtgtttatgaaaaagggcaatagactgtcactattaattatattagtgttaattttggcgatttgtatcacattagaattaacttttctcaaaattattttcatcagcctgattttagggttctatttattcttcgaatggaaggttaacaataataaatatgacaaacgtaataatacctctttaatttgtttacttttattttctttagctgcttgtctctaaccaaatattaagcttttctttacttactttaattttattcaaagtcatctgaccaagcggattttactccattgaaagtgttaacataccagttgatcaataaacgacgggggataaaattcattgaatattagagtaattggagacattcgaaccggcaaaatacagccttcgttaaccgggaatgccattgtagacgatgcgttaattcaaaatttttgtaatgaattaaaaaatagtgttaatcatgccagcgtaccagtcaatatcattgccgagcattttttcagcccagccattcacacagatgatcttattttgatggatcaacgaatatcaaggcttcttcccgatgaaattcgctcaaaatattgtattatcgatgtcgatcacaatgatctcgtacgtggaaacgttctaaaagtactagatatcttgaaacgactaaacaaagattcacaagaaatttaattgacccattgaaataagcattcaaaaaggctcgcaagataggaagggatattgtatcgttcaatatccctttcctatcttgcgggcttttttagctctttaattaacgcgggttagctactgtttcttatttctgcctatataaaccaacaacatgacaaccattagtccgactgtcaatacaagtgtatcgaaccatgcttccgatctatcggcaaagggcaacttaacattcatcccataaaatcccgaaacaattggcggaacagctagaaccaatgaccaaaccgtcaaaaatttcattgtctgatttaatctattatttaatatatttccgaaagcagattcggtctcattaacaacattgccctgaacatcgaacatagcctgacactgtttatattcaattaccagatccgaaatctgttgggttacccgttgctcgacatcagcagttaaccgcagtttctgctttaaatccccttgcaactcctctaaagcgaccaaatttccggcagtagccgatcgtaaataaactaaccgggtcttcaaaatggtcaattcatccaatcttctattagtaataatccccaaacgatggccggcaaatttatccgcacgttgactcacttcgtccaacatctcaaaatatggcacaagtattgcaccaagaatcgcaaaaatatggtcactaataagtaaaaaatcttgattggactgctgattgattagtttagcctgatcttcaccatgacaggaagtaatcatcacatcatcattaaatccaagaaataccggaaccgttgtggcgttcgtgtcaagaccatttgccaaggcacgaatcaccaacacatttgtatcactgagcgcatcataagttgcccgtggttgttcgtgacgatccagcatatagccttcaaatttttgcggcaatcgatacttggagatgacgtcattaagttcgtcagttcgtgggtcaatcacttcgatccacgtataagttttgaatttatgaatagttatcatttatgaattcctcacaaaatctatcatcaagcattaccaccaaattgtaaggtaagtatcgtcaaaattcaatgtgtgtgtgactaagtttaatttaatgacggctgggctgtttagcgttaatcaagtggtatgccagcaacatgattaaaacagacacaatcgaaatgatcattgcaaccctagtagatgcacttaccaacaggaaaccaaggataaaaataaagaatgccaaactcagataatctgttattggatagcctggcatcttaaaccgactaattcccttaggatgcgcgcggcggtacttaatatggacaattaagagaacaacccaaaccaccacaaaattgattgttgaaacacttgataccaaattaaagacgcccgccggaataaaatagtttaaaatgacgataatcaataaaaatgcggttgaaaaattaagtgcaatatttggcacgccatttcgaccgagtttggttaagaaattcgacgcattaccacccatacttaacgcatacattgttcgactcgtactgaataaacaactgtttgttgcggaaattgcggccgtcaaaacaacaaaatttaatatacctgctgctccaacaatgccaactccggaaaagacctgcacaaacggactcgaagttgttgtaatttcattccaagggtaaacgctcataaccgcaatcatagagccaatataaaataggccaattcgaatgggtaaactattaattgcttttggcaaattgtcttccggatcatcagtttcaccggctgttaatccaaccatctcaatcccaacaaaggcaaagacaaccatttgaaatgacagcaggaatccatgagcaccctttggaaaaagcccgccatgactaaacaaattgccaaaggaagccgttgaatttcctactttaactgaaaaaatggctaacccaaaaccaacaatgaccaacaaaataattgcaactactttaatcattgaaaaccatgactccaactctccaaatagaccaacgttaactaagtttgccgcaaataagcaaagtaaaataatcagaggaggaatccattggggaacgcctggaaaccagtatttaatataaataccagttgccgttaaatcagccattgctaaactaatccagcaaaaccaataagtccagccggtaacgaattcccacctgtcacctaagtattcttttacaaaatccaaaaatgaatgttttgtcgtatcagataataatagctctccaatggcacgcatcaaaagaaaacaaaaaatgccaacaaccaagtatgaaataataatggatggtccagaagtatgaatagcactccctgaacctaaaaacaacccggtgccaattgcaccaccaattgcaatcatttgaatatgtcgacttttcaacgaacgcgataaactatttgcacccttactcttttccataattttcctccaaacaagtcttatagacaacaaaaaaacgcccctaatacttacaaaataagtaccaggggcgtctctttagacgcggttccacccaaattctacaatccaactcagaattgcctcttattgcagataaaggatgcagcccttgtcattcgccataatcctgatatcgactttcagcagttgccgactctcttttcattagttaccaagtatacggattcgtgaacaattgtcaagggttcatagacaagtagtcaaaaaagtggtcatttatttgaagttttcgttgaattagtgtattttagactcaataaaagtaaaagatacttttaattttcgattgatggaggttgatttaaatggcatcccatactgctcttttaattattgattatacaaacgattttgtcgccgataaaggtgcattgtcttgtggtataacaggccaaaagctggcaccaagaattatcgaactcgctaatgaatttgtatccaacggcgactgggtgattcttccaactgacgtccacacaccaaacgacccataccatccagaaactaaactgtttccttcccacaatgtccgtggtacctggggccgtgaattttatggcgatgttgctaaatggtatgatcaaaataaaaaccaagataaagtttatatgtatgataaaacccgttacagtgcctttgccggtactgatttagatatacgaatgcgcgaacgtcatgtagatacacttcatctggttggcgtctgcaccgatatctgtgtcctacacactgccgttgacgcctataacttaaattacaatttggtcattcacgaaaaaggtgttgctgctctcagttcggcgggacagacgtgggcattggatcactttaaacacgttttaggtgcttctgttattgactgaaagtccatcgatctttgcaatatttctctttttattgtttaattgttttcgaagagatttttcgaccttgatgatcagaaatcgggaaaacaattttcttctccacaacgctgggtaagcatttcttatttaatgttgtgtgaataaggaggaacatgaatgagtgaaaaattaccaacttataatcatgaccaatggcagaaagccaaggatgctgttttggaagagtatgaggactataaacagcttttaagacaacagggcgtcgattacacgataaaaaatgctcgtagactgctgatttatcaagacttggttgccgaatggcagcacaaattggatacagttattacggatttggaagataatgtgttcgccctcagtatctttagggacttaaagacgcgaaaagtcagttctttattggaacgaggttacacacatatttcaaattggcctgactttaacccgagtgcgctggctctttggcttgaacttgaagaggacgaagctatggcgtagcttgaaatgataaggtagtcgtaagcataagtaggcctgtaatttatcattacttttaaatttgcattttaaaaatcaaaaacactcaaaatcgagatcagtgataagaatgaagtttcttatcgctgatctcgatttgctttaaaatgccacatgtattttctgaactcagattaaacacattgacttaatccttgtcttttttcttctcccctttttcagctttgcgattcttcttaacatactcttctctggtttgaaggtctttgatgttaatcttgatttcaaccggcgttaaatcagtcatgtcatttaacgcttgacataactttgccgtgactttgtcaaacactgttggaatactttttccatattccaaggtagcatccatagaaagcttcactttcttctcatcattatccaaatcaactttaacacccgttgtagggtcgacactatctgaaaaacgatctgtcattgaatctatcagattaccttcgagtgacaaaacgccatcaacatctcgaactgtatttccagcgatctttgccaaaacatcgtcattataagtcaataccgtttctagacttgtattttcttgagccatgtcagcttcctcctaaaaattagttgttcatatatcccaaataacttaattatttaactcgttcatcatgaaccgagtttgcaatctcatccttttgactgttactttgctgctcccattcttttttggttaaaacatcattgatattcaaattcagttctacaacatctaatccagtataatttttgatcgcgttttgcgtccttgtacatatttcatcaaaaatttttcgtgcatcggatccatattcaattgtcgcatccatatccaatgcaacttgtttatcacctacctccgcgtctatgcctttagttggatccgtttttttagaaaatcttcccgcaagctcactaatcataccgccatctaatgacaatacgccatcaacgttgcgacagacaagaccagcaattttttcgattaccgcattattaaacgttagtttccgagttaattcagtgtcttgggttacttttgtgtccattaagctcagctcctttttatgatttcaaacatctgctttaatcatcgttaactaattgattaatcaaacttttaatgccaccaaatttgccaacaacagcgccaatcagagcacctgcaattcccaaggtcaatacaagcatgaccccgttaaaaccgctgaaggcccaaacaacgccgcacaccataccaataatgccaccatacacaattgagttcatgttgctccctcctaaaccactcgaggctgacgcgttcgcttatttttcatagaatcgcgaggctttacctttacacttaccttttttaccggaatatccattattcgaccaatttctttaaccacgatcatttgaatctcttctcctatttttaccaagccctcattgtcacgaccgactgaggaaattcttacccgtgtctttctctttctcccagtaatcctgatgttggcctttacatcggtaacagatccttgagatagaatcgcttcctgcaagactttctcaaccgctcgttgagagatacttaatttcccatttggtgagtgaaactcaaggctcttcaccttggttggtgccaataatgaaaaaagtataccaattatgcaggttaacccaatcaggatgctaaaaccaaatgccgccaattcaacccagatatcagatgtttgggtagtcccaatcacaacttttgatagatagtcaattggaaccaccaatccgacaaaccacaaactttggaccagcccaatgacacttaaaatcagaatcgcaaattttgaaaaatgacgcatgggttctcctcctttcaagaggtcagccctaactggccaatccgcgagttaataaggaaaccaggaataccaggattactgccccaacaactgccggaacaattgcgatttcagccagttgcggtccccaagaacccagtagtgcttggccaagccatgccccaacgagcccagcaacaatgttgccaatccatccaagcggtaaattgcgactggtaattgcccctgcgattgctccaataacaccaccaatgatcagtgtccaaattaaactgagcatcatcatcatcctttccgctatagagataaaaaacgtcatagcattttcgctatgacttaagtttacaataatttatttcttattgtgtgaataagttatgaaaaaagataggcttttttaagaattaatttggtcaataaagtgccctttacaaaacaggaatttttagaaatatcatcatcaatgcccatatcataaggctaaaagccacctacttaataatcaatgatgaagcacccgccaataacgcaaccacaaaaatcaaactcatcattgcgatatgaaatcgtttatgcatcacaaacaacgccaggtactctcggataactgcatttggtaaataataaaaaggtgttttggcaccgattccagttgctggaatacctaatttaccagccagaataccaccacgcaacgtatgaaaattatttgtaacaaagacaattttgttatcatcacgaccactatcgtttttaatgatccggtcggaaaagatcaaattttgtctcgtgttaatcgatttatcttcaacaagtgtatcggtttcgggaaccccttgatctagggcgtactttttcatagcaacaccctcgggaattttctcgtctccaccttgaccaccagaaaaaatcaatttagcgtgtttggccgtttttttcagttgcaaatgataaaattcaatccctttattaatacgatttccaagtagtctgccaactttgtagccatcaattaagccacttcctaaaacaataatataatccttgtcatattttggaaaatacaggttataaacaatcatcgaaaccatcgtattccaaaccgttaaaagaatataaaaaataaacaatgtcaaaaacatggtaataaaattttgaattggttttggtgcatttattggatcaaacaagaagaatatatcaactaaaatgacacctattccaagaatcaaggtcagagaactgctaagacttcgtccttctcttttccacgcaaaataggcgttaataaataagaatacaaaactgaaaattaatccaccaccaactataaccacaaccgccataagcaaaatcgcaaagattgctgcaagcaacacattttgaatcactaccaatgcttcaaacaaaagcgccataaagcacagaagattcaaattaatcagccagccaataacagatgtgtttctttttttaattagatatgttgccaagactacaagcaaaaccacttgaatacccagcatcgttaataatcccgataacatcgtaagttcccctttcccaatacaaaataaatctagctaagaatctgtttcaatcttaattctagtctttcatacttaaatacaccttattaatataatttataccaaaacaaaagagctggaaataaccgttcatccagcccttaataaatgattcagtaaggtattccaatcttcccagttacttaagactggcatcatggattactatctttccttacaccaaacatagtattgataatttgaatttaagtttaagcacgaaactaaacagttggtcgctgctttcatcgcgatgataggtcgtcgcttttaacaacgccattatcaatcccccataatgataacaacgacactgcttcaatactttattgattagattgctttgaattattaaagtcattcatctcttgtgaagaaaagtctttaacaaagtccaaaatctctctgactttatcttcaccataatgtgtaatccattcatcaaacctagcagtagttaactcggtcactttgctttcaacctgttcaccacttttagtcagatgaagatataatcttcgtcgatcgctttctgccggcttttgataaatataatcatgttgtaatagaactttgatttgccgtgaaattgcgcttcgcgttacctttcgttcactcgcaatgtccattaatgaaacatgttcgcgatcagcgattgtatgcaatatcaaatactgttcaaaagacaatccgtacttcgtcgccggctctgaaacaaaattatccagatacttaagcgatgacagatacacattaattgcctcttgcaataattcttcgtgcgtttttgtcatttccctcaccattccccaataattattaatatcaatactgcactaattatatattgtctgtactgttgtatcaacaatataccgctagttttgggaattttttgagtatctgccttataattgatactagaaaatgattattggaggtcacatgtcagatattttaactcagaccattcatcaaattgaattagggatttttaaccgttttgttcaaattgcaaccaagcatcaccttcattacgttgcaaccggtggcactcttttgggtgccattcggcatcacggatttattccctgggacgatgatatggatattgccatgctaagagatgactatcaacgtttcttgaaaattgcgccaaaagaatttaaaaatgaccactattttttacaaaccccatggagtgatcataatttcgcactaagctatgctaaaattttagatcaaaatacttttatagaagaacacaataatattaataatgctcgaaagggtgtttttctagatatctttccactcgataaaattccaacttcagatgcaaaacgtcgacgacaaatgatcgatatcaaaagactcgatagccgaatttaccttaaattgcgttataatattattgataacccaattagaaagttttatggtgctctctctacagaacaaatagacacagcaaatgactttaaaaaagcccgagagaatatgatgactgcttataatgaccgcgtaaacctagatcaggtcaagaatctagcgtctcaatatgcctatgaaaaagaaatcttttcacttgaacagcttcaagaaactgaaatcgttccctttgaggacacgcaaattatcgttccaagtgactatgatgctattttgaaacaaatgtacggtgattatttaaagctgccgccagaaaatcatcgctcggaaaaacacattatcaagcttatttataataatcaagaattcgaaagataacgagttacttgcattcgggcatcatttttggtagtttattggcaattagttattaatagattgaaggtgttattatgtttgatcctaaccaatcacgtttcgctagctttagtattgtttcaaccttgcctgaccaagcaatcgacaatgtttggtttattatcgacaatgatttacaaaatgttttcccattatcaaatttaatcaagtttaatctagttaatagtgatgggaagctttcatatgattttatccaaggaaatgaattggtcgctacgtttgactcaccttatccatacgataacagttaccccaagtcattagttgtctatgacagtggcaaccgccaaatcatcgcaacaccatcggaaattaacatttaagtacaaagagctggtcaacattaaattgttggccaactctttgtttgtaaaaacaaaaaaagataaccatttaaaaattggttatcacttttgtaaacctctgactgctccggctgggttcgaaccagcgacctcttgattaacagtcaattattctaccactgaactacggagcaaaaatatattttgtatcaaacgcgatataatatttatatcatatctaacacggaaatgcaataaaaaatgaataaaaaaaagattttgcttagagactcatttgagaaaatccctaactgctccggctgggttcgaaccagcgacctcttgattaacagtcaattattctaccactgaactacggagcaaaaatgtttttctaaaaacaacatatatatttataacataaattctcatatcatgcaaacctaaattagtttttttatcaggcaatatgattttcttttaaaatgatgctgatttcttctttcatttcaggtgtttttttccactcctcaaaatgatccatatcttcggttggcatcacgtaattttcattaatataacgctcatatttctgcacgtgaggtgaatgagggatatttagttgtaatatcctaacctgcttaataaaacctctctcagcggctaattcggcccttccattttgaaccatattgcttatttcaatatattttgtcccatcatttcgggtgatttcttcaattaatgtcaaaacctcatggcttttcatctgttaagctccaatcctattttgctccaccaaatcattatacacaaaaaaactgatggcacaaagtgtccatcagtttttttaagagagaaagagaattgattagaaggtatttatttagtacccatgaataatatagcgttttctgtaagcgctgtcaacttatttttaaaaatacgtcggcatttccattttttatcaaaatgtcgtcgtatttacaacgttatgattaactacttcgcatccggtaaatgtaacacatccgatggatgcatcaataaggatggatcattcagcacatgcccgacagaataccctgaaatattaacaaggcagaagaaaatgacgactaacaaaacagcccatgtcagtaattgattcccaactgacattttttcactaataactgaactgtaaaatagcctgtggacttttgaatgaacgtttttctcttgaggtgccgccttctgcatctcttcggtaacttgtttttgataattttgaatactgaagttcttctgtacatttttccgttcagtttcaaaatcatgcttttcctttttactcagtttcttaaaccattttgtgaactcacggtatttagtggtgacttctttcgtttcgccaaccatttttaattcaccataattaatccaagcaactttgtcgcacaacatttcaatttgttttaaagaatggctgacgaaaataatcgtcttaccctcctgcttaaattccgttatcttatcaacacatttttgataaaatgtatcatcacctacggaaagggcttcatcgatgattaaaatatccggattaatatgaacagcaattgcaaacccaagtctcgaacgcattccgcttgaatagcttttaaccggttgatcaacgaaatccccaatatcggcaaacgcaataatatcgggcatcatttcatcaatttcttcattggtaagcccctgcatgagtgacttcagtcgaatgttctcacgaccggttaaattattacgcaaacctgcgtgaatggcaacaattgacgtatctccacgaacatccacataccccgtcgtttgcggtataattccggaaataatgttagataatgttgatttcccggaaccgttaacgccgatcaatcccaacgtttcaccaggttgaatggtcaatgagatgcccataagtgaccagaaatgaggaatttgatgctttgagatcgcaaagaacgaccgtaacttttcagattgagttttaaaaagatcatattccttggtaacattttgtacttttactttataattttcttccatgattgtgtctcctacttcagagattaaacttttcgtcaaatattataacagatatccaaataaaaataagaggccgagagaaaagcttaatcttttgctcccaacccttagtaacttaatgtattctttttgtattcccattttttataattttttcaagcgataaatttaattgcaacgtatattcgttatctgcagatgattgcgctttacgcggttcaaacactgagcgtggaataattcgttcagggatactggtgatcttagaacgaacttggccagtttgattagttctgccagattgacgagtagaagccgacgtgcccaattccttttttaatgactgttcaatttgttcattaatattaccagcggttccaattgttgagtcaccattatgcgcatccaattcgtccaagtggtacttcacaataattgcgtttaacttattaccgtagttcatatcggtggcataggttgttgccaaagccatcgctgcgtcactggcagtaaccgcattagtcgtccatgttcctgaataataattaggatccaccaacgtaccatgacgcaataaactagcattgtcacgaatagaagcaacgatgcttggatattttttaaattgagcagccgtcatataatgtttccctttggaggtatattcaccagtactcattgtcacagattgtccattataagtccctttaattccaaaataattatttgcctcagttgaaagagttgaacgaccaaaatcactttcgacaattgcctgagccatcattactgaaggatataagtgattctctcgactaactttttgaaccggtactttcagacgattaataaaatcgcttgatacactagcaccggctgaatgaccgttgaaaaacaaaaagccagcagctactagaaggcaaacagcccccttggccaataattttgttaaatgagatttgattcaaaaaacctcccctgctttttctaatccatatgccaaaaaataattataccttaaaatggtatggaatcaatggtctgctgtcaattatgataaaaactttgaagatacccaatatttagcatccgacccggggcaagcaattcgataccatattgacttatcattaatacgataacccattttatcaactttaacttttgtaccgacagttaactttacttgagctaatttataatgcttcataaattgaccggaagcactaaaatcggtgtacaaataatttgccttagcagcagatgaaataaccttgtttgcagtaaaatcaacttttgctactttttctgggaaagtagcgacattgaccccctcaatccagcttttgttcttgccaattttaattcgataccatacattctgccctgtagctgttttgacaagtgccgtttgatctacactgtatttagtctttgattttaaagaactgattttagcggtcttcttggctaataacggtgaccccaatacatgattataaagaagcccgtttgttgccttatttggtacaaggctaccacttgttgcccctgtataaattgttgaaaactgaagtgcgggtgcataaacccaaaaacgtttagatttgctatttggataaaatctgaaccggtaccaatttcctgatgattcccttttgaccccacgcatgtctaaataaaccgttactcgtttcttgacacccaacgacttccaactataacgcttctcatttgcactggatccctttatatgattataaacataatagttggcatattttttagatagcggtaccgattgtgctgcactggctttgtaatatttgacgctggaaagtgtaggtgttgcatcttgagttgttgtggttaccgagtttgaactatcactactggaggtactactactcgaacttgtagaatctgtcgcatttgaagaagtagacgcatctgatgaggatgatgaagcctgatcagttgtttcgccaaaagttttatccaaaccatactgttgaataatcttaattaaagaagccccataatcaggcgctgtcgcgtatttccccgttaacgcattagcggcatctgaataggttgttgcattctctttccaagtacctgaatagtatttcgaatcccaactggtgccattacgcaaagtagacccgttatctgcaaaagatgcataggcagttggatactttttaaagctggcagtcgtgttttccatttggccgttactattatactcaacggttggcattgacacagactgcccattataagcgcctttaatcccaaaaaaattgttggcctgctgtgtaagctgactttgaccccaaccgctttcaagagccgcctgtgccatcattactgatccgtaaagattatatttggcggctgcttttttaacatcaccctgatagtcacttataaaactggttgctgatgacgcctgcgccgttaaatatgtacaatgaccaggaaaagctaatgcaaatattgcggatgcagaaatcactagtgcaaccattgctaatttaataaatcttctcaacatttccaccccttgattgacacttcacccttatcatattagaaaattgatgaaaaatgaagcgttttaaccgttaacttttgtattttcttgattggcaactttatatagttttctaataactgcatattatctgtcattttaacacaaaataattgcccaaagcttaaaacaacgtgtacgaagataaaataatttagtcgattcaagaaatgttttaagtattctaaggggtaaataatatatgaaagacctcctaatttttactaccatcaatagttgttcacaataaaaaaagccgaaccaaaacttacttttgattagacctcttaaattaaacttgtgaggaagcgaagactttgttactaaccacttctctaaattttaaaaatgttattcaactgtgacactttttgccaaattacgcgggcgatcgacgtccaagcccttatttaaacttgtaaagtatgcgatcaactgtgccggaacaacactcagcaacggtgtaatcatctcatctacgtctggaatggtaatcgtatcatcctcaagggcaagaccactgcgaacaattgtgaaggtcgaggcaccacgagacattgtttcctgaaggttacttcgcgttaaattagctgttttttcttgcgtaataatgccaacaacaggcgtcccttcttcaattaaagcaatcgtcccatgctttaattcaccagaggcaaatccttctgcttgtacataagaaatttcttttaattttagcgcagcttccagtgatacagtctgatcaattcctcgaccgatataaaatgcacgaggagcaggaacaaaatactttttggccaagtcttcgataatatctttttcatcaataatggcctgcatgcctgtggcaactaatcctaattgctgccgaatatcaaaatcttcggcaattgtttgttccttggtttcacccaacgcttttgccagaattgcttcaaccgcaatctgagctgtatacgctttagtagacgcaactgaaatctcagggccggcatgaagcagcatcgtataagtggcttcgcggaaaagcgttgagttttcaacattggtgatggtcaagctcttataatcatgggcatttacattcaccaagacttcacgactgtccgcagtttccccactttgagataaaaagataaagaatggcttttttgaaagcaacgggtcatcgtacgcaaattccgaagcaatatgaacttcggttggcacatgagccaacttctcaaatagttttttcccaaccaggccggcatgataacttgtaccagcaccaacgatataaattcgatcagcgtcatttaatgcgtcaattaaattatcgtcaatatttggcttaccggattcctgggtataaagtgcagccaactttctcatcacattaggctgctcatcaatttcctttaacatgtaatatggataaggccctttgtcggtctcacttgcatccatatcaacgtggaatggtttacgctcaaccttgttgtggtcagcatcttcaatctcaactgaatccggcttaactgtgacaacttcgccatcatgaagttcgaggaaatcatgagtaacattcagcatagctggagcatctgaacacacaacattgcacccgtcaccaagtccaattaacagtgggctcttgtttttcgcaacatacagtgtctcgggatcagtactgtcaatcaacagaaatgcatatgaagatccctttaacaagctcaacgtcttcaaaaaggcctgcttggttgataagccttctgtttgaacaaaatggtctaccagctgaacaacgacttcagtatctgtttgactcgcaaaagtcgtattgcttaaatattctgattttaattctttataattttcaataacgccattatgaacgagataaaatctatgatcctcggaaaattgaggatgcgcatttgcttcgctgacaacaccatgcgttgcccaacgtgtatgcccaattccaacggacccatgaacgtctggtccaacggcggcttctaactcggagatacggccttttcgtttgattaaatagtctttaccatttaagtcatttacgtagattccagcagaatcatagccacgatactcaagtttttcaaggccttccaacaaaattgaaactgcattatcatttccggttacgccaacaattccacacattttatattctcctcaacaatcaaaattggtatatacaccattaactgttatcctttttctataacacgtataatctacacaattacgaacaaaaagtcaactaatagttacaaatggtataggacaattattcttttaaataaaacctaagactatcagtatttttaaaacaaaatgaaaagactaccaattatttacgatagtcttttcatacaaaatgatttaattttatttaatcaatcccaatttcttcacggacaacatccgcaattttttgagtgtactcatcaaccaaatcttgagttggtgcttcagtcataacacgtagcaacggctctgttccgctcggtcgtacaaggacccgaccgtcaccatgcatctcttcttcaacttctttaatagctgcttgaattttttcattttgaagaccatcttttttatcgcgaacttttacattgatcagtctttgtggatattttttaatttcgcttgccagctcagaaagctttttaccagtagatttcatgactgataacaactgaaggcttgtcagcatcccatctccggttgtattaaaatcaagaaagacaatgtgcccagattgttcaccaccaaggttataaccgtcagcattcatcttttcaaccacgtaacggtcaccaacctgagttttaacacttgtcataccggcacgttccattgctttgtacattccaagattactcatgaccgtcgtcacaatcgtatttttcttgagtcgtccccgctcagccatatattttccacaaatatacataatggcatcaccgtcaactaattggccattttcatccacagcaatacagcggtcaccatcaccatcaaaggcaatcccagcctgaacacccttttcaacaaccattttttgtaggttttcaggatgagtcgacccaacgtgatcgttaatatttagaccgtccggtgtcgtcgccaacgtctcaaaatcaattcccaaatcagcatataatgtcgtcacaagtttgcttgtggaaccatttgctgaatcaacacatacttttatcccggataagtcctccgaaattgtttgttcaagaaaatgaatgtatttttggctgccttcaaaataatcaccaacaacaccaagcccttcagctgctggtcttggtaaaatatcttcttgacgctcaagaattgcttcaatttcttcttccatttcatcggaaagtttatagccgtcagcaccaaaaaatttaataccattatattcgactggattatgagaagcagtaatcatcacacctgcatctgccccctgattacgtactaaataagcaacaccgggcgttgtaataattcctaaattcaaaacctcgatgccgacagacaataaaccggcaatcaaagcttcttggagcatttgcccagaaatccgggtatcacgtgcgactaacacttgaggctgctttctttccgaatgatgagtcaaaacatagccacctgctcgaccacactgaaaagctaactctggggtaagttctttgttggcaatgccacgcacaccatcagtaccaaaatacttcatgaaaatttcctcatttcaaataaattattagttattcctattaatcttgacagaaatccgatccggatcaaaacccttcacattgttaagtttcgaatccagttcaacatctttggtttttgtcgttctaacatcactggtatcaacttcgactttaatagaatccagttttttaagctgagcctgtgtgccaaatacccgaacacgcttagtagcagaggtcagcgtaaagctctcgttatcatctgtaattccctttggttccaactttataggaagttctttgctattgccgggggtaattggtaaagtaacgtcggcagtagccggcgtaattacaacattaaccgtattctgcttactatcgagtgcctcaacaattgcctggctgttaatcgatgatttggcgttttggggaacattaagctgggcaacaactgttttgattcggttaatttgatcagaagcgccggtaattttaacattctttacatctgctgaagcgttaccaggctgatatcctgaagcaatattttctttattatatttaacctgtaacggataagtaaccgtctttcttggttgaatgtcaactttaattgtagccggttcaaaacgatatctcaaatcattatttaaaccttcctgctgaatccgcacccgatgtgtcccaacgccaagtttggaaaggtcagcatacactttaaaattctgagtgttggctgttgtcgtaactaaagctgaaggcccagttatatgaagttgaactttttcaggataaccggtcacaaaatatttattactgtttacagtcaacgaaagctgtgaggagatcgttgtagatcgattagatgtcaatgacgttgaattactgttattcttaactgaagaggtcgtgctaggctgactgctgccaacatacaaaaagagcagaattgcgaataccaatgcaagaagccgataagcccagttattaagtagaaattttttcaagattaccgacctccccgaaaatgactgtcaataaagctgacaactgtattgataaatgttcgatgatcctgttggtctgtattggttagaagctgattttgtaaatattttaggtaatcatcctgggtcattccccttaacagctcgttattctgggtaattgaaacttcgccggtttcttcagaaataacaatagttaacgcatctgttaattcagaaatcccaactgcagctcgatgtcgtgttccaagctctttgggaattaaattgctttgggaaagcggcagatatgctgcagcaacggcaacacgattatctttaataatgactgcaccatcatgcaaaggcgtattaggaataaaaatgttaatcagtaattcaccactcacgtcagcatccacatcaatgccggtttcaatatattcctcaaggccggtattcatctgaattgtaatcagcgcaccaattcgccttttggacatgtattgaatggccctgtcaagcgccctaattagtttctttgctgcttcattctcctttttacctttaacaagcagtgatccacgaccaaggtgctcaagaccccggcgaatttcaggttgaaaaataatcaccatcgcaatcactccccaattgatcacctggtccataatccatgagacagttgagagaccgacataaacacttacaattttaataagtgcaatgatgacaattcctcgaagcaattgaaccgccttagttcctcgaatcatcaaaattaaattataaataatgaaccaaacgactaagatgtcaattagattcgtcaaattgtggagcgtaaaaaagtctgaccagttcatggcggtctcccctcaaaattttttcaaaaacattatatcattcaaattgactgaacaactaatcataccaaattctgtgatatgtttaaataaattataaaaagtacttattcaacaaatttccgatagcatttatcggtaaaaaatagtttaattattattgtgataggaggttgtcaagttgagtaatttgaataaatgggttgttcggacatgctttattgtctggatcactttactatacttgtatttaagaacgcctccgtttaactttttggtattaaatacttttctagcctatattccaattgaattaagcttccacatctcgattgcaaagcctaaaaacgcgttcatcttttggttgtttgtcatcatctggctacttttttatcccaataccccttacttattaacggatctattccacctatctttattggaaccttatggggttaatggccttttgagattaaacaatgtcatgtggttaaaattttcattattgcttatatcaacactattttcgactttgctgggtatgtggggattagaaagaattgccgaggcagtttcagacaggcttcgagtccataataccatttttaaacatctgctcatcatcggattaacatttgtgacatccgtaggtatcttcattggtcgctttctacgaattcatacaatctatttaatcttaacaccggaaatgttcattaggccactgctaaacatgtggagtaaagatgcaatcgtttttatcggattactaacaattgtccagctggtcttcttctatactctaaaacttgtggtagcatcgtcaacaagcaaacaaaactcactaaacaagtaaagcctgtgaaaagctaaaacgctttgaccacaggctttttttgaatacaggataggaagtgacactttttaaaacttctgaaaaacatttttaatagctttttaaaataacccgactcaacttaatctgcattttgataatccattattaacactgtttcagaataattaatatactgtcttagatgcgctgccattgcccaatcaatgtgcccctgctccaataatacctggacgccctctcgttcagcggctagcgccttgattcgtaaatgttgatattgcatcgtgtgatctttgatctgacgtttactgtgttcctttgctagttcaatttgattacgataatgaatgatcaaatggtaaacagattgactatcgaaacgattattatcaatatcatcccgagcaaaataactcgacaattctttaatagcaccctttgcttgctcacgttgaaccaacgccagctcatcggtaatatcatccttactcttacgttgaatacgccataaggaaaccttattttttaaacgaaccatttgctgaattgacccgcgacccatgcgagttcttttgccaatcgaatgaatcatgcgacgttcaagccgctgaagacgttcgttggcgactaaaaaagtttctcgagaaatctctttggcatcaaataatctctgaatggctgaacgttcgccccgcagggccactcttcttagcgccagctcgtcggcaataatcgaatccatttcttttttattttgaagtttaagctctaatcgcctaatcaagaactgataatccaagattagatcataagcctctttttgattgttgggtcgtctctcctcttcgattcgttgaacagccaatttcataatataaagctgagcctcatcatcagaaatgtaatgagagccatcatcttcatcagctgcagcagcgtcaagatcatcatccccggcaaagtttgcccgagttaatagaggtgccttattttcagaaatcaatggcagcataatggttgcgaccactaaacttataataatgacgcttgctgcgacaaacaatgccaaggaacgcgatggaaagggctgtccggtcgaaacggcgacgggaatagacagtaccccagccatcgttaccgcgcctctaacacctgataaaccggctaacaaggcagctttaaatgaatgcatttgattcttagtttcgccatggcgtttcctggtacgtaaaccacttacaaattgatatccgtaaatccaaataacacgaatagccaacaaaattagccaagccacaaacgagatcccaaacgcagcaaacgtattaatcttatcgttttcaatcacattggttgttgcaattggcaattcaattcccaaaatcaaaaagacgattccgttaagtgtataaataatgatatcccaggttttttcactcacaagcgtcaattccggttgactgcgatctggtgcagtcccgtaaaaatgaaaaacaattccggcagccaccactgctatcacgccggatgcatgaaataactcttcagtaattaagtaaaccacaaatggtgtcgtaacccgaagaactgtactaaaaataacgtcattaattccttgacgataaagccagttttccaccatcaaaataattgcgattacaattacgccacttgcgaatcccataatactgatatagaaaaaatcaattgctgcagctttgatcgaaaatacaccggttacggttgccgcaatcgcatacttaaaggcaatcaaaccacttgcgtcattgattaaactttcaccgctaacaatatgcagaaccgcctcaggtagattagctctttgagaaattgattgaacagctactggatcggttggtgataaaatggctgccaacgcaaaactaactgaaaacggcattgcgggaataagggcatgaaataataaaccgcccaacaaagtcgtcagaaaaaccaatataatggcatttgccaaaatcggtccacgtaacttccacagctccttcttcggaaatcgtcgcccatcattaaaaagaagtggtgcgacaaaaagaagtaggaaccagtccgtttccaatggaattgatatatgaagaaccagcgcaaggccaaggcctaaagcaacttggattaaacttaccggaattgccggaataaaatgatcgataacattagaaataaccactaacgtcatgagtaatatgaccgcttcaagtatgtgcattgatccactcctcttaatgatacttgtatgaaactcctcatacctaaaaaatgagttatttctatatctataaactctttactgattcttcaccaataattcgaacttctgtttctaaatggactccgaatttatcaaaaacggttttttgaacatgtgcaatgacatttaaatagtccgtcgccgttgcatgatcaacattaacaataaaaccggcatgcttagttgatacttgtgcaccaccaatttgaaagccctgaaggccggcttcatgaataagctttcccgcaaaatatccctttggccgtttaaaaacactaccacatgaaggcaattccaatggttgtttactttctcttaattgatttaaatgattcatttgcttctgaattttttcagcaattccggaagttagcgaaaatgtcgcggaaagcacaatttgatgattatcctgaacactgcaatgacggtaaccaaaatccagctggtgaaaatcaagatgaataaccttgtcatcagacgttaaaacttcggcgccagtgacaacgtcatcaatatctccaccataagcgccggcattcataaatattgctccaccaacgcttccgggaatccctgctgcaaattcgaccccagttaatgactgagcctgagcggccttagtgacatcaattaacgcagcccctgcatccgcaacaattgtgttatgatgacgaattcttatcttattcatcttagtcaaaatcattgttaatccatgaatgccaccatccctaacaattaaattacttgcatttccaataactgtaacgggaataccatattgatttgcataggctaacagctcctgcgtttgcctgacagattcaggaaaagctaatatatcggccggcccaccggtcaatgtatgcgtgtatttagaaagtggttcattaaataaaatatcgatatttggataaatatctgctatttctttataatcgttcataattaaattccttaccttcaaaatagttcatgatgattttttaagatttttcaaaacgtataattttattctaccacgattcaacttttcgatgttactcgggaaaatgatgggttaaagaagtctttagttgcgattgatgacgaacgtttgtaaaatggtaatcagcaaatgaggtgaaataaaaatgaacttcgcagcaatggactttgaaaccgcaaacgccaagcgggccagtgcctgctcactagccttggcaatcgttagaaacaatcaggtcacccatgaattttattcgctaattaatccggaaacagattttagttggcgcaatatcaacgtccatgggattcacaaacaagatgttgccaatgcccctacttttcctgaactctgggatcatattgccccattgttcacagcaaacaagttggttgttgctcacaatgcatcattcgacaatagcgttttaaaacgcacacttgagcgttatgacctattactgccacattatttgacgttggacacactcaaaacgtcaaaacaattttatccacaaatggttaatcataaattaaacacggtttgtgatgagttgcatatcgaattggaacatcatcataatgcgcttgatgatagtgttgcatgtgccaacattttactcacgcaacagcaacaatttggaaatagcgttttgagaaactttgtaaaggccatttaaaaatatcgaatgcgggcaaaaatgatgcactgcattcgatatttttatttcttgtcatccttaacaggtaatgacatgattaaaatggtttgatttttggattctttacgactggcaacactaaaccccagctttcgataaatatgaacagccgcctgattattttcaaaaactgccagcgtcaacgtatttaacctactatacgaacgagcccaatcaaccgccaaatccattaaattagtgccaatggtaaagccctgatactcccttagtacggctaccccgatttcaccagactgctcatcaatcccatctactgttacaattccaataggcatattatctaaaacagccagtgccatcaaatttgtgtatgattgattgatcagtctaatttgctgagattctaactctgccgtaatttcacccaaatccgaatccaccataaacgtattggattctttttgaagccgacttaataaagtcaaaacattttgggcatcactgggttcagctaatctgaaactcacttcatccgacattaaatctctcctaaaagtttggtcgtcaattcttcaaaacgattcccctttggttcaaaaatcattgttctgacattatctcctttagcatcatcccgcttaaaaataattctcaaataatcagcagggatctcgtcagaaacaaattttgaccattcaacaacattaacaccatcaccattaaaatactcatccaacccaaggtcatcaccgccaccctgctcaaggcgataaacatccatatgataaagtggtattcggccactttgatattctcgaataatagtaaaagtcggactcttaatagggcgctcaataccaagtcccttacccaatccctttgtaaaagttgtttttccggcacctaaatcgccatcaagtaaaataagatctctcggctgaagaaattgggcaagtttttcgccaacttcaattgtttgttcggcagagtttaccgttatcgtttttttcaatcgatcatcacttccacttttaaataattatctaaaccgttttatataataccacacacaatcagtcaattttaacattgtgactaaatcgataaatcctgttaaacgcaaaagaccggcaatttacttttgtcggccttttttctcatattaggtttattggatcatttttataaattaattaagacaacgtctgggcagccgtaatgatcgaaactttgtagatatcttcttcattactaccacgggataaatccgaaaccggtttatttaacccttgtaaaattggtccaattgcttcaaatccaccaaaacgctgtgcaatcttataaccgatatttcctgattgtagttctgggaaaataaagacggttgcatgtcccgctacatttgaacctggtgctttcttatcagcaacacttggcacaaaggcagcatcaaattgcaactcgccatcgattggaatatccggcgcctgttgcttagccaattcagttgcttcttgaacctttgtaaccatatcacccttagctgaacccttagttgaaaaactaagtaaagcaactttaggatcaatatcaaatgtcttagccactttagcactctcaacggctacttctgccaatccggcagcatccaaatcaatattaatggcacaatcagcaaacagataacgttgatcacccttttgcataataaaagaaccactgattaatttaacgccgggctttgttttaataatctgtaaagccgggcgaaccgtgtcaccagttgggtgatttgcacctgaaaccattccgtctatcttgtccatgtataccaatgtcgttccaaaataattaggatctttcaaccattcacgggctttggcctcatcagttttgccctttcgcctttcaacgattgccgagaccattgcatcaatttgatcttgaggctgatttaggtaatcaataatttgaacatcattcaaatcaatgtttgcgtcacctgcaacctgctcaacctcatttttatcacctaaaataaccggtttgataagaccatccttagccaaccggcttgcagcaccgagtacacgaacatcgttaccttcaggaaaaacaatgctaatatttttcccgttgatcttttgcttgagactttcaaatagttccatgacaaaatcctccaattcatgcaaaaattacttatattaaggtgtttgggttaccttttccggtaattgccaattaatcggttcttcccccatcgcaatcaaagcttcgtttgttttggaaaatggtttagaaccaaagaaacctcgatttgcagataatggacttggatgagcagattgcaaaacaacattggtatcggtatcaatcaacgctattttattacgggctgctcttccccacaaaatgaagactaccggttcttctcgagccgataatttttgaatagcggcgtctgttagttgttcccagcctttacctttatgagaaaatgcttgaccatttctcacagtcaatactgagttcaacaacaaaacaccctgcttcgcccaacttgttagacaaccatgatgaacaggcttaattcctagatcagactgaagctccttataaatgttttgtaacgacggcggtattctcacgcccggcattactgaaaagcttaggccatgagcttgatgcggttcatgatatgggtcttgtcccaaaatcacaactttaaccttgctgaacggcgtcaactgaaacgcctcaaaaatatgattcatatcaggatgaatatattgtgttttatattcagagatcaaaaattggcgcaactgttgatagtatgctttttcgaattccggttgtaaaacatcccaccaatcattttttataaacggtttcattcccaacacctcacgttttattctaccatatcccttttcaaataacattagcaactatttttccaatccgtggtagaatgttcttaataaacgaaaaggaaatgtctctatgagtcgaaaaattcagatcaatctgtccgaactggaccatacaagatcatgcaaaatcattgatgaatataaagacacgaaatatttaatcgttggtaagtgggggctggtttccgatactttctcggtctactcattaacaggggatgttctggcagaggtaaggcaacagtcccttggcgtaacacctcgctttgaccttttttgtttcaatcaatttgttggaagttcagttctgcatttttcaatgcattatacaactttgttcatcaacggcattaattggctggtcgttggcaatcaggaaaaacaatcatatataattacccatggtcgacaaaaaattgcctctatcaaatcatatgcacaagccgatcaagtcatccggctattgaatgttgaaaatattgagcatgaaccaatggtggcacttatttcagcaattctaaatcacccatcgctggttcacacatcgaaactaaagttaccgtcattggataaataccctaagggtgctaaaccccagtggggtgaatgccattttttaaagaaataaaagatggtgaattttatttagattatgataacaaaaaggagatccaagcaaatattgccttggttctccttttttggttactaaaacatatttcttaaaaaactttcacaccgactcatttaaaatcgcttcataacccgctcgatggttcgttgttcatcacggcgcttaatcgtttcacgtttatcatactcacgcttaccttttgcaacaccaattaaaaccttggcaaatccacttttcagataaaccttgagtggcacaattgtgacacccttatcttgtgtcgcctgtcctaatttacgaatttcttttttgtgcaataaaagtttacgatttcgaagcggatcatgattaaattgatttccttgtgcatattcactaatgtgaacattcaccatgtaggcctcaccatttcgaatctgcacgaatccatcttttaaattaattcgacgatcacggattgatttaatttcagtcccggtgaggacaatgccagcttcataagtctcaagtattgaatagtcgtgacgggctttcttgttttgcgccatcaaattatcattattttgcttatgttttcgtttggccatataatctcacctgcttttcaaaacaattagtgctttttacgaccatattgtttcttagattttgaattcttattagaacgatgattatttcgattattattgttgttgctaaaatgaatattagcaccaccaccgtgattactgttgttactatgacgttgatcattgttatgacgatgatatgattcttttggtaaatagttactggttggcgtatcttccgggttgacaacatcaaaatcaaccgcactctgttcaacatcaacattgataacttttacccggattggctgtcccattttataggttctatgagttctgcgaccaacaagtgccataaactgctcaacatactgatagtagtcatcactcattcggctgatatgaaccaatccttcaacagtgtttggtaattcaataaataaaccgaatttcataacagagctaacgacaccatcaaactcttcaccgatatgatcattcatgtactcggctttcttcatagcatccgtatcacgttctgcatccaccgcacggcgctcgtattcagaagtagttgtcgcaatttcatccaacacatttgcgtacttcttcttggtttcatcattgataccattatcttcataataatggatcatccgatgaaccattgtatcaggatagcgacgaattggtgatgtgaaatgcgtgtagaatggtgctgccaaaccaaaatgtcctaaagactgatcggcatatctcgcttgctttaaactcctcagcaacattaccgaaaccatcatctcttccggtttaccagcaaccttcttcaaaatattttgaagtgtctttggcgtaatatgcttaggatctcctttaacattaattccaaaagccgttaacgtctcaaagaaagtcttaattcgatctgcatccggctgttcatggacccggtaaataaatggaacatgagcctcgtaataatttttggcgaccgtttcgttagctgccagcataaatgattcaatcatcttttcagcaagtccacggatccttaacttaatatcaattggatgccctttttcgtcgacaatgatttctgcttcattatcatcaaaatcaattgccccacgcgcatgacgttgtttatacaagatcctgtgaagttctcccattgtctcaaacattggaaccagttcattatattcgtccatagtcttttgatcatgagattccaaaattttgttaactgcagtataagtcattctagctttggaccgcattaagcttggatgaatccgatgcttgacaacatttcccgactgatcaatttccatctcacaactcatacaaagtcgcaattcaccttcgtttaacgagcaaatgccattagatagtcgtcgaggcaacattggaataacccggtcagtcaaatagacggaggtcccccgtctatatgcctccttgtcaattagcccaccagcctttacatagtgactgacatctgcaatatgaacaccaagatggtagttcccgttaggtagtttccaagctgttaccgcatcatccaaatcctttgacgactcaccatcaatcgtcactaaatcttggtcggtaatatcttcacgaccagccttttcttcttcggttacgtgatctggaatagcatcagcggcctgaagaacgtcttctggaaactctgcaggaatatcgtgagaataaacaatttgtaaaatatcgatacccgggtcgtcgactgcaccaataacttcatccgcaataccaaccatataatctggatgatctgcattgggatactcggtaatttgagcagtaataacttcacctggtgttggttttaagccaatatcgttaatataaaacttatattttgcaatttttttatcagttaatttaacctcaccaaaatagtgacgattttcggattttgaaaatggtccaacgactcgtttatactttcgatcagtaatcgatgtgactttgccttccgggccccgatcagatccaggctccgccggcttaacaatttccatttcaacggtatcgccgtttaatgcattcatcgtgttatcaggtgcaatgtaggcatcaggtgcgatatcatcataagcaacaaacccgaatcccttatcattagcatgaaaaatgccggataacttttgcttatcagggttcatttgaaacttgccatcttgtgtgaccaccgcaataccgtcgcgctccaagcccgccaattcctgaacaatcagcttaaaagactctgatccatggtatcttaaaacatcggcaattttttctactgaaaattcattgtcgggatatgttctaaggacgttctcaatttctgtttttaaatcattatcttgcaatctttattcctcgtattattcataaattttagttaaaaagttacttaaatcaatttcgagctgctgatgagctgaattaacagtaatcatatgactggcatttgggtattcatgataactcactttactattaacaagctgatcacgcactaattgactactttcagggttcactatttcatcgctcattccctgacctatgaaatatggttgatgaattttaggaagatcagaagcaacgactgcactaaagtcggaaattctttttagtaagtcatcaatatgctcatccagccactgcaatttatcggccatgactttcggatctgttttatagcgaagatagttagcccgtgccatctgcataaaggtattatgaacactaaactgtcgctttcgaactattggagagccaaatgaaccaccaccgactaactctggatgtaattcaagcgctctggcagaaaaaatgcctcccaacgagattccaaagatactaatatcttcaaaaccttgatgcttcataaattggattgcctgttgcgtatcttccagccaaatttcaggagacccctgaagaataatatctttaaagtccggagtcccatgcccggttaacaacggtgcgtatattgaataattacttcgctcaaggcgtcgggccagcagcctaacatcaactggaccacttgcaaatgcatgcattaaaataatggccttgggaccatgttcgaaataaaacgacttatttggtgcttgcatattctttcattcccctctacagtatagcagctgtaattatttagaatgacatcattaactgtgcacatcagccaatcttgatgctcgcagcaacttctttttagcttggatttaacataacttcttttaccctaacactaattataataaaaatccccctgtatttaaacaggaggagtaaatactaatgagatgataaccaaaccagtcctaaggataatacaaaaaagattattcccaaaacaacggttgttttttgcatgaatgcttcaaaaccacgtggcttctgcttggcaaacaagtcatctgcaccaccggttaaggcagacatcgcatcattagtctttgatggttgcattaataccgcgattgtaattaatacacagtcgatcaatagtaatgttatcaataagttgtacacgttacagcctcccaccgtaaaatcggctcaatactactcatactaagttaacacattatcaacgtttattccacacctagccatcaactttctgaactaagttttgtcaaatcagctgttatttcatgctgtttatttgtcgaaacattaatataaagcgtgtcgccccatcgaagcattgtatggcctgaagggacaatttcaatgccatctctcaaaatctttgttaataaagatccatttggccatggtatctgacttacaatttttccatccatgtaggcacctgcaaatatgggcgttactatttgtgcggttcgaccaagatgaaactgccgtttaacctttaacaactgttgaagcatcgcataataaaccggtttgccgttcaaggcgtctaaaacactatatgcaattaggcaaaccgttgccaatccaagtaggtgtgtcaatgtaccaaccatctctgtgatcaagagaattgctgtaaaaggcgccttgctgatagctgcaaaatagccagccatccccataataataaaactcgataagtatgtttgcgagataaacccatattgaattgcgatattgccaataatcgcaccaatcaagcctcccagacaaaggattggtaagaagattcctccaggaagaccactgccatatgaaatcattgaaaaagcgaatcggatcaggaagaaagcgcaaagcaccaacgttgaatagccggcgcccgtcaactgaaggatgatataattgccaccacccaacaaattcgggaaataagcccccaaaccaataatcaacagtaacggaataataccctgatagtaccacggtagtttgctaatccgatgataccaaccgcccattcttaaaatgataagctgataaaatcggccaagcaatcccaacgcaattccaaggataacgacccagataaaataccgaagcggaagcggctggcttttcatatacagaacaggtttcagaccaaaaacataggttgcaaccatatcggatgtgattgcagaagttaatgaaacaatccaaatgtttgttgaaaaattatgataaatttcttcaagaacaaataacgtactggcaattggagcattaaacgcggcacttaagccggcagcagcaccacttgaaatcagcacctgccggtcaaaccctacctgcttggttaagtgtgccagcccctgtccaagcgttgaccccaattgaatcgaaggtccttcacgtcccaagtataagccactgccaattgcaagaataccaccgacaaatttacgccagagcacagaccaccatggataatcaagctcgtctcgtagttgtccttcaacctgtggaattcctgatcctttgatatcgggttgttgtcgtaacagcatgcctataatgagaccaacactcaaattaatggcaagacacaacaacatcagtattggtttcttaaatatacccgtgtacaggatctgcattatcgtcatcatgtgttggatggaccatctaaaaagagagaccacaattccggctaaaataccgataataaggccattaaagataaattttagctgagacaatttatagttaccctgaacctgcacgtttttcatcccttaatcatttctaacacttatcatatcacaaccacttaaatccatttctttagcttgggaaccaatagtgaaataagtaatcccaagccaatgataatcccccttttagaatcagcatccccagtttgcggcaatcgattagaagatcgacccgcttttgaagaacgggtggtctcactatttgaagattcagatacctgctgtgccgatgattttggatcagtggcctttttagataagacaacatgtttatttttggaacgtcccctagttgacctgccagtcttttgggtcacttgattattttgttttttatcttctgccttatcattgacctctttggaaacaccttgatcgtttaataccacgttttggtttttcgtgtcttcgaacacatctttgggcgtattttccaaagacctttccttatttgttaccggaagttcagaatgattgacctgcaaatccattttcttgtcattatcttttacataattaattttaacattagccggtgtcattgttgatagcgttatttgtttatcggtaataatagaccgatagccatcaattgagattggcacataatgcaacttttctccgaattttcctgaaagggtgctttttgaaagttggtggccgttttcatcgacattaacaatggtcactttaacatcatttctttgatattgaagcaagtaaagatctttctgtttgtcatacgtcgtggattgccactcatagccatagaattcgatattttcatgaaaaatatctgctaccttggacctatcaatcactttcaaaaacaaatcattgccggtttcgtcgagcccctgtactttgatcatatgactggatttaaggcccattttattttgttccctgctaacctttttcgcgaatcgcgattgtgtcggatggcttgttcccttgtctgcacttattttattcacttcatgttgaacctgtccctcgttaatcccaaaagtatccgaacttaaccccttgctttttgcgagttgggttgactttttagaattaatagattgatccactagaagttgtttggacccttttgaaaagtctttttctactaaatgcctatcagttggcttttgtcccttgagatcatcacttaaattagagcctgcaaggttattcatcgttgacgatggctctgcttcttttggagtgccaattgattgctcctctttaactacctgctgtgttgttacgtcttcgtcgtcttttcttccactattaacttgttcatcagaggcggttttatttttggggcgttttttagcattttgttcattcaaattagaaagatcgctttgtttaaagttgccaacaatttctccagttttaacgtctgaatgattatcagaattaatttttttattttccgttattctgtcaaaatctgtcttatttgacgatgtatcattgctcgttacctgctgaaaaagtttttctggatgattatctgatacataagtaactgtaaagccgtttttgatacttcccttaatagctgtttccccatctaacagcttatagccgggtaacgtcttagggataaatttgaaattctcatcttttggatcaattttttccttataagaagcatcttttttaccatctgaactaagaattgatctggaactcaagtgtccttttgcatcctttatttgttcacgtacataaacattaaattccctaggagatgtttgttcactctccgccgcccgacttacaatcggcgctgccaaactcatcaaacctactgaaaacaaaataacctttttcaaaataaaaacctccatttagtgtgtaatattaattacgcaaaatgaaggtttctttattttattaagtcaaaattattttgtaagagatataaaaaaaccgcatttctgcgatctttttatcaattactacttgctttgaatgtcatcacgagcttgttctgataaattgtagaatgagtgaatacctttgtattcggaaacatcaccaagttgatcttcaattctcatcaattgattgtacttagcaatacgttcgccacggctcattgaaccagtcttgatttgacctgcattaagagccacaacaaggtcagcaatcgttgtatcttcagtttcaccggaacggtgtgaaatgatagcagtgtatcctgcttcacgagccatttcaacagcttcaacagtttcagttaaagtaccgatttggttaagcttgattaagatagcattggcaacgcccatcttgatacctttcttaaggtagtcagtgttagtaacaaacaaatcatcaccaacaatttgaacctttttgccaagacgttgggtagccatttgccaatctgcccattcattttcgtcaagtggatcctcaattgaaataactgggtatttgtcaacgataccttcaagcaatgaaacaaattcatcagcagtgtatgactttccgtcacccttcaaatcatacttcttagtttcagtgttatagaattctgaagcggcgcagtcaaaagcaatcgcaatatccttgcctggtttgtagccggcacgttggatagcttcaacaaggatttcaaatggttcctcattgttcttaagatctggcgcaaaaccaccttcgtcaccaacagcggttgaataaccacgttcgtttaacaagttcttcaaattatggaaagtttctgaactccaacgaatagcttctttgatgctaggggcaccaacaggcataatcatgaattcctggaaatcaaccttgttgtttgcatgcttaccaccattaataacgtttagcattggtgttggaagcaagtgggcattgaaaccaccgaggtagttatatagtggcatctctaattcatcagcggcagcacgtgcggcagcaagtgatacaccaagaatggcatttgcacccaacttacctttatttggcgtaccgtccaattgaatcatagccttatcaatagctaattgatcagttacatcgtagccaacaatttctttggcgatgatgttgtttacattatcaacggctttggtaacgcccttacccatgtaacggtctttgtcaccatcacggagttcaacggcttcgtgttcaccggttgaagcacctgaaggcacgattccgcgacccattgcacctgcttcggtatataattcaacttcaacagttgggttaccacgagagtcaagaacctcacgggcataaatatcagaaataattgacatatttttttctctccttagcgaaagttgtgaccttttgtacaaggttcaacttaattttattagtttaacgctcaagtttcaatataaaactgcgaatcttagctatttttgtaagaaatttgcaagtttcaagaatgaatcagcctttaaactggcaccaccagccaaaacaccatcaatatcggtttgagctaaaatatcatcggcattattatcgttaacacttccaccgtacaacacacgaacctgattggcaacatcatcagaatacaaatcggcaattgtttgtcgaattaagtagcatccttcttctgcttcatcagtgctggcagttttaccgctcccaattgcccaacttggttcataagctaaaataatgcttttagcctgatctgcagtgacagatttaagcgcattagtgacttggctgacaacccacgaaattcgttctgcagattgacgtcggctcatcgtctcgtcacaacaaatgatcggtgtcaaatgatttcgaaaagcagcatgaacctttttgttaataatgtcatcggtctcattgaaatacttccgccgttccgagtggccgataataacatgggtaactcccatttcattcagcgcttccggactggtttctccagtataagcaccctcgtcttcataaaaacagttttcggccgcaataattagcggtgaatctgcattatgcttaatcatactttccaaaaatagtggtgaagcagcaatgcaggtttcagtaactttcgggtcaggaagctttcctttgattgtttccagaaacttaacagactcatctaccgataaattcattttccaattaccggcaacaaacggaattctcataatcaaatcattcctttacaattaattgcttaaaattattgtaacaaaagaaaccccaaaagccacgaataacactataccaattttaaaataatatgcgcctgaaccctattgtgaactactcggtcatgaatgaccgagcttctgggaacacgaagtcgtatttaggatgttgtatcggtatgccgaagacctaacctacagaacttcgctcttttaccacggctagtttctagccaatagctcttaatccgcaattaaagatattaactgccgcattaatatctcgatcatggtgggtccagcattcagataaaaaaatcccgacaaagcgggattttaaacttatttattgtcgattgcagcaatgccgggaagtgtcttaccttcaaggtattgaagtgaagcgccgccaccggttgaaatatgagttaatttatcagcaacaccaagctgcttaacagcagcagttgaatcgccaccaccaacaatggtcgttgcgtcagtcaatgagcctaagaattcgccaactttaagcgttccttgagcaaagttggacatttcgaacacacccattggaccattccaaacaaccgtctttgcatctttaagaactttttcaaaatcatcaattgacttaggaccaatatccagtgccatccagccatcatcaatgtcgccttcgacaactttatgttctgcatcgttattgaagctcttagcaacaatattatcgacaggaaggacgatcttgtcgccacccttttcaaggatgctcttagcaacatcaattttgtctttttcaactaatgagtcaccaactttgatacccttggcagcgtaaaatgtataagtcataccaccaccgatgataatcttgtcagctttgctcaataggttatcaataacaccaatcttgtcggaaacttttgcaccaccaagaatcgcaacgaatggacgttgtggattattgacagcttcacccaagaattggatttctttttccatcaagaagccagcagcaacaggcttgcctgatttgtgcattgcttcagcaataccaacgttagaagcatgttgacggtgagcagtaccgaatgcatcattgatgtattcatcacccaaagatgcccagtattcgccaagtttaggatcattgcctgattcgcgtttgacgtattctccatttacaacatcttcataacgtgtgttttcaacaagaagaacgttaccgttttccaacttgttaattgcatcttccagttgtttaccttctgttacaggaacaaaagtcaccggtttgttcaacaagtttgagagtcgttcggcaacaggacgtaatgaaagaccctttttgtcttcttcttttttaattcggcctaaatgagagaataagattgccttacccttatgatccaaaacaaatttaatagttggtaaagcagcctgaattcggttgtcatcaccaatcacaccatctttgattggaacattaaagtcaacacgcattaatacttttttaccttcaagatccaaatcagaaactgttaattttgccaatttagaagcctcctatacacaagatcgtttgtgattattaaaacatatacttagataacaaaagacggagaagacgccctctccgccgattgtataacttaattattaaagtgaagcaaacttcaacaaggtacgaaccatgttgcaagtgaagccccattcgttgtcataccaagcaacggtcttaacaagttggtcatcaccggcactagtaacctcagtttgagtaggatcaaatactgaaccgtgtggatcatcaatgatatctgacgaaacaatttcgtcagcattgtaaccaaatgcttcgttaccttcagtgtgcttcttgatagcttcgttaacttcgtctgcagttactttcttgtcaagaattgcaattaattcagttaatgaaccatcaacaacagcaacacgttgtgcatgtccttgtaatttaccagcaagttctggaataacaagaccaatagccttagcagcacctgttgaatgaggaatcgtgtttgcagaggcagtacggttattacgcttcttcttagtcttaggaccatcaagaatttgttgtgatgcagtgaatgcatgaacagtagtcattgtaccaactttgatgccaaattctttgttaataaagtatgccattggagccaagcagttagttgtgcatgaaccagctgaaacaataacatcgtttgagttaagtgtgtccaagttaacaccaggaacaacagtcttaatttgaccagcaggagctgaaatcaagacacgctttgcaccagctttgatgtgagcttgtgatttttcttcggatgtgtaaaaaccagtacattcaagaacgaaatcaacgccatcgtttttaacccaaggaaggttagaagcatctttttcagcgtatacaggaatttccttaccatcaacaacgatacccttgtcagttgaagaaacatctccagggaaacgtccatgtgttgaatcatatttcaaaagatatgccaacattgatggagtggttaaatcgttaattgcggcaacttcgatttcatcggagtgtaattcgtgaattcgtttgaatgccaaacgaccaattcggccaaaaccattaataccaatctttacagtcatactgtgttttcctcctttaggaaataagaaaatattaaatattatcagatagtacgaaactaatcgtaccactaattgaaaacaaagtcagcaccttgtgaataaaatctcaatcaaggcgcatcgagtaaattgaaatattacccaagtacgagtatagcagaccactgaataattgcaatgagttctacgctagtaaccgctttcactaattcgatttttctttgtcttgaaaaatccattaaattctagtatattggtatagtgagttgcattagaaaacttttttgcgcccgtagtgtaatggatcgcacgtaagattccggttcttgaaatgagggttcgattccccccgggcgcattaaactattcttcaaaagtaaaagagaccgaaccaaagttaatctttgatttagtctcttttttaatcatcaaacatcattcaaatctgtgaaataatcgtctacttgtaaacaactcgagatgaacgcttcaaaccttttcatacaaattaatcatcaacgtcatgaaaatcaacaccctgtttggcataaaagtcaataatagattgtttttgatccatgaactttggcggcaatgaaagctgagatcccatcgtcaaaatcgattcctctaaaccaaatcctggtgcagttgtcgctaattcgatccggttatccccaggatcacgaacatatatactcttgaaccaaccacgatcagcgtactcttctcgattaaggttcattttttctgccttatcccaaaaatcgaacaataccttttcactcggaacctgcaacgcaatatggtcaatacttccccggccaaaccgtgttcttacctcgggctgttggctcttaaataagtcgattgattcatggccttccaactcaactacattgtctttaactgtaatacccagccaatcatgaaagaacgatgcggtagctgtcgggtccggcacatgtaattctgtacccaggaagcgggcaatttgattttctgctggaatcccattatttggcactacccgccaatcagtcagacgttcaggtgtttctaacattttaatctcaatattatccggatcgttaaatttaagaccattcccaatttcggttacttcaataccttgatcatccaaacgatgatgccaataatccgtacttccctgtggaattgctaatttaatattattaaagaaatgtttcccatccgttcttctgccaagtaatggcaaaacaaaaaatgtcacaactgtccccggcgtccctaaataatcgccataaaataaatgcctaattctgatgttttcttgattaacactatttttgacaagtcgcatccctaaaactttcgtatagaaatgaacattttgttctgcatctcgggttaataatgaaatatgatgtgtttgcatattatatgcctcccggctagtaaatcattctaatataattgtatcatgaatgtatccgctttctaagcattgtgacgtttaagaataccaccgactgcaagtcacaaaacctttgattttaacctataacccgttttccataaacaagataagcaaactatttgaccttttttgaccaatcaactaaactgtaatcatgaacttggcaaaagccatctttcataaaattgataaggaggcatattcaatgaatttagtgccaaccgttattgaacaatccgctaatggcgaacgtgcttatgatatttactcacgtttgttaaaagaccgtatcatcatgttgtcaggaccaatcgaggatgacatggcaaatgcaatcattgcacaattgctattcttggatgctcaagactctgaaaaagatatttatctctacatcaactcacctggtggtgtcatcacatcaggtatggcaattttcgatacaatgaactttgtaaaagcagatgttcaaactatcgttatgggtatggctgcctcaatggcttccgttcttgcttcttctggagcaaagggcaagcgttttgcattgccacacgcccaagttttgattcaccaaccttctggtggtgcccaaggtcaacaaactgaaattgagattgccgctgaagaaattctcaaagctcgtaaaatgattaatgaactcttagcaaagaattctggtcaaccaattgaaaaaatcaataaggatactgaacgtgataactacttgaccgctcaggaagctgttgattacggtttgttggatggcatcatgacaaacagttctgagaaaaaataaattttaattaactacggatcgaaactgatccaactatttccgagaccaatttttgggcctcggtttttttatgctttttttattctgacgttgactcagaaaaatgactgttccgaaattcttcttgcgtgctgtactcttatcatcatcaagtaacgatcattgataaatcacattttaggacctaaaatgtacttgtaaaagttaaataagtaacaagctcaaacgatagttacttaaaacgaattattagtgatagataattcgaataaatcgcttgtgttctaacgcttaatcaatgaatagaggctaataagatgaaaaatacaatgacttcggataaaacaaaagtaattgaatcaactgaaaaagatgaaacgattcctaccgaaatgaaggcttgggaagttgttaagccaggaccgcttgatgccaatccatcgccactgaagtttacaaccaaaccagttccaactccaaagcggggcgaagttttggtacacattattgcctgtggtgtttgtcacaccgacttacacgttactgaaggcgacttacctgttcatcaggaacacgtcactcctggacatgagattgtcggaaaggttgttaagaacggtccgggaaccagccgattcgagcttggagatagaattggggtgccttggttacgttggacctgtggcgtttgtgaatattgccgagcaggtaaagaaaacctctgccccaattcgttatacaccggctgggaccacgacggcggatacgctgaatatgtgacagttccagaggggtttgcttatcgaattcccgaaagatttgattcaatgactgccgcaccgcttttatgcgccggcattatcgggtatcgcgcttttgaacgtgcaaatgtacctgccggtggccgattgggattatatgggtttggcggttccgctcatttaactgctcaattggcgatggctcaaggaatcgaggttcatgttctaactcgaggtaaggatgctcgaaaatttgcattggaacttggcgctgcatctgccaatggcgcctatgatcttcctccggtaaaattggattcagctattatctacgcccccgttggcgatattgtgccaaaagcacttgaagctttaaaaccaggtggtacgttggcaatggctggcattcattcaactgacattccacaactgacctacactgaacatattttccatgaaaagaacttaaccagtgttgaaagtaatacccgccgggatggcgaagaatttctaacattggcagacagactgaatatccatccagaaattcatgaatatccgcttgccaaagctgatgaagcgctaaaatatgtagctgctggagacattaagggtgcttgtgtattaagagtaagtgaaggataaaaaatagttaacaattatcttagtcacaaaacaggaggttgagacaacatatgttgtcccagcctcctgttttgtttttatcaaaaaatgtccattttcaaaaacttaaaatcaaaagaaaccgtcttaactacgcaatctggtcttcagctagcttgctggcaaattcattaatctttcttaatcgatgattaacacccgattttgagattggcccaccttcaactaattctccaagctctttcaaacttacttctgggtgcttcaaacgcgccctggcaacttgagccaacttaggtgctaatttgttaattcccataacatcatcaattaatttaatattttcgatttgtttgctggcagcattagctaccttatttaaatttgcgttttcgcagttaaccaatctgttcaccgagttccgcatgtcacgaacaattcgaatatcttcaaactttaacattgaactggttgctccgattaattgaagaaaatccgcaatcttctcggcctctttcaaataagtaatgtatccacttcgccgctgtgttgacctggcttttaaatgatacttattcatcatttccgcgatcatttcattgtggctttcatacaaagaataaatttccaaatggtatcgcgacgtttcagggttattaactgagccactagctaaaaaggctcctcgtaaatatgaacggatctgtgcatcgttagttaataatttttgtggcacccgttcaacaatttgaacgccatcaaagattcccagatcatttaagacttcagttgctttattttcaacacgtagaatatacaaattatttttcttcaacttcatctttcgacgaacactcaattcgccggtaataccgtaaaacttagaaagcaattgatacattcttcttgcaattgctggattttccgatgaaacatttaaaacaaaatggtgattggaaattgacagggatccgttgattcgaatcagcgccattaattctgctttggcattatctctgtgaaccgttaaagatgttagttcctttttaacttcgcttgcgtatgacattggaacaactccttactcttcgtcagtcgatcgaccaattaaattcagtaactcctcggcaacttcttggccattatgaaaggcaccacggtccttaagctccaagaagtcagcggaaataacccgacatcccattgcccgcaaacctgcaaaatcatgtttaacaggttgggaaacttcattccattttttgtaatcgatgtattcagaaggaacttctttcatattaactaaaacggtgttgatgaaattctttccgagatgttgattaagtacccgaacatgatcggcttccgtaaaattctcggtttcacctttttgcgtcataatattgcaaatataaacaatatcagcagttgtcctctttaaggcatttccaacattttcaatcatcaaattaggcaaaatacttgtaaatagacttcccggccctaatacaatctgatctgcattcatgattgcatctaccacttcatcaaccgcttcaggtttgtgggagtcatcattggtttcaacccaaacccgcctaattaatttaccagccgcagtaatctctgattcaccactcatatgactaccatcactaaattctgcatttaattcaagcggctcatttgcagcagggaaaatatgcccgtcaactttcatcatcctgctaagaatctgaacggcatcaaaaatgccgccacgcttttcagacaacgcagcaataataagatttccaatcgcatgaccggcaaagaactgatcactgctcttaaaacggtattggaacaaatccaattccaactgcggtaaatcagaaagggccaccattacatttcgaatatctccaggtggcacaacgttaatataatttcttaggattccggatgatccaccatcatcagcaacagttacaattgctgtgatgtcaacatgccggttttttaaattttttaagataaccggaaggccggtacccccaccgatcacgacaattcttggtcggtgcgtgtgcaatgcgtcaatcatcttagttttcccccttccctttatggcggtcaatgtctcgatgcgtaatattaaccggatactgtggatattgtttttgtaaatctttacttagtcgttgggcaatggcaactgagcggtgttgaccgccagtacagccaatggcaattgttaaactcgctttgccttctttctcatatccaggcaatgtgaaattaaggatatcaagtagtttatcataaaatgcctttgcgccttcagaatgcataacataatcaaagacagacttgtccagtccggtcttaaaccgcatcttaggatcataatatggatttggcagaaaccgaacgtccatgacaatgtcagcatccagtggcagcccatacttaaatccaaatgacatcacttcaacatggaaagtgtgggttgtatcagtagattcaaaattatgaaaaacctcttcacgcaatcgtctaggtgacatatttgtggtatcaacgaccaaatcagcagcctttttaacattctcaagtagttcacgctctttttgaatgccatcaatcacccgaccgtttctggcaagtggatgtgcccttcgagtttctttatatcgtgaaaccagcttggtatccgaagaatcaagaaaaataatatcgacatcgtcattctttttgagatcatcaaacattccgataatttcatcataaaaaacttgtgaacgcaaatcgattacaagcgcgattttattaatatcccgctccatccttactaactctttaaacttcggcaaaagtgtcggtggcatattatcaacgcaaaaatatcctaaatcttcaaagctttgcattgcaactgttttaccagcaccactcattccagtaataatgacgaattgattattcatagccatgttgaatgatgtcctttcgtataacaaactcatttgagtataacataccgggcgtatcattttaagcattaaatttttgcatgaccatcccagcctatctaaatgctttgactacagcattcaaacaaaaaaggagctgacaaaaagattgtccagtcccttttaattttatcatgactattactgagcaaagacgtacgaaaaaaggcaacttccagccgagtaattggaagttaaccgccttttatcccactctctattcaaaataatcactcatatgacatcattaatggtttgctgctttagcagccgacttttgtttcgctcgttccgtcaatgccttatcccgttccaaaacaggtttaagatattgtccggtataactttttgtgacttcagcaacctgttctggtgtgccggtcgccacaatttggccgccaccatcaccgccttctggaccaagatcaatcaaatgatcggcatttttgaccacatcaaggttatgttcaatgatgagtaccgtattaccattatccaccagcttttgcaggacaccgagtaatttacgaatatcctcactgtgaagaccggtggtcggctcatctagaatataaaagtttttcccgctggcttttttatataattcagaagccagtttcattcgttgcgcttcaccaccagaaagtgtcgtcgccggctgtccaagtgatacataacccaaaccaacatctttaattgtctgaagtttacgcgtaatctttggaatggcactaaagaaatcgagtgcttcttcaactgtcatatcaagaacatcggaaatattcttacccttgtattctacttcaagtgtttcagcattatatcgctttccatgacaaacttcacatggcacataaacgtctggcaaaaagttcatttcaatttttaagataccatctccatggcaggtttcacatcgaccacccttgacgttaaaactaaaacgaccctttttaaagccacgtagtttcgcatcatttgtattggcaaataaatcacgaatatcatcgaagacaccggtatatgttgccggattactcctaggtgttcggccaataggtgtttgatcgatattaacgatcttttcaatattcttataacccgatatggatttatattttccgggacgctccgaattatggtttagcttctgagccaacgcctttttgagaatatcgttaaccaatgttgatttcccagaaccggaaactccggttacaacaatcaattcaccaagtggaaaatcaactgtaatatctttcaaattattttgagcagctccggttacacggacttttttgccattgccagtccgccttttttcaggaacaggaataaatcgttttccagccaagtactgaccggtaattgattgaggagcagcagcaatttgatccggtgttccaacagccatgacttttccaccatcacgaccggcacccggtccaatatcaacaatgtaatcagctgcacgcattgtatcttcatcatgttcgacaacaatcaatgtatttcccaaatcacgcatctttttaagtgacgcaattagtcgatcattatcgcgctgatgaaggccaatcgatggttcatccaaaatatagaggacgccggataggttggagccaatctgggtagcaagccgaattcgctgtgcttcacctccggaaagagtcctagctgatcttgacagagttaaataatccagaccaacatttcttagaaaggtcagccgatcaacaatctctttgataatcggttttgcaatcatcgtatcttgtgggccaaattttaggttttcgaaaaaattgagttccgcagatacatccaatgcagaaatctcagcaatatttttgccatcaactttaacagctagtgccttgcgatttaaccgataaccatgacaagtctgacaagtcagttccgtcatataaccgctcaaattatttctggtaaaatcactgctggtattgtggtaacggcgatcaacattattgataacaccttcaaagggaccgtcaacatctcgaataccaccaaagtcactttccaaagtaaagtgaagtgactttgttttagatccataaaggacaaaatcgcgctgtttctttggtaacttgttaaatggtgtatccatgtcaacaccttcagccttgcacgcttgtgctaacatattcggataccatttggacccagtcggactccaaggggcaagcgcaccttcgttcaacgtttttgtcttatcagggacaaccaaatccggatcaacctctagtttcattccgagaccgtcacaatccgggcaagcaccaatgggagaattaaacgaaaacaaacgcggctcgagttctccaacagtaaacccacaaattggacaggaataatgctcagaaaaaatcatctgatcccgttcgcctaaaaagtctgcaattgcatatccaccacttaatctaagggcagcttccagagaatcggataaccgattattaataccatctttaatgacaattcgatcgataacaatgttaatatcatgctttttatttttgtccaattcaatggaatcatccacatcgagtgtgtctccatcaacctgaacccgaacaaatccttcacgtttaattttttcaaatacctttttatgctgaccttttcgtccgcgcacaattggtgaaaaaatctgcatctttgtccgttccggaagctgcataatttgggcaatcatctggtcaacagactgactggtgatcactgtcccatcattaggacaaatcggtgtcccaactctggcccaaaggagtcgaaagtaatcattgatttcagtgaccgttccgactgttgaccttggatttttcgaagttgtcttttgatcaattgaaattgccgggctcaacccctcaatcgaatcgacatcgggtttatccatctggccaaggaattgacgggcgtaagaagacaaactttctacatatcgacgctgcccttccgcatataatgtgtcaaatgccaacgaactttttcctgacccggataagccggtcatcacaaccagtttattcttagggatcgtcacgttaacgttctgtaaattatgtgcacgcgcacctcgaattataatcttatcattcaccaaattttttctcctttagctgatctgcgcctttaattccataatcgtgtcacgtagcgttgccgcttgttcaaaatcaagctttttagcggcttcacgcatttcatccgtcaaacgggccaacatattcttttgatctttggtactcatttgttcaaagtcactttcgacaaaatcatcttttttaccggcatcactactggatttagtaatcgagatagcatcacgaactggtttgataatggttttcggtgtaatgccatgctctttattatatttaatctgaattgcccgacgacgcgcagtttcatcaatagccgccttcattgagtccgtgacagaatccgcatacataataacggcaccatgttcatttcgagaggctcggccaatcgtttgaatcaaagatcgttcatttctcagaaatccttctttatccgcatccaaaatcgccacaagggaaacttccggaacatcaatcccttcacgcaacaaattgataccgactagaacatcgaatttgccgagtctcaggtcgcgaataatttgagttctctcgagagttttaatatccgaatgaagatatttgactttaatgcccaaatcctttaaatagtccgttaaatcctcagccatttttttagtcaaagtggtgacaaaaacccgttcatgtttatcaacacgtttattaatttcaccgaccaaatcgtccatttgacccataatcggtcggacatctattgtaggatcaagcaaaccggttggtcgaataatttgttgcacaacatctttggtttgatccatttcatatgggccaggcgttgctgacatataaatgacctggtgaacccgcttttcaaattccggcaaccttaacggccgattatcaagtgcactcggtaatcgaaatccatatttgaccagttgctcttttcgagccttatcaccattatacatacccctgatttgaggcattgtttgatgggattcgtcaactacaagcaggtaatcatcgggaaaaaagtcaagaagtgtaaatggtggttgtcccggctttcttcgatccataaaacgagagtagttttcaataccactggtatatcccatctcacgcatcatctcaatatcatacgtcgtcctttgcttaagccgttgagcctctaacaattttccttctttttcgaatttagaaacctgactatccatttcctgctgaatttcaggaagggccaacttcataacatcatcatttgttaaaaagtgggtggccggaaaaatcgcaatgtgctcccgatcaccaatgacttcacccgtcaaagtatcgacttctcgaattcgatcaatctcatcgccaaaaaactcaattcgaaaagcatgctcatcccaagaagccggaaaaacctcaactacgtctccgtgaaccctgaaacgaccacgttgaaaatcgatatcgtttcgatcatattgaatatcaaccaattgacgcaatagatggtccctttcaatattttgtccaactcttagtgaaacaacgtggtttcgatactctgttggatctcctaaaccaaagattgacgaaactgaggctacaacaatcacatcattacgttccaaaagagaactggtcgctgaatgtcgtaattgatcaatctcatcattaatcgaagaatctttttcaatatacgtatcacttgaaggcacgtaggcttctggctgataataatcataatagctaacaaaatattctaccgcattatgtggaaaaaattctttgaactcaccatacaattgtccggccaatgttttattatgtgataaaaccagtgttggtttgttaacctgtgcgataacatttgaaatcgtaaacgtcttaccggtcccagttgccccaagtaaaatttgtgctttttttccatcatcaacgccgtttactaacttttttattgcctgtggttgatcacccgttggttggtaactagatactaaatcaaatttatggttattttctctttcgatcaatcaaatttccccctgactgaacttcggaatacttaaaaagattaaaaaaggcacggacaatttcaggttacgcccgcccttgagataactgtacaaaaaacaaatacaacagcttgctttgatacttgctcaatcaaatcaacattgacacttcttcataagacattttaccatacgaacatactttcgcaaaccattatttaccggaattttcactttttagaacccgcctggttaattttctcaatttctcttgagtcgtaaagttttcatccagcatctccggaatgacttttgaaacaacgtattggacacagtgcatatcgcgatactgcagcatcgttgataaactttctttatacatttcaggataaacctcttcaggattccccttttgaatttcaccaaatgactcatagagtaaatccactttatcggcaaccgctaaaaccctgccttctaaagtatcatctttaccttctgaaagtcgacgacggtatgcatcttggaattcagatggaatttcattttgaataaagttttcggttagcttatcatccacatctgccagcattgaacgaagcactggcgttgcatacttaacgggtgtcttaatatcaccaataaagcgttcggtataatcatgattcaatgctttttcatacaataaacgccaattgaccgtttcacctgcattttcttcaacatctccaagaaattgtgcaatctcagctaccttaaaagagtgggccgccaccgagtgttgttcaaacttaaaatatccaggtgcccgattaatcaattccaattcagctaaactttccaaatattgatgcatccccataagtcaattgcctccatccagttcatttatttttctttatactaaagaaggccgagaaaattatcccgacctcctttctgttcatatataaatcatatctcatttaaacacgaattcaaaatgaaacgaagtcttaatgcgatacttctgtttgtccttttgaactaagtgcttctacatatttaaaggcttgttggccagcaataccgccttcaccaacagccgttgtaatttggcgtaaatccttttgtcgaacatcgccaattgcataaatgcccggaaccgaagttgccatctgattgcttgtcttaatccaaccatcagcatccgtaatatccaagttagcaaacggttcagtcatcggcaataaaccaacataaataaagacgccggaagttttgatttcagactcttcattggttttattattgacagttttaaccgcggtgacctttttatcatcaccgagaacttcagtcacattagtattccaaacaaaatcaattttatcgtttgcaaatgctcgatcctgaatcacctgttgtgcccgaagttggtctcgccgatgaacaaccgttacatgatcaacaataccagctagatacgttgcttcctcaatggcagaatctccaccaccgacgaccacaacgtttttattcctgaaaaaggcaccgtcacacacggcgcagtatgatacacctttaccaccgtattcatgttcaccgggaatgcctaatttcttatactctgaaccggttgcaataatgacaacctttgcttcaatctcttcactatctgttttgacaattttgacattgcctttatcctcaatagattcaactgaaccataaacatattcggcaccaaaattaaccgaactgtcgtacatctgttgagcgagatccggacccatgactgatttaaagccgggatagttttcaattgccgccgtattgttcatttgaccaccataaataccgcggtcaatcattgcgactgataaatttgctcgggatgcataaagcgcggctgtcatcccaccaggcccagcaccaatcacaacgacatcataatttttagccatttggatcctccttgtctttcaatgaattacaactaccaatttactatgaaaaagtaagcctgtccagcagaaagattttactttttctgtttcatatcttcttcacttaattgtttgccaagatccttcaaataggtacgtaatccacttgaaatctctggatgctgcagaccaaaaataatgttagtctttagccaacttaacttattaccggtatcgtaacgtcgacctttaaattcatgtgcaaatacccgctgtgtcttgtttagcgtatcaatcgccgaggtcaattggatttccccactggcatcaggttttgcattttccaaaataccaaaaatttccggggttaacaggtatcggccaataattgccagatcacttggtgccttttccggcgatggcttttcaacaaactttttaacattgaataaccctggctgcacttcttcggatggatcaataacaccatattttgaaatatctttatgggctacccgcttaacagccaaagtcgatgcaccggtttcctgatagctatccatgagctgcttggttaaaggcaccttatcttccatcacatcatcgcccagcattacaacaaacggttcattgctgataaaacttcgagcggtataaattgcatctcccagcccccgtggatgtgattggcgaataaaatagatgttcatatcattcgttttacgaatgctctctagcatgtccgtcttatgacgttcctcaagattttgctcaagttcaggattagcatcgaaatgatcttcaattgatcgtttacccttaccaatcacaatcacaatatctctaataccggatttctttgcttcttccacaataaactgaattgtcggcgtatcaacaattggcagcatttcctttggaagagccttggtttccggtaaaaaccgagttcctaatccagcagccggaataacagctttggttactttcttttgcatttatatacctcaacctttctaaaaattagtctttttaattattctatttctgaacgaccttcccgggtcattaattgattgattgtttctttaatatcagcaccatcatataaaacgtggtaaatggcacttgtaatcggcatttcaacgccgcgtttcttggaaagttgatacgctgcccgcgttgttgcaatgccttcaatcaccattcccatgtttttgataacctggtccagtgattcaccacgtcctaattcattaccagcacgccaatttcgagaatttgtacttgtagcggttacaataatatcaccaacgcctgataaaccgataaaggtaagtggattagcgccaaatgatgttcccagtcgagaaatttccgctaatcctcgggtcatcaaggccgcttttgcattgtctttatatcctaatccatataatgcaccggcacctaacgcaatgatattcttaagagcagctccgatttcgacaccaataacatcatcacttgtataaacccggaaataatgattcataaataaatcttgaatctcttttgctgccttttgattatcgctggcaaccgtgactagtgtaatgtccttagtaacaacgtcttcagcctgacttggacccgataaaacggaaatcgattgacgattttccggggcaatctcctgtgcgagcacctgtgaaaggcgcagatatgttttctcttcaattccctttgaagcatgaataatattaacccattgatgacgttcctttaagatttctgccacttggtgggcaaccgatctggttacctgagttggcacaacaaacaaaatatagtcaacgtcttcaatcgcttcgcctaaatcattgtatgctttgattgaatcagagaaagtaaagtttttaatgtatttggtattggtatgggattcattaaactccttaacctgttccttattatatgaccataattttacatttgatccattttcatcaaggatacttgccaaaacgcttccccatgatccagctccaagaaccgcaatttctttagtcatcattattctccttttttattggtaaattaaaaatcaacattcagcgtattcccttccaggtaccatggattcacctgatcacgacgtcgatagatcgctagaataatcgcgccaacgaacaggaagatcgacagtatttgtgaaacccgtaagttgaacaacatcaaactgtctgtccgcattccctcgataaagaaccgtccaaatgaataccacatcacataacccaagaaaacttcgccctgcttaaataaataagggttatgccgtaacgttattaatactaaaaatcctaaaaagctccacaccgactcatataaaaatgtcggttgtcgatatgcgccgctgatatacatttgtgaaataatgaaatgcggcaggtgaaggccttgaagatacgctaaagaggttattttcccaaatgcctcttggttcataaagtttccccaacgcccaattgactgagccaaaataaccgttggtgcagcaacgtcaagcattaaccaaacagggataaaacgtcgacggcagaaccaaataaccacgatcattgcaccaatcaaggaaccataaatggcaataccgccatcccaaatttgaatgatttctccgggattatctttgtaatacgaccactgaaagataacgtagtatagccgagcacagattaaagcagccggtaatgcccacaaaatcatatcatagatgtcatcgggcttgataccacgttttttaccttccctgacagccaaatagaccgctaaaataacaccacaggcaataataatgccataccaatggacttcaatcggtcctaaatggaaggcaattgggtttaaagccaaacttttaaaactaaacaatatgggcactcctatttcttcgaatcaggtttttttgatgttttcccgattagatccttattcttctcttcaacattcttttcttcggctttttcttttgcatcactggcactattagccttaattaagttattcaaattacgatcaaaggtttcagttgcgtcatagcccatcgattgcgcacgaaagttcattgcagctgcttcaataataatggccaaattacgaccggttttaaccggaatggtaatttttggcacattcacatcaaagatatgaacattttgtgtgccatttccaagtcgatcaaattttgcatcctttgtgtaatttgccagatgaataattaaatcaaccttggtttggcttctgaccgcacctgttccaaaaagcgtcataacatcgataatcccaattccccgaatttcaagaaggtggcgtaaaatagccggtgccgttcctaccagcgtttgctcatcctgctgatacacttctaccctatcgtcagcaatcaatcgatgtccacgtttcacaagttccagggccgtttcacttttgcctataccactatcaccggtaattaaaatccccaagccatagacgtcaaccaagacaccatgaagggattttctttcagccaatttatcttccagataattggtcatattgcttaaaacccgtgacgttgtcagtttcgatcccaacaccggaatatgctctaatttagcagcctcaagcaattcttccggtgggtcaagctgtgtggaaataacgaaagctggcgtttgcggttgacacatttttttcataacgtctaacaggtttttgtgagacattcctttagaatacgaaatttcagttattccaagtagttgaattcggtttgcaggataatagttaaaaaaacctgttaattccagaccaggcctggatatatcactagtagaaattgacttactttccaaatattccttaccataatatacatccagtcgggtattggcaactaaatccgctacactaacactttcagtcaagaacatccctcctcaaataatcactataattttatcacttttatatacgccacgtctttaagagaatgaggaaaacaacaaaatgttttagttaattagctacgatttatcaaaataactagcgataataacactcacaactgacattaaaatagcaataaacatcgctgtccaaaacgaggaaaactgaaagcctgctccaacaatcctcgaggtcagttccaacatcaatccattaatcacaatgccaaatagccccagggttaaaaaattaattggtaaagacaaaataatgatgataggtttaaccaaccagtttaatacccccaataccaatgccgcaatgaccgcaatttcaacgctcgaaacatataagctgctaggaaagaaaccgctaattgccataaacaataaagcgtcaattaagacagttgataggaatctcacagttagcctcttttcttgtcgtgattaacatcttcttcctcaacaccgtgaatcacttttcgcgattttttagaagaatcctgatttttgtaagttgatttaagctgattaaaaaatgatacgggcgcattttcagccggaataatcgcaatcataacaatataagccagaattgccaccagaccaacacctggagtaaacatcaaaataatgtatagaatacgtaccaatgttgaattccaatcaaagtaagcggaaatgccaccaagtacaccagctatccaacgatcctcagacgatcggtaaagcttctttttatcactcatcgaaaagcctccactataaattgactcttaaattaagcgtatcaaaaaaaacgccgcaatcaagtatgccgcgtaaaaaaatatgcttttttaatttaattcgataatttttccggttgccaggtaaattgtccactcacaaatgttggtactgtaatcgctcactcttgaaagatccttggcaacattaagatagataatcgcagagttaacaatttcaggatcctttgccatcgcctgataacttggagcggcaatatcattataatgtttttcgataactttatcgtatctcttagcagtttcctttgccttatcttgatctgcctcaccgtaagaactgatagagtcatcatattgttcacttacatctttagacattgacgcaataatagattcaactgttgcaattcgcggttgacctttaatactgagcgtggaccgcgcaatatttcgtgcatgatccccagcccgctccaagtctgtcactgcttttaaaataccgacaacttcacgcaaatcacccgtgaccggttgataaagggcaatcatttcaaaagaacgtttttcaatatggatctgcaaatgattaatcgcgtgatcatttgtaaccactgtttcagctttatggatatcatggtcgataaaagcctgccccgcattagcaacagcctctccaaccaatgccccaagtttcataaaatctgcctttaaagtaactatttcttcgtcaaaaacctttcccattaggtcatcccctatccaaatcgaccactcacataatcctctgtctgcttctcatcaggattaacaaacattttcgtcgtatcatcatactcaatgattcgaccttccataaagaatgctgttttatcagaaattctggaagcttgctgaagattgtgagttacgattataattgtatagttcttttttagttcaagtagcgtattttcaatatttgcgctggaaattggatcaagtgcactggtcggctcatccattaaaataactgacggtgaaactgccaaaaccctggcgatacagattcgctgttgctgccctcctgaaaatgaaagtgcattatcatacaaatgatccttaacctcatcccaaactgcagcctgtttcaaacttcgttcaacgatttcatcaagcttttgtttatctttaacacctgcaattctaagtccataagtaatattatcataaactgagaatggaaatgggtttggttgttgaaaaaccattccaatttcttttcttaaatcaaccaaatttgtttgcggcgaataaatattctgctcatgaaacttaacagtccctgtaattgtgacaccatctatcatatcgttcattcgatttaagcatcgcaaaaaggttgactttccacatccagatggtccaattagtgcagaaatctggttgggattaaaatctaaatgaatattgtgcagtgcttggaaatcaccataaaacaaatcaagattatttgctgaaataattggctcagacatcaaattgcctcctatccaaagttgccagaaacataatcatcggttaacttaatttttggtctggtaaaaatcttcctggtcttgttatactcaattgcctctcccaaattaaagaagaccgtgtaatcacttaaacgcgcagcctgttgcatgttatgggtcacaatgataatggtatagtttggttttaattctcggagtgtctgttcaagttgtgatgtcgacaccggatcaagtgcacttgccggctcgtccaaaagtaagacatccggtttaacagccagtgcccgcgcgatacatacccgctgcgcttgaccaccggataatgattgtgcacttttatgaagactgtccttaacctgatcccaaaccgcagcctgtttcaaagttgtttcaacgacctcgtccaatacttttttgtcatgaattcctcgtctttgcagggcaaatgtcacattatcataaattgatttagcaaaaggattaggacgttgaaacaccattcctattcgacgccgaacctcgtagacgtcaatcccgggttgattaatattaacacccttatacaggatttgtcccttaaccgttgcgacatcatcattcatccggtttaaagaacgcaaaaaggtagatttacctgaacctgacggacctattaaagccgtaatggtgttctttttaaactgaatgtcagcttgatgcatcgctaaattcttaccatagtatatttcaagatccttagtttgcatgtcaatatcattttcttcgggatcaaagtgatagataaaccgttcatgattgtttgtatcaaattgcatattgaattctcctagttcatcgaagtcattttctcgaatacctttcggccaatataacgtgctgaaagattaaaaattaaaattgccaaaaccaagaccgctgcagaaccggatgaaacctgggttaggtcaggcataatcccttcagaattaattttccaaatgtgtacggctagtgtttcggctggacgcaaaggacttaacggactgtcaatgttgaacggattccaatcgccaaaattcaatgctggtgcactctgcccagccgtgtaaattaaagcagcggcttcgccaaaaactcgtccagaacaaaggatgaccccactaataatccccggtaaggcagcaggaacaacgatatggataatcgtttcgtattttgatagtccaagtcccaaaccaccctgtctctgatcatcagcaacgcttgccaatgattcttcaatattcctggtaagcaaaggtagattaaaaatggtgagtgttaaggcacctgaaataatcgaaaacccgaaattataatgaacaacaaataacaggaacccgaataatcctacaacaacagatggtaacgaacttaaaatctcaattgatgtccgaatcattgatgtaaaccaattatcttttgcatactcgtttaaataaattgaagcccccaacgcgatcggcagtgaaatcaacattgccaaaattaacaagtaaaaagaattaaacaattgaacaccgatgcccccaccggaactaaatgccttggccggagatgttaaaaatttccaactaacgtttggcaaacctgtgataaaaatgtatccaatcaaaaatgccaggatcaaaaccacaaaacctgcaattgcttttaaaacaattattgcaatctgactttgtttctgcactcgattcatttactaaacgcccctttccgaccaataaaatgtaccagtaaattaaacagcaacgacatcaccagcaatacaagagcaagcgaccaaagcgcgtcattctgcatggatcccatcaccgtatttcccattcctgcggttaaaacagaagtcaacgttgaagctggtgagatcaggttatgcggcattaacgacgcatttccgataaccatttgcactgccaaagcctcgccgaacgctctggccattccaaaaacaacagccgtcaaaattcctggtgttgcggctcttaggacaactttccaaattgtctgccacttcgttgctccaagtgctaaagatgcctgacgatagtatgttggtaccgatttaagggaatcaacagtcatagacacgatggtcggtaaaatcataacaaacaggacaaacgttcctgaaaggattccgaaaccactcccgccaaacacatttcgtacaaacggaacgaccacggacaagccgataaatccataaacaaccgatggaataccaaccagcaattcagtaaccggctgaagaattttagcgcccctcttcggcgaaatttcagtcatataaacagccgttccaatcgcaaatggtgttgaaatgacagcagccaaaatagtgactagaaaggaaccgagaatcattggtaaagcgccaactgctgcgtgaccgtcaggtgtttttgtcccgggattccataaggtgcctgtaaagaaatccttcatactgatatgatcctttagaaaggtcgacataccctttgttgcaataaacaaaataatcccaatgacaatcgccataattagcaaaagtgcacagagacataaaaagcggccaaagcgttcataacgtgctgttttggactttttaaataattgttttgccaacttttgatcttgcattattctacccccgatccctttgaaatcttaccctgccatgttcgttgataacgcatatcctttacagaaatatagccaagcttattaaacagtgttttttgaatatgatcgttctgaaggtaatgaaggaatttcttagttagaccggttggttggccatttgtataaatatgttcataagaccaaattttccaatcattatccataacatttcgctcagtcggtttaatgccgttaatcgtaattggctgaacagccttgtttacatagccgaaagacacgtagctaatcgcaccaggcgtcgacgaaacgatttgacgaacggtgccggatgaatcctgctcttgggctaccgcactttcacggccatttagaccgtattcttcaaaagtcacccgcgtaccgcttccctgggttcggttaataagcgtaattggtaggttcttcccaccaacctgccgccaatttttgacttttcctgtaaaaatcgcaatcaactgcttggatgtcaatcgatggataccgacttttttattaacaattggcgtcacaccaaccacggctattttatgatcaactaatttttggggattaataccagctttttcctgggcaaataaatccgaattacccatttggaccgcgcccgattcaatttgactcaatcccgtcccagaaccgccaccttgtacattaataaaaatgccactatgttcggccgagtattcttcactggcagcttctactaatggctgcaatgctgttgatccaaccgcggtaattgattgttggttggttgcctgcttacttcgggtagtgtacgatccaatacctgcaaggataaccactgccaccagtaaccatttaatcattcttcgtttctgcatccgcatttcctcctcaaatctccactactaattgtattaaatcaatgtaaaaatttgatatttgaaatgtaaaagttttgtaaataaatcacggggtgtcttatctaaaaaagcgggtctgtcaaagcccgtcataatcgaaaaagattagtttatggcatatgtatgaattaccaaaactaatcttttttataaataatctttaacttgatttgataaacggacaaaaaggcttatgtgttatagtcaaattacttatcgacttgcgcagtttgtgactcatcgtttatcgggaattcgactgtaaaagtcgatccgacaccacgctgacttttcacatgaatcacgcccccgatagaatcaactaactctttaacaattgccaagcccagaccggttccgctcaccttttgcttggttctggaatcgtctgcccgataaaaccgttcaaacaatctggaaatatctttttgcgcaattccgattcccgtatccaccacgtgaagctgccaaaaactatcattggcagaatatttaacagtcacacttccaccagaccggttatatttaattgcattactaacaagattttgtaaaattctggtcaacatctgcgaatcaacgcttacaactgcatcttgtggtacctcatcaaccaacgtgatatcacgaacctttgccattgaagaatatcctgtcaattttgcgtcaacaaatttcttcaactccaatgcctgtgaatgatgtggcgttccgttctgaatatgtgaaatcgtcagaacatcttgaatcaatgaagtcaattgtgtactttgctgatcaataatttttaaaaactcaaccaacgtttttcggtcatccattgcaccgcccaacagtgttttcgcaaagccggaaatcgccgtaactggcgtttttaattcatgactggcattacgcaagaaatcaatctgcatttgtttaacgtttataatgtctgaaatatcatacataatcactgagatatggtaatcattttctaactgattatagacaacgcttgtgtcccaagttgaagaatgatccccgacacttctaatttcagtctgttgagattcatgatcttcaaaaacccgttcaatgagtgaaagtaactgataattcctaatatcctgtgagtacgaatgtggttgattcataatatttctctgaagcattgaggccattttatgatttgcaaatatcacgtcttgactggaatcaatgaccataattccaacaggtaagcttgaaagaattgtgacaagttccgtattactatttttaatcgttttactttcgtcctgttggcgagattgaagttcagttaactggtcagcaatttgtttataaggattacccggacgaataaataacggtgctacaggttgatgggaaacaatactttttgtcatatattccagttgtttacggattttctcgttctttcgaaaatccaatgtcgcggtcacaatcgctactgttaagcaaaaagaaagaacaaatgccaaaaaaataaggtcacggttatctctagcaaacccaaaaaagagcattaaaaaagtaacactactcagccctaaaataattaggatttgtcgatacgctttactcagcgtcatcgcctcctgttgagaactcataaccgaacccacgaatagtttttagatacttgggacgtttaggatccgattcgattttttcacgaagatgtgcaatttgaatatctaccatacggctttgacccgaataatcaaatccccaaacaccttgcaacaattgatctctacttagtacttgattttcgtgaccgacaagatattgcattagttcgaattcttttggtgttaatttcagattttgatcattgacactcactttgtattgcttatgatcaatcgtaaacggaccagttgtttctatgtctccacttttaactggtgcagcattttgttggcttgaaggctcgcttttttcatatcttctcaagacagcattaattcgggcaatgacctcccgagggctgaatggctttggtacatagtcgtcggctcccatttccaagccaaaaaccttatcaaattcagtatcttttgcagttaaaacaatgactggcgtatcgtttctgtccattcgaattcgttttaaaacttcttcaccactcatctctggtaacattaaatcaagtaaaacaatgtcataatgattattttcaatcattgataacgcgtcagcaccattagttgcgctttgaacgtcaaaacttgcttgcttcaaattatattcaagtaaagttacaattgccggttcatcatcaactactaatacttttttcaagggaagatcctcctactgtgtgtttactcaacagactgcgtatacgttttaaccccgatttcatgaggcgaattcttaaaaattgccgattccgtcatttttaattgatcatgacgatcccgaaccttaaaacgacaatatgtcggactcgtggatagtgcccgataaaattgatcatcattagaaacttggatatcattaaccgtcaaaataacatctccaaccgataaattcatttttgctgccggggttccaggctgaatgccaataattcggatgccatccataacttcactgtactcaaattgttgctttcgatcccgatgcttcacaatcaaaataacaccatagtaacaaatcattaaaaagatcatcgctggcaaaacgagtttatgattaaaagcagctccgataaccattaaaatgcccaaaccggcgactaacatcattaactttcccaagttcctaaagaattcccgaggggtgctttttcgcactgttaattttaaaccaattaaaatcggcacaattaaaatcacaaatgaatggtgattaatttgaaataccggaagaaagcccaacccaattttaaaccagtctccaggcagcaacaagagtagcggaaaaatggttaattcgttaaatggataaacggcaactttgttatttcgtttgtttcgcgaaatggctggcgaatcaaatcgaccggcgtttgcccgcacaaataatcctgttgcaaaaatgactactgccagaattgctaaatagtttaccgggttaacttggtgacttgaaatttccatattcacaaaccacttttcaataaaattaaattgtgtcatttgcggtaataaaagtgataaaatgcctgcagctccaattaaagtaacgcctaagaattgccatggaatcagtacgagtgcgattaagcagagtccctcatagagaattagccattgaagagatgtcattaataaggaacccaaaacgacagaaaaaataacgccaatcattaaaccacttctgacaaaatggcgtccttcgtaaaagtcctcgtaaatagcagaattaaaaattctgcgttctcgtttaacacgattcgtatgtatcaaataagctcgaacaactccgacccacaacataggttgaagaacatagaaacaaattgccaatagaaatttcataaatttttccctcatccgttattatggtataagtatagcattgattaattaaaatttgaaagccagctaagtaaaaacaatccactgaaaagatcggttaggatagataacagttgttaaaagggtctgggcaaaatgtgtctttgcccagaccctttcgaacctaatttaactctatattaagtcgatattatttaaacaatgcgcatttattccgggttgtccttacttaactgccattgcaggtaagcattaataaatggatcgagatcaccatccatcacaccattgacgttggccgtttcataatttgttcgatgatcttttaccattgaataaggatggaagacatacgagcgaatttgagatccccagccgatatccaactgctctccttcaatttttgccttttcttccgcctttttctgttcctctaattcataaagttttgacttcaacatgtttaaagccgtttgtctattttgcaattgggatcgttgtgcttgactggcaacgacaataccagtcggaatatgagtaattcgcacagcagatgacgtcttgttaacatgctgaccaccggcaccgctcgcacgataaacatcaacttttaattcatccggactaattttgatagaaacatcatcatctagttccggcatcacatccactgaagcaaaagaagtatgtcttcttccggcagagtcaaatggtgaaattctaactaatcgatggacacccttttcagatcgaagataaccatatgcattttcaccattaatcagtattgagacactgttaatacctgcgacctcaccaacttgataatcaagtacatcaaccttaaaatcgtgtgtttcggcccaacgagtatacatcctcaacaacatcgaaccccaatcctgagcttctgtaccgcctgctccagggtgaatttccaaaatggcattattatgatcgtacttgccattcaataataatcccagctgatacctatcaagttgcttttttagtttatctgcctcgccaataaactcatcttgcattccggaatccgggtcttcggaaattaattctaatgtaacctttaaatcatcaagctcgttggttagtgtgtcaaacctgtcacgctttgtttttaattgattcgtctcgtcaatcagtttttgagccgcttgctggtcatcccaaaacccgggttcagccatctttgcttcattgatacttatactttcactcagcgcatcaaagtcaaagagaccccctaaagccatcgatggctttttgcatatctgcgatttgtttttttgcttcacttaattcaaataccatatttatgcctcatttcaaatcaaatttttttaccgaacaatcgtcacaattgcaaaagaagttgagacaaaaatgaatttttgcctcaacctcatcgcttaatttcggacaatcacaactcttaaccgccatttgagcggatagtcttgtttctaagccgaaacaatttgtcattatctttgcatattttgacgaatttctgccttcatgaagagtcgagttgcatcatagtcaatatctgcaatcatttcttcaaacattttatatccttcacgttgatactcaactaatggatttagttgaccgtacccacgaagaccaattgactgacgaagttgatccatcatgtcaatgtgatcggtccagtgagaatcaacaactcgaagaataacaaccttttcaaactcaagcatttgagattcatcataaagctgtttttgtttttctttataaaccgaatttgcaagatccattaacatcttcttgatttcatcggccgtcttattttgaaaatcctcaagtgaaattttatcaggacttaccattgcgctaatcgcaaagtcaagaattgtttggagatcccagtcttctttttcaccttgagtatgcaaatcaacaattcggttaacagtccgttcaatcatcggtataataacccacttaaggtctttattttcctcaatgacttcttgacgttcaccataaataacttcacgctgttgacgcataacatcatcatactgaagaacgttcttacgagaatcatagttgttaccttcaactcgtttctgagctgactcaacttgcttggtgatcatcttggaacgaataacagcatcttcaccttcaacgtttaaatgctccaagaagttcttgattttatcagaaccaaagcggcgcattaaatcgtcttcaagtgacaaataaaattgtgacaaaccaggatcaccctgacgaccagaacggccacgaagctgattatcaatacgacgtgattcatgtcgttcagtcccaataactgctagaccacctaactccacaaccccgggtccgagtttgatatcggtaccacgtccagccatgttggtagcaattgtaacagcacccttttgaccggcattcataacaatatcagcttcttttgcatgattcttagcgtttaaaacaacgtgaggaatttgttcctcatcaagtcgctttgaaaggtattcggaagtttcaaccgcaaccgtaccaattaacatcggctggccctttttatggagttgcttgatttctttaacaactgcatcgaactttgcgtccaaagttgggtataaaacatctggatggtcgactcggacaaccggtttgttggttggcacagagataacctccatgttataaatctcacggaattcctcagcttcggttttggcagtacctgtcataccagcaagcttcttatacatacggaacatgttttgataagtaattgttgccatggtcttactttcctcttggatttcaacgccttctttggcttcaattgcttggtgaaggccatcagaaaaacgacgcccctgcataatccgtccggtaaacgagtcaacaattaacacttcaccgtcctgaaccacgtaatccttatcccgcagcataatgaagttagcacgtaatgcttgatccaaatggtgggtcaaagctgtgttatctgtatcatacaaattttttaagttaaagtatttttcggctttttcaattcccttatcagttaatgaaaccgtcttagtctccaaatcaatcttaaaatcatctttttcgtgaagcgtcttagcaaatcgatctgttcgctgatacaactcggaagttccagttgattgaccagaaataatcaatggtgttcgtgcctcatcaattaaaatggaatcaacctcatctacaatcgcaaaattaagtgggcgttgaaccatttcttctttgtacgccaccatgttatcacgcaggtagtcaaacccgatttcactattggtcgagtaagtgatgtcacatgcataggcttcacgtttttgatccggtgtcatttcggctaaattggcacctacagttaaacccagccaattgtacagctcacccatttcagtcgcatcacgttgagataggtactcattaaccgtgacaacgtgaacgccttctcctgcgagagcattcaaataaacaggcattgtcgccgttaacgtcttaccttcaccagtcttcatttcagcaatattaccctcatgaagcacaattccacccataatttgaacgtggaatgggtaaagcccaagaacccgacgagcaccttcccgagcaacagcaaatgcctccggaagtaaatcgtcgagtgtttcaccatttttatagcgttctttaaacgccggtgtcttggcttgtaattcttcatcgctgagttgacgatactcgtctgcatataccccaacttcatcagcaattttgcttaatcgtttgagttcatgcttgtcgctttcaacccatttttttaaaagattagccattgaaaaattcccttctaaatcagttattcattttaatgtctttatcgtattaatcaactacatacttgtttattgtaacattcaaggccatcaatgaaaacaccttgataacatttacagcattcgtttatcataatacttttcaaatcaataggaaagagtgaacttcgaaactatcctttttttaataaatagacaaaaagactccctttagtcggctggctttgtcatccagttcgcctaaagggaagtctctcattatttattcttcgccggtttcaatcaaaccatagcgaccatcattacgacggtaaacaatatcaatgtttgatgtatcggcatcttcataaataaagaaatcgtgccccaacatgtccatttgaagaattgcttcctcattgtccattggttttaaggccaaacgctttgttcgcacaacatcgaactgtgactgattatcatccgaatcagaagtcgtttgatcatcatttgggacgaattccaaattcttgaagcccttctcacgagatttacgattaacctttgtcttgtattttcgaatttgacgttcgagtttgtcagttaccaaatcaacgctggcatacaagtcattggaaagctcttcagctcgtaatgttaggaatggtaaaggaatcgttacctcaactttagcttgtttatctggataaaccctcagattgacatgagcagtattcttcatgtccttttcaaagtatttttccagtttgctgactcgcttttcgacataatcacgaatcgcttgagttacctcaatattttctccacgaatgttaaaaattagcataacgttctctcccttcaccattaatggtttaatggtccagcaatgaaagtgatttcattactggctacaactttagtataaatgaaagttcgtcttttaacaatcatcaggtccgattaatttaacgagcaagcgtgaagcccttaacacatcgagctcctgcacgatataacaaacctgcggcatgtcgaattgttgttccggttgtatacacatcatccacgactacaatcgtcttttccctgatcaattcactctcgtgatcaatcaattcaaacggctgattaacattaagcctctgcaatcgattcttttcggattggcggctttctttttttccttgtcgtgtacggaggcagttaactggttgaataccttcacacaaccccaagacctgattaaaaccgcgttcttgaagggtgctttcattaaccggaatgacaacaaccggacaacgcattgcctttaactcagaaacgattagccggttaaacacgtttcttaatcgatagtctccaagaaatttgtactgcttcatgtatgctctcatcgcatcgttatattcaaaaagtgcccgattagcaaacggctttttaaaataatgctgccactttatgcaatcttgacatgggtcattcaagttaccaaaaattcttcgcccacaataccgacacgttttcatgtctgacagctttacgaatcgattgaaacatttacgacaaaccttcgaattatttaatctctgaaacgaaaagatcttaggcagcgttaactcagaagacagtactgtttgacacagcaaacaagtcatttgatctccctcgctcttcgattcatttctttgatttgacggtcacaggatttgatcgtttttgatttagtttcacaatataaaatcacttgtcctgttggccgcgcactatttcgcccaacccgaccggcaatttgaaccaatgcagatgcggaaaacacctcatcgtcagcctttaaaaccataacgtcaattccaggaaaagtaaccccccgttccaaaatagttgttgtaatcaaaaaatcaacggcctggcttctcatagcagttaccttttccagcctttgtgggtcagccgaataaactgtcaaataggtacagttaatattagctttctccagcgcactacttaccaaggttaaatccctaattctgggtacaaacagcaggaaacgctgtttttgtttaaccaaacgattaatcatctgcaggatagatttaggtagtctgccttgatcaaccagtctttttaaatgctgatttttaactattttgactgttggtaacaagtgaccatggtatcgaatcggcagataactaaccgatatttcttttcgcttgattttatgcattaaaacatcatcaggagttgcggtcagatataagatcccaccacccggtttaatcgcgttttggacagcatagtgcaacatatcattaccagaaaatggaaatacatcaacttcatcaataaccatgacatcgaatgcatggtaaaatcttaataattgatgagttgtacaaattgtgatttgactatattgataatgttgctttgtctttccgtgcaataaaatgctggaaaccttcttaaacgccgattgaattctgggaaaaagctcaatgcacacatccactcttggtgacgcaataccaatccgcagtccttgggagactgcccagctaatcgcaggaaagagcatctccgtttttccggcacctgtaaccgcccacaaaagatggcgctgcctcttttcaaatatttttacaatttggttcgcacactgctgctgtaaatcggtcagttgcccccgccacgacattggcgactcgataaccggaaatttatttggctctgggaaggtcgctaaagaatggcgcgtatccatccgccccatctggatacacacataacaataataatgatggtacggtaatctggcttccaccggctttagctttgcatgacaacgagcgcaacgaattttgccttttgttatgataatggccggtcgaaatgttaccattgcgttttgcttaattgttggcgacaattctaaactattgatttggcgtccaaacaactctgatatatgattaatcatgtaaacacctcgtaactaaatacgaaaatataggagggatatttttgacaaatccatcactaaccatcaaaaagaacgggatacatgaaattgtgatcaaaaaatcccgcttcatttgtacactagctagaattaatgacgaagaccatgcaaaacggttaattgcagaagttagcaaaacaaatgcaaaggcaactcataattgttatgcctaccttcttggtgacgacgatcacattcaacgcgaaagtgacaatggtgaaccatccggaactgctggcgtgccaattctcgaagctttaaaaatgaatcaactccataatgttttatctgtcgtcacaagatactttgggggcatcaagttgggggctggtggtttaattcgggcctatagtaatgcaacctcaagtaccattgattcagtcggaattgtaaagctggttttaaagagggaactcattatcacaatcgactataatcaattcgatccccttaaatattatttgagtaccaatgaggtcccaatcgaaagaacggactatggtgctcaggttcagatcacggtacctgtggccgaaaatggcttaaaggaattccaggaagaagtcataaatttactcagtggcaatgtcacattcaaaattggaaatgataaaatctttgaagaacccttttctcgagacaaacgagaaaaaacagaacacaaaaaataagcaagctttctggccattcctatgtggtgtatcaccaccctgaacgattagaaaacctgcttattttttaccaactagtttttaacgtatgtaagcacaataaaaattagggtttattttcttcttttccatgattttctttactggtcgtatccttaaccaactttttaataccattcaataatggctgacgatcttctccaaccaaaccgattgtttcgacaaataactctaacccaattaaaacggcaattgttaacagaattgatccccataaagtagaaattggatatagtagcgaaataaacgaaaaaatcaacgcaatcccataaataaccaacacggtctgacgatgagttaaaccaatctgcattaaccgatgatgtaaatgtctcttatcagcatgtgaaattggttcgcggttcaacaagcgtctaaatatggcataaaccgtgtcagtgattggtacacccaaaatcatcacaggaatcaaaagtgtaatgaaagtggcatttttcaatccgaatagtgagaaaacagacatcataaatccgataaatagtgcacctgtatcgcccaaataaatgcgtgccggaaagaaattatatggcaaaaaaccaacacaggaagcaaccaatgcaaaaatcataattgatacaaaaatattaccaacattcaagaaaaacataccggtgattcccatcgtggtcaacgcaataattgacacaccagttgctaaaccatctagcccatcaattaaattaaccgcatttgtaattgccaaaatccaaatccaagtgaccggtaagctcatccatcctaggtgaagcgtaaaaaaaggtagtgtaatggtcgtcatcttgacgccggcaaaaaaataaacccacaaggcagcaattgaaatccccaacactttttgacgtggtcgcaatacaaaaatgtcatcaataattcccgtcagaattataatcgtttctcctccataaattccccagagaattctggttggaaactgatcacgtagaagaaccattgtacaaaacgtgtacgcaataaaaatagaaagtccaccaattgttggcattggaatcttgttaacccgccgtttgtttggtcggtcttcggcccccactgcaaaagccagttttctaataaatggtgttaaaacagctgaaattatcatagtagcaaataaagacacaatgatttcgaatttcaaatttgaaacctcgcttacttccttacatttcttatcaaatcaattatacagacgcagtttcataaaaacaacccgagatgatttaagaccattataggaactcatttttcaatgacactcaaagattgcaaaactcttcacatttcaaattgataaaaagaccttttttgtcaatttttctaataagatttaatatatgtacaaatatagaataaaaaaaggaatttaacggactataacgtaatgtataaaatcatcgtcaaactcttgtaaacgctgtcaacatctcttcgcccatactggcacttgtattttgtttaacaatttctgttgaaaaatacccaaattctattcccatgtgttaagataaaatgtgaaagcaagttcataaaattagtgctttcgaaatgaaagaagggaagtattatggaaaatagtagtaaaggaacaactaaccgttggttaatcattttcggaacgatccttattcaagtatctgccggatcattctacgcttggtcaatttttaacaatggatttatgatgaaatccggcggtgttgttcaggtcgttgatggggtgaaaaagattgtcggagggctccctgcgggctctgttagttttacctttacgcttggcatgctctgcttgtcactagcaacgttggctggaattccacttgctaagaagtatggcattaaagtggttagcctttgtgcatccgttatttatggcctatccattttaggtttaatgacgattggtaaaggctcgtcaatttggatgttatggctgtttggtggtgttttacttggtgcaatgaacggtgtgctttatttaacaacactcactaacgcaatcaagtggttcccagagaaaaagggattaatttcaggaatcagtgttgccagttatggtcttggctcatttatttttaaatatatcgacatggctattgctggtggtaatggtgcgattaccgccgacaacattggcagagttcttctttggtggggaattctggcattgattttggcagtcgttggatccttcttcttaaaggatgcaccggataatatggcgattccatcaaatgatgcgaataagcctgcggaagtcgataagacgaactttacaacgtctgaaatgttacacacatctcaagcctatatgatgttcttctgcctaacaaccgctgttatgtttatgggactcttgggtgccgctgttaccaacatggcagctgcttggacacaagctccgaatgaagttgccgtttggggtggtacaagtgccgctgcaacttttgtagcgattgtggcacttgctaataccattggtcgattcttcatgggctggttatccgatattaccggacgaaaaaccgtgttcttcatcacttatatcattcaattgctttcgctgattgctttgttgatgacgaaacccggctcaatgagcatggcgatgatgtacattgttgttatcgcaatggccttctgctttggtggtaacattactgtatttccaacttatgtctccgattactttggattaaaaaatacgtcacgcaattattcaatgatctaccaaggattcggaatcggtgccattatcattggcttcttaatggcttccggtaatccactggatccaaagaaagtcacgttatccaatggggctgttttaacccaaaacttcactttaacttactgggtacttctgattatggtagttatttcattagcgatttttgcatttattaaaaaaccaattaaaaagtaatttataattaactcaactactcatagtttcaaaagaattaaaatggaattcaattccttttttctcacctaaagtacgaagatcctgccaagtcagccttaatagctgatttagcaggatctttatttttttacattgttacacaaaagaggacattccctgttcgttcattaaaagtaactaccaagtggttactaggcataaaagataatcatataaaactctccgaggagcgcttcgcttttcctcgtaaccatcaatgaaaagaaccgtcttcctttgtataatatagggaagcggtgttcatctgtacattcgttatacttttgcgtgactcaactaagccccgaatataacccgatgccttcgagtacctcgagattaacccattgttgctgattcggacgccttataaaatgcattcctcacggctgtaaggttaaccgccaacttttattctaaatgcgagaggctgctgacatggatgtcattagcagagcgaaggttgtggaaatcgaagtacaccaaaaaacagatcaccctcaccaatttttaattggtcgcacctgatcaaaaagccccggaagaacagtcggcgtacgaacaaaacacccgaattggtcaatgcgcgaactggcgttagaaagaagttgaagtcgtcttaattggaaagtaccggtcagtatggcggccggtttggctaaattttggaaccttagccgtttcaaaatggtcttatgtaacccagaatattaaaaatatcgggtgtttaaaaacgacatgagcaaaaaggatttcgaatggatcgcgaattagctcggttgcctgggatagtcgtgctagtttttatttccacacggccacaattcacgattgcgcgaacctcaaactcgctcacgcaaagtccctatgtgaaaaggctacgagtattaaaaacagattcattaattccttcaacgtcaaacattaagttaacgacatattgtaacggatatttttggtagttctggccagaaatgttcgcttttcttaatccaagccgaaaacgattaacctgcaaacagtttctaaatgtatgcacacgaaccaagcccttaaaagcctaaccggaaatgatgtccgcctgattttttagacgcgtcctgtctcctagtgatcgcaagtttaagattgaacttgcatattggcagatgttcaacaggccaattcatgaccttgaaatttcctaattgaagaacaaacttcaacccttgaagaatgtacttcggacttcaaaaccattccagcaggattagtaaacacattgcccaaattgtgattcgccgaagttgggcacagatgtagcccgtttccgaacgctcatcattggcttcttcgggcgttggccctatgtcctggaaatatgaacagctggccatccaaaagcagtacattttgcatggaaatgttttttgaaaaactgccctgcgctaacccgcccgccgctaggctgcgaaaagacaacctgctctgcgattttaaaagactatttctctatcgtttaaaaggtcaatgagtgcgacaaaaggcaggagtcgcattcgcctcataaactgctttaggatactatgccatgattgaaaatgcgtgagttcaagttatcaagagaatagaaaagacacacgagcgaaagcgctcgttggtcaataaaatactttacctaactaaattatactaattttttcggtatttgactaccgttaggttagtatgtccttttttaggttactttcttataaaagttgggggatagcaccagacaaagcgatgaggttattcgtctgaatggtcgtttaagatgactagccaaactagcattatctaccaaaaatcgtcttgatggagggcattaagagcacaaaactagtcatggatgccctacatgaattaattgacctgttgccgtttcggaccattcatcaatacttttaccggtttgatcagactgctagagaatgggacagagttatcgtgaccgacatgaattatacctatcttaaactggctaaaatagtattccccaacaccatcctagttgtggataaattccatatcatcaacgcgcttaaccgcgtctttaataaaaccggagttagattagtttgcgacatcttctagtgagtttcacgctcaagcgctactggaagctactactggtttcttctgaacaaatggatttgaatattttcataaatgtaccaacttttcttactggctcactgccaccgaaatcgtccacaacctatttgccctcgactccgaactgaaccaaacttacgaggtcctagatcacgtgcgaaccgctattcaacacgaagactgggctaatcacaatgcaaccttctggaacatggcaggccgttctaaggaaatggccaacatgtctgaattactttaaactcatcacgaagaaatctatcatacttttcactcagtattccaatagtcttttatagggaactaataatagaatcaaagtcattaagcgagccagctctagttaccgaaacttctttcggtttagaactcctgtatgcttttatagttaaaacaaaaaagccctaatcacaaagtgatcagggctttaatcttcagatttaccaacaacagttgacaaacagcctttatttcatttaatcatatttaacttttaagcatcatttaacttcaccatgatcaaaaagtaaaaataattgtttgttagatgatgtaattacaaaggtccagccagaataagaaaaaatctcacttcatcttttaattacattagtattattttttgctacgcctaaacttcctatcccccttgaaattaaagctactctcttaagtgatagttgtaggtggaaatgataatattttgacgtgaatttaaaattgtccgtaatctcaagctagtttggttatgcaaaagattttcccaacgatgtttaggcacaaattgtggtaccaagaccgtcgtagagtagtttcgatcagccgcccttttagcgatgacatcacagaatcgtaaagttggctgtgcgattgaacgataggatgaatggatatcaacaaatcgaacatttgggaattcctttttaaactcttcagaagtcttatgctctttttcagggttggagtcaaatgaaacatgcatggcaatcacatagtcaccaattgactgtgcgtagctgatcgcattagcggtaaccctggtaacaccacctaccaaaacaatgaccgtagagccatcgtaatgatgtgttgcggtgatttgggtatcctcttcaacaacccgcagctgttcggcaacccgcttataatgacgattaatcttgtaaaaaattcgaagaagaatcggcatcacaattagatatggccaaacatttggaaaacgcagtaaaaataaacaggtaactaatgccagcgaaataaaagccccaataaaattaatcaccgactttaattgccagcttcttccacggtgacgataccaatgaatgatcataccggattgagaaagcgtgaatggaatgaaaacaccaacagcatacaacggaatcaaagaattcgttcgacctccgaagatctgaatcaggacaattgctccgacagccaaggaaataataccattggaatagccgagtcgatcgcctttatccaggtaagcatgcggcaaaaatttgtcttttgccaaattataagccaaaattgggaaagctgaaaaaccagtattggcagcaaccgccaaaatcatggcagttgaaagctgaagaacataataaataatcccatgaccgaaaacagcaacaccaatttgtgaaagaaccgtttcatgaccatttggtacaattccaaggtagtaactcatataggtaattccaccgaagaaacatgccaaaatagtcgccataattgccaatgttgcagatgcattatgactttttggctttttaaaattcggaaccgcattactaatggcttcaacaccggttaatgaagaagaaccggatgagaaagctctaaagaacagaaccagcgtcatcccttcaacaggcgcaccgatatgtgcagcagcatgatattgaatatggccacttaaaatattgtagccaccataaatgatcattaccaagatcatgacgataaacagatagaccggcagcgtcaaaaaagaagccgattcacggataccacgtaaattcaacaacataattcccacaacaattaggcatgaaattaacacttgatgagaatataaactgggaattgccgaagtaatcgcttcagtagcggaagtcgttgatacggcaacggttagcatatagtcaaccaataatgaaccaccggctactaaaccggctcgttcaccccaatttgtactggcaacaacgtaggccccaccaccagacggataagcatgaataatttgctgatatgatagtgtaattgcagccaatagaaccaacacaagcgctgcaacccagatctgatacatcaatgcagcggctgataatgttatcaggatggtggtaatttgttcagtaccataagcgactgacgatagcgcgtctgatgataataatgccaaggccttaaactttgttaaagcttggccgccttcgtcagtggtttttagcggcttaccaattaaaagccgttttaaatatcgccacataaatagttactccttttataatatttaccattcatggtgaaccataaaataatagtccatcttaccattaaatacaagtattgattatgtacataaaatagtcactaataccatacaacaacaaaaagcgcccgacaagctcggacgctcaatttgtttgtctatagcgactatttttatcttaaaattacattcccataccaggttgtggcattggagcagcaggtgcatccttctgaggctcatcggctacaacagcttcagtagtcaaaagcaaagcagatacagaagcagcattttgaagtgcagaacgggtaactttggtaggatcaacaataccatcatcgatcatatcttcaaacttaccatttgcggcattataaccaatgccaggcttttcgtcttttaactgttcaacgataactgaaccttcaacaccagcgttttcggcaatctgacgaaccggttcttcgagtgctcgacgaacaatgttgataccagttgcttcgtcgccatcagccttaagcctggcgatttcaggaataacattaatcaatgcagttccaccaccaggtacgaagccctcttcaacagctgcacgagtggcgttcaaagcatcttcgattcggtacttcttttcctttaattcggtttcagtagctgcaccgacacgaacaacggcaactccacctgacaatttagcaagacgttcctttaatttgtcacggtcaaagtctgatgttgttttttcgatttgagtcttaatttctgaaacacgttgtgaaatttgatcttttgaacctgatccgtcaacaattgtagtagaatcttttgtgacattgatcttgttggcttgacctaattgctcaagcgttgcgtcctttaagttcaatccaagatcgtcagtgatgacagtagcaccagttaacatggcaatatcttggagttgatctttacgacggtcaccaaagccgggagccttaacagcgacaacgttaaaggtaccacgcatcttgttcaaaacaagtgttggcaatgcctctccaccaatatcatcggcaatgatcaaaagtgaacgaccttgttccacaatcttttgaagaagtggtaaaatatcttgaatgttagtaatctttttatcagttacaagaatgtatgggttatcaagatctgcttccatcttgtcattatcggtaaccatgtattgtgacatatagccacgatcaaattgcataccttcaacaacgtccaagctggtttcaacaccacgtgattcctcgattgtgatgacaccatcatgaccaaccttctccattgcgtcggcaattaacttaccgacttctggattagctgatgaaattgacgcaatctgtgcaatatcatcttttgttttaacgtcatgtgacatcttgtgaagtgcatcaacagcagttttagtggctgtttcgataccacgacgaataccaacagggttagcaccggcagtcacgttcttcatgccttcgttcacgattgcttgtgttaaaacagttgcggtcgttgtcccatcaccggcaacatcgttagtctttgaagcaacttcagaaaccaactttgcgcccatgttttcgaaatgatcaggtagttcaattgccttggcgattgtcacaccatcattagtaattgttggtgtaccagctgtttgttccaaaacaacattacgacccttaggaccaattgtagctttaaccgtatctgctaatttatcaacacctttaagcattgcgctgcgagcgtcttcagaaaacttaacttgtttagccattccaattttcacctcaaaaatttattttgattaaattattaaattgttgaatcaattatccgcaattcaattattcgacgattgcgacgatatctttttcatgcaaaactaaataggatttgtcgttatcttcaatttccgtaccagcgtacttatcgaacataaccttgtcaccctttttaacaactggggcaacagtttgaccgttatctaaaacgcggccttccccaacggcaacaattgtacctgtttgaggctttttcttagcgttatcagctaaaacaatgccgccaacgtttttttcctcttcttcttctctttcgataattacgcgatctcctaatggttttaacacgttagtccctccatttacaacaatttttagcatcattagcactcatatgacagaagtgctaatcactgcttataatatattattttttgagcggaattgcaaggatttttcataaacattgcaatattcaagcgtttttcaatcaatgcgatcaattcttgttacaatagcgtcaggagattaaaggccaacgtcatcatgcgctaaatataaaaaaagatcaggacgataactgtcttgacctcttttctatcactcacaaatatattgctgacacacaaaataaagagactcccattatgttgtgaaagtttgtctttcacaacataataaagattgtcccctgccacttatgacgctttatatggttacttgccaaaattctctataaaataaatcaacgtttgcaattcgttagttaaatcaacgttttgaacaagtacatcgtcaggaacggaaagtctgattggtgtaaagtttaaaattccctttacaccgcctgcaacagcatcatctgttactgcctgagctgcgcttgaaggaacggttaaaataatcacttggatttgctgttcctgaagttgatgtgccagttcttgaattggatagactggaacgccgtcctcaatcttattaataattgtatcatcagtatcgaaggctgccgaaatcctaacattaccatctttgtgaaagttaaaattcagcagggcgtgtcctaagttgccaaccccaatcaatgcaacgttggttaaatgttcctggttcaagatctgcttaaaaaacgaaagcaggctatccacatcataaccatatccacgcttccccaatgcaccaaagtatgaaaagtcacgacggatggtagcagaatctacttgaacagcttcagctaattcagttgaagaaatccgacttttgcctgtgtcatgtaatatatttaagtatctgtagtaaattggcaaccgtttagcggtcgcacgtggaatattttcagctgtcacgaaaatttcctcctaaatttcattaattttgctaactgagcactttgtgaatctctctttacttagtattctaacataagataccatcttgtgaaatacatttcaaatattagctttgaaattaacaaagaaatgtcactattagagacatcatcccatctaaatcgcctcaaaatcaacaatatgataaacttataaggataaaagaaaggtggctggatcgttgataatcttacaagcccaagatttaaccaaaagatttaatggtattaacatattctcaaaagtaaacttatcaattcaagaaaaaagtcgcattgcattagtcggccgaaacggtgccggcaaatcaacattagttaaaatgatcatcggcgagcagtccatcgatggcggtcaaataacaacaaaaaagaatctcacaatcggatatttggcgcaagatacgggattagattccgataagggaatttatgaagaaatgtcgtcagtctttgcgaaactcaaggaacaagaaactaagattcatgaacttgaagctcaaataagcacgctggatccaaaatcggataggtttcaccaaatttcagcaacttatgatactgttcgagccaattttgaacagcataatggttatggctatgatgcggaaatacgtggcgttctccatggcttcggctttgataaggaccagtacgataaaccgattaatgaactttcaggtggccaaaaaacacaattagcacttgcaaaactactacttgaaaaacctgaattgttaattttagacgaaccaaccaatcacttggatgtcgaaacgattacctggttggaaagttatattcaaaactacagcggttcgttattgattatttcacatgaccgatattttcttgatcgtatcgttaacgaagtttatgacctggctaacggtacattaagacattacgccggaaattacacacagtacacccaaaagaagcaacaagaaatctcccttcgctggaaagaatatgaaaagcaacaggctgaaatttccaaactccaaaccttcgttgataaaaatattgtgagagcatctactacaaaacaagcccaggctcgtagaaaacagcttgagagaatgaaccgaattgaaaagccaacgtctgacggtaaaagtgttcgtttcacattctcaccaaaatccaaaagcggtaacaacattttaaaggtcactgacgcagcagttggttatacaaagattctttcagaaccagtcaacttggatgtcaaaagaaatcaggccattgcaattgtcggccccaatggggttggtaagtccacccttttaaaaagcattcttggcattattccctttttaaagggttcggctcaatttggaaccggtgttgacactgggtactatgatcaagaacaagcctcactacacccttccaaaacggttttaggcgaagtctgggatgatcaccccactacagccgaaggagacattagaagcgttttaggcagcttcctcttttctggagatgacgttgctaaaatggttcacgatttgtccggtggtgaaaaagcccgcttacttttaacaaagttagcaatgcaacacaataattttttaattctcgatgaaccaaccaatcatttagacattgatagtcgagaggttttggaaaaagcgctaaatggttttgatggtacaattctctttgtttcccatgaccgttattttatcaacaaagttgcctcatccgttgttgaactgtcacaaagaggaacaaccctttaccttggtgattatgattactatgttgataaaaaagatgaacagcttgcgattaaggaacatgagcaggaaaaacagggaaccgctcaattagccgcgcaggctaccacgtcaacgactgataaaaagaactatgaagtcaataaacaaaatcaaaaggaagttcgaaaactaaatcgcgaagtcaccgatttggaatcccagttagacgaactgtctaaaagtaaaaataatattgaaaatcaaatggctcagccagaagtttttaacgacttagataaggcgtccgatcttcagaagaaacttgaaatggtcgatcaggaaatcaaagaaactgaaagtaaatgggagcaaaagagtcttcagttagaagatattgagtaattcataaaaaggaccaacagcaaagtaaaccacaaaattggcttaccctgactgttagtccttttatattcaagaatatttaattaatttctatcgatcattacctaaattaattagttgcaggttccttaatccattcaaattccaaactgggatcagcatttagcgttgcatttgtaaatactcgatggcgatacaacatttcaccagcagctccaatcatagcagcgttatcaccacataatgatagtggtaccaactccaaagaagttttcggaaatgcttgtagttctttttcaagacgattgcgcaatcccttattagcggcaacaccaccgcctaaaataagctgcttaaccggataatcttgaagtgctcgttttgttttgtcagccaaaacgtcaataacagcttgttgaaaacttgctgcaagatcatctttattcaaagtttcatgaatttgatcggcatggtgaaccgtattaataaaggcactttttaatccactaaaactaaaatcgaaattatcatcttggtccattgcccttgggaaatggaaagtatcatgacccttatgagccatttcatcgacttgttttccagcaggataattaattcccaaaacccggccgattttgtcatatgcctcgcccgcagcatcgtctcgagtctcaccgataatttcaaatcgattttccttgggcatatacacaagctccgtatgaccacctgaaacgactaatgccattgccggaaattcaattggttcgactaatcttgcagcataaatatgacctgccaagtgattaactggaatcaaaggcagatgatgtgcccaagcaaccgcctttgctgctgtcacgccaatgagcaaagcgccaaccagccctggcccataagtgacagcgactgcagataaatcactatatgtgactttagcctgtgttaacgcatcattgatgcagctggtaatttgctcaatatggtgtcggcttgcaacttcaggcacaacgccaccgaaccgttggtgactttttatttgggttgcaacaatattcgaaagaattgtatcgccattttctataactgcaacagacgtctcgtcacagcttgtctcaaatgagagaatcagatcttttgccaaaaaactcacctttcctagccaattttcgtaatgtctaaaatcatattcaatgcatcttcacgatcgttaaaataataatctttctttaacccgttgtccacaaaaccgatgtcacgatataatttttgagctctggcattgctgacacgaacttccagcgttactttatcgtattttaactgtcgtgcctttttgataattatattcaccaaaaaatagccgagcccatgattttgaaaattgggtgccacggcgacattagtgatatgacagtcttttgtatggtcatttaatgaacagccaatgaaagcaaccagccagtcatttcgtcttaaaaccagatacaaacgatcacttttacgcatcaattcagttcgaaacgcccgctcgtcccatggagtctgaccaccataaacggctcgttcgattccaaggatttctggaatgtcgggaatcatggcctttgccagaaaataatttgtaccgttgatttcgacatcgtgattcttaatgtctagatatcgttcccggagctgaacctgcttgttataaaaattttgctgaaaccattctttaaattttttccacatagttacgggtatcctcgtttggatgaagtttttgccaatcagcttcagctttggttagacgcaggtatctcggaacaacggcatcaatgtccttcacaggtgacaactgtgatccataaagaccaagtctggctgcattaggaactgctgtcagttcatcagctaccctcaaagaatctccaaaccgcttcaaaaatgcctcggaaaaaggtgctgtatcccctacaatcataattggctgattaacatccgttagttttgccaaccagtcattaatatttgtatgctgatcggaaataattgaagtcatcgttccgttttttagttgataaaggcctgtaaacatattttgatttcgagcatcaaaaattggattgattaaaaccctcggctctgagatattaagcgcaagtgttaacaaacttgaaacagtcaccagctctatatctaaagtgctggcgagtgttttggcagctgtcgttgccattcgaatccccgtataagatccaggccctgacgcaacaacaattctgttcaagtcgttcggtaagagatcggatttttgaataagatcttcaattaccggcattaaaaactccgcatgttttctatgcgtcgttaacgttgtttcggctaataaatgatcattatccagaacggcaacggataatggtcgattcgatgtatcaattgctagaattttcatttttttcatgaccctttacatcgtttttcttccataaaaatgtagcgctagatgaaagtacatcgttagaaaaaatttcatgaactgttttaatcttatcgctatctttagactcaacagctaccgagctggtaacccaattgccatatttaacctcattttcgaaacgaatatcaatctgttccggaacgtgggacacaagaaagtcaagtggcagaacgtcagtcatccactcaagataatgagcgttattcacatgaccattaaagtcaatgtcactggccctaacctgatatttttttgaggaaacttcagcactgtcagctattcgacttggccgtggcaatctcggtacccgacgcactttttcggactggtagggctcaataatcgtttgaggaatctctgtaatctttcgggctctctcatccattaaaacccatatactgtctacctttacaagctcatttccctgatcatcgtgaacccaaaactcacggtaggcaaagaaacggttgtaggaagtcccacgtgttgtcattttaacagtatcttcaacttgtggaagccggttaatcttaattgaatattgcgtgacaacccagccaacaccatacttatcaataagttcctgttgggcaactcctaatttagcattttgatgatctgaacagagcattaaaatattaatcaacattgtcattgtaatgcggtagctaacatctccttcataaaaggagatcgtatgattttcactgtactgatctgcaggcattggcacgtcttctttctaacataatttaaattataactcttttataatgggatggaaactaatcaagcctttaatttatactttttaatcttaacgaatcaacaaaatgacgtctttcttctaagtaaataatattcacttaatgccatgatattcattgtaaacaacttgtttacgtagattatgagctttggcaacctttttgatcgattcattaacagacaatccatccttaatataaatatctacttgttgcgtaagagaaaggttttccattagattatcagtcttattctcctctaaaggttgcgcgtttccactcacaataatgacaaattctcctcgtatagttgttgaatttgcccattcaattacttgatcaagtgtgccacgaataaattcttcatgtttttttgtcaattcacgacataaagaggctgctcttaatccaccaaatgaattttgaagactttttaacgtctttaaaagtcggtgaggtgcttcataaaatataagcgtttcctgtcgattaaccaactttgccagttcatcacgctgctctttgggttttcttgaaagaaacccataaaaataaaacggctgaggggaaacaccagaagcaatcaaagctgttataccggcattagcacctggcaagggaacgacagttatttcacttttaatacaagcaaccaccaactcatgtcctggatcgctaatcgaaggcattccggcatcgctaacctgggcgatcgatatccctttttttaacttatcaatcaactcaggaattctttgcacagtattatgctcatgaaaactaatttgtttggtttcaatttcaaaatggttcaatagcttctgcgtatttctggtatcttcagccgcaattaaatccacctgtttcatgacagaaacagcccgaaatgtcatatcctccaaattaccaattggcgttggtactaaataaagcgtaccgtatttacttttagtatcgaaacttctttgagttatcacttagttattaatcccttcgaccataaataatctccgtgcaaaaaatgcaatcttcgccattttcccgtcgcttgccataatatgaactgcaaacatgaaacccttcgttatataatttttcaagattctttcgggatttagataattctggtgaattgttaccgactttttcagtaatctgattaattctatcccgaagatgctgattttcaatttctagttccgcgttcttttccattaattcaattaatgattcatgcaggtgagaaaattcagctgcggttgcacccagatgactgtccatttctttaagctcatcatataaattttgactatccaatactatctcaccctttaaaaatctatgacttaacaatcgtcagcatctttagtgtgacagattcaataacattttgaaaattcacatttaccatcaaactgcctcgcgtatttaacagttcctccaacatcgtcattaattggtcacttgaccattcttgggcagcctgctttgtttcagaaataatatcaggaaatttagtcgtatctttttttaaagtaccatacttaatttcaagcgtttcatcaaaaacaccaatcatcattgataaagcaacctgctgacgttccttatttgtgatcagaggcatcaaggccatttggatatacggcatggccatcagattgcccttcactaaataaccaaaccatttggaaaccacttcctgaagtgaagaaaaccaattatccgcttgccatctttttatttcagataaactatttgtcatcgacattagtaaatttatctgacttggtaagataccggattttcgcaactcttgattcattacatctttcccaatgctcggaaattcaacaacttgggttcttgaaacaatcgttggcaaaataaggttacgattttgactaatcaaaaaactgacaacatttccagtaggttcctcaataaatttaagcaaactattagcggcaccggttgtcattttatcggcatctgaaataataaaagctttttttgacccttccattgcgcttttagtgaactcactctttacatgacggatttgatcaactttaatactcaaaccatccggtttcgttataacaacatctggatgatcgtgattcataattcgtgtacactcagcacactttccgcaaggataaccgtctttcacatttgtacagaaaagacgcattgcaactcccattgcaactgcattttgacctgcaccatcttcacccgtaaaaagatacgcatgtgacaattcatttcgatccactaagcgcataaattgttcaaataatttgggctgttttattttcgcatcgctcgcaatgttgtctgacatttttaacctctaaaattgatggaattgctcaattggcaagatcatcacagtagccccacccacttgaacctcaattggaaaagtatgttcagccgtatcaccatttagactaaccgggggcgtcataaattgttgtcgggcggagcaggtttccttaataagctgcaacgttaaatcaactttatcatcatcaacagcaaccaaatatgttgtattgccggcccttaaaaaacttccagttgtcgaaaaacgtgttgcaacaatgtcatgggcaacaaaaaccgaacgtaacttattagcatctttatcttgaacgattgcaattactaatttcatagctaagactccttaaaaaattcacttgctatttgatgaatcacatcagttgtatcttgaataaccttttcaattggttgagttgcatcaattatgataaaacgatcgttatattcaccaattaatttcatgtatccctggtgaacgcgtttatgaaaagcagttgtttcaacatctaaacggtcaattttacttgagtcccgatgcttggcaattcgattcaagccaacttcaaccggaatgtcaaaataaatcgttttatatggaagtatcttttcggttgcaaactcattcatcctcgctactgcctgcattccgatttctcttcccgcaccttggtaagccaccgagctgtcaacatatcgatcgcaaagaaccagcttatcagcctgcaaggccggcaaaatagtttcgactaagtgttgacggcgtgctgccgcatataataacgcttcagttcgataatccatttctgtatttttacgatccaaaataacccgtcgaatttgttcggaaattttattaccacctggttctctagtaacaatcagatggtcaccaagttgtttttggaattgattaacaacttcattcatgacagaagttttccctgcaccatcagggccttcgaaggttataaatttgccagtcaaagtttttccctcaattctatatttaggtttattgtactgtatgtttttttacctgtctattctcccagataaaatgccacaaaataaaagagcgatctaaccttaaatgccggcctgaatttcacatccctgtgtctcagaaacaacgaacatttatccaaaaatcactcaaaatttatcattaattttccttattgaaaatcatcgtggtcataactgatgaccgatgcttgaatatgatcatttttaatgtgtctgagtcgagcttctttataaataaagaaaaatttttgctttgccaaagccgtttcttgtgccatttcaatatcgctgtcagcaaccgcggtttgagtttgagcggcatgatcccactgctctttaagattattgataagatccagcagacgttgatcatattcagcttttatattttgctttttaaatccaccaaaccacaccattattttcctccattacatttcggttcggccttggacagccttaaacaatgtcatttcatcagcgtattcaatatccgttcctactgacagtccatgtgccaatcgtgtcactcggatgccagctggtttgattagcttacttaaatacatagcagttgcttctccttcaggagttgcgttagtcgccacaatcacttctttaacctcaccgtttttttgaagtcgcctaattagggaagtaatgtttaaatcttcagggcctttgccttcaattggtgacaaaacaccatgaagtacatggtacagcccatgatattcttgaactttttccatcaccataatgtctttaggctgctcaacaaccaatatttttgtttgatcgcgagtcttatcacgacaaatttcacatggatcttcgtcagttaagttaccacaaatcgagcaatagtgaagatcttctttggtagccaacagtgcgtgtgaaaattccttgacatcgtccttattcatatcaacggtataaaaagccagccgagttgctgtcttgttaccaataccaggtaatttcatataactatcgattaattttgcaattggttcaggatactgcataatcgttccttcctatcaacagactacatacccggaatacctttggcgtacttgcccattgtactttgagtggtatctttaatcttcttcattgcatcattaactgctgcaacaatcaaatccgatagcatttcgggatcatcagggtcaattgcttcaggcttaattttaatatctgtcataatacgttctccgttgaaggtcacaacaaccatgtcgtcaggagcgctaccggtaaattcctgtttatttaagttatcttgttcttccttaagttgcttttgcatcttttgcatttgtttcatcatcttattcatattcataccattcatcattttaaaattcctccgtctactatttaatcatttttaatatcgagaatgtctttaccgaataactcttccgccttttttacgatcggcttgggatcgtttgaatccggatcgatcttttcttcttccgtggacgtctcctgactctttggatcggtattttgcttacccttcagctcatccttgtgactagctaaataatctttccgaattttcggccattgattatccggcacgaaaacaattttgggtgctttaccggcaattcggtccaaattgttttccaaggcatcacataattctcgattagcttgcgctttttgaaagaaaatcggatactcaaatgatacaatcacaccatcggggctggccgcaaccggtttggagacatgcatcactgctcgttgtgtaacagacagtgcgttcatcaaatccggccaaacctgctggaattcattaaggctctgtctggtagcctttcccaagatcggataaatcttggccaattcaacgcgtgcattcccagacttagcctcaatgggttttggtttaaccatcggctgactttgagacgcctcatcagccggaccggatttcttaagttgttcgatttccctttggagctcattaactttatcggttaacgccttaattttaccattttcgtcgatattatcgactgaagtagtcgttgaaacgccctgaggctgtttcaggtgcgtgattttaaccgtcaaaacctgtaaataaacatccggatgagccgtgtatctcaacgaattagcaatctcgtttaattcattaatgatttgataaatttcttcatcgctgatctggtcactcaatgctttgaatttatcatcaaccatccctagttccagctgctcaacgatttgtggatcctgttgatacaaaagaatgtcttggcaataactggttaagtcttcaacaaatcgactagcatctttcccgttatcaagcaccttctgaacggtaatcaaagcatttttcgtatcctttttaatcacttgctcgacataagttgtcaataattcatttgttacgcttccggttacttgaagggcgttttcataggtcaccttatcatcaccgtatgacatagcctgatcaagaatgcttaaagcatcccgcatcccgccttcggctgcttttgcaatgagttttaatgctttatcatcgtactcaatgttcttttgtttaaggatgtaggccattcgttccaaaatatcctctggcctaatccgcttaaaatcaaatttttgcgttcgagaaataatggtagccggaattttatggggttccgttgtcgccaaaataaaaataacgtttgcaggtggttcttccaatgtttttagaagtgcgttaaacgcacccgtagacaacatatgcacttcatcaataatataaactttataatcagccttcgttggcgcatatttaaccttgtcacgaatgtcgcgaatttcctcaacaccattattagaagccgcgtcaatttcaataacgtcactcaggctgccctcgttaattgccctgcaagtttcacacttattacaaggttcgccgtcctcaaggtaatgacagttaactgccttggcaaaaatctttgcagcagacgtcttaccagttcctcgaggaccggtaaataaataggcatggctgatttgttttgttaaaattgcatttttcagtgtttgggtaataattgactggccaacaatttcatcaaaacgttggggtcgccaaacccggtataatgcctgatagctcatttccgatcctcctttagaatcattaattactctgacaataaactcgtaagcagtggttaaaatacttaaacaattatatgctgaatcgtccggaattgccaaccaaattagccctgttttgggcaagcttatcgaaaatcttaatttgtttgagtcgtcaatacactccccaattaaaaataatcagctgtgtttatgaccaaacaaaaagtatgaacggtgttcattcaagacacgattcatactcaagtaatccaaattataaaaatctcccagcaatatttctttgctgggagtctaatagtcataaacaagaggcacagtgtcgatgatacttagtgctgcttccttccggacctgacacagttcgtaacccgacccttgcctcagggccttgcggcaataactatcatatcgtattttcagagaaaaagccagtcacttctgtttttttctttttcgagcagctttaaaaaagtctttcataatctttgaacatgcgggttgaaggactccttcaagaacttcaacattatgatttaatcgtgaatcttctagaactttgtaaaggcttctaaccgctcccgcttttttatcccgggctccgaaaacaactctatcaattcgagagttgacaattgcccccgaacacatcaggcaaggctcaatcgtcacataaagttcacaatcaacgagtcgccaactcctcaaataacgacaagcttcctcaattgccataatctctgcgtgggcgaccccgtcatttaggtgctcacgcaaattgtgccctcgaccaatgatttgcccatcttgggtaatgactgctccaatcggcacttcaccaatcaagtatgccttttgtgcttcaatcaacgccattttcataaatttttcgtctttattttgactcattcgaacctctcaattaaatcgattactcattaacactacgaaggatgtagtaacccttatctcgtttaacaatctcacagttaccgaaaacctttgtcattaattttttggccgaaggcgcgccttgtttcttttgcagaacaaccgtcagcgtggcattgggctttaaatgtgagaccgctcctgttatcatatcgtccacgactttttttcctgctctaacaggcggattggtcacaattgctgcatagttgtctttaatgttagaataactgttgctggcaaaaattcgaacatttgaaatgccattagcctgtgcattcttttctgctaatgctaaggcaatctcattgacatctaccatgtcaaccactctgtcgggctggatctttgcaattgccagaccaatcggcccatatccggtacccatatctaaaatattaccatccggaatattctcaacgtccacattttcgagcaatactcgactgccataatcaactcggtgttttgaaaacactccgttgtctgaagtaaacacaaagttgtttcctaatagtgcgtattcccaagtaatcggttcagatttgacatctggatgctttgaataataaaattgatttttatccatgaaaaaactccttaaattaacgtttgacaaggatcaaccacatttagtattgatattttttatcatcacaatatattgtgttaatccgttgattttttgtaagtttagtgtaaactagaatcataaattaaaaaagaaatgattaaagcggggtgtgccaaatggcaaaggtaacagtatattcaaaaaataattgtatgcagtgtaaaatgacaaagcgttacttggcagaacatcatgttaagtttgaagagcacaatatcaatgagcagccagaatacgtagactatcttaaagataaaggtttcctggctttaccagtagtcgatgttgatggacagcaagcgtttagtggattccgtcctgatgaacttcaaagaatcgccggataatctttgtccattttaacatactgattaattttaaacgggcggaaccaattttggcttcgcttattttattcgcaaaattacagaaagcgtggtctcactatgtctcttcataatcttaaggatgttacatatttcgatctaaataacgaaattaacatccccgttgataaccaaatccctctacaaaaggatcagcaggctctccaagcctttcttaagcaaaatgtcactcccaatttgatgacatttgacagcctgcaggatcgatttgattatcttattgaaaatcattattacgaagcgggatttatcaagaaatatcccatttcatttattgagaaactttatcaatacttgaaagatcaagattttcatttcaaatcatttatggcggcttataaattttacgcgcaatatgctttaaaaacaaacgataacgataaatacttggagtctttcctggatcgcgttgctgccaatgcgcttttctttgccgacggggatgaacaacttgcgatgaacttagctgacgaaattattcatcaacgctaccaaccggcgaccccaagttttttaaacgctggtcggcaaaatcgtggtgaatttgtttcatgcttcttaattcaatcaaccgacgatatgaacacgatcggtcgaacaattaattctgcccttcagctatcaagaattggcggtggcgtcggcattaacctttctaatttacgtgcggccggtgatccaattaagcatattgaaggcgctgcttccggtgttgtcccggtcatgaagttgttggaggatagtttctcctactctaatcaactcggtcagcgtcaaggagccggtgtcgtttacctatctgtttttcatcccgacatcatttcgtttcttggtgccaaaaaagaaaatgcggatgaaaagattcggttgaagacactctcacttggcgtgactgtccctgataagtattacgaactcgtaaaagccgatgccgacatgtacctattcagcccttatgacgtcgaacgcgaatatggggtaccattctcatatgtcgatatcacaaaagaatatgatcatttagttgccaatgacaagattaagaaaactaaagtaaaagctcgggaccttgaaaccgaaatcagcaaactgcagcaggaatccggttacccatatatcatcaatatcgatactgccaaccgtgaaaatccgattgacggccgaattgtcatgagcaacctttgctctgaaattctacaagtacaaacaccttcaactgtagataacgagcaacattatatcaaactgggaaaagatatttcctgtaatttaggttccacaaacattgccaacatgatgaacgcaacgaactttggccattcagttgaatcaatggtccgggccctgacgtttgtaaccgaccactctaatattgacgtggttccttcaattcaaaacggaaaccgtgaatcccattccattggtttgggtgctatgggactccatagctactttgccaaaagccacatgcattacggctctcctgaatcaatcgaatttactagtgtttacttcatgctgttaaattactggagcttggttgcttctaacaagatcgccaaagaacggcatcaaacattcgacaattttgaaaaaagcaaatacgcagatggcacctactttgataaatatttaaatcattcatacgcaccgcaatcagataaggttaagcaattattccaaggcatcacaatcccaacgaacgaagattgggtggctttaaagaaggctgttatggaagacggcctttatcatcaaaatcggcttgccgttgcgccaaacggttcaatctcttatattaacgacacaactgccagtcttcatccaattattaatcgaattgaagagcgtcaggaatcaaagatcggtaaaatttattatcccgctccttatctttcaaatgacacgatgccgtattatacttcagcctacgatatggacatgcgtaaagtcattgatatttacgcggctgcgcaggtacatgttgatcaagggatggcactgcccctcttcatgcgttcaaccattccagaaggcctgtacgaatggaaaaatggtcgaactgacaagatgactaccagagatctgaatattctaagaaattatgcccatcgcaagggaatcaaatcaatttactacattcgaacttttacagatgatcagcaggaagtcggttcaaatcaatgtgaaagttgtgttatttagtgagttatcctgaagtttaagtaagataaaaggaagttaataatgactgaaaactataaagcaatcaattggaatgcaatcgatgatcagatcgataaagcaacctgggaaaaattaaccgaacaattctggctggatacccgaattcctctttcaaacgatttgtctgattggcgtacactggaccaagaccatcaatgggtggttggtcatgtcttcggtggcctaactttattagatactttacaatcacaagaagggatggcctcactgcgaaaagacgttcaaacaccacatgaaacagcggtactgaataacattcaattcatggaatctgttcatgccaaaagttattcatcaatcttctcaacgctaaacacacccgaacaaatcgatgagatttttgattggagtgatacagaagaatttcttcaaaacaaggcccttaagattcgtgatatttacgaaaataacccggatccattaaagaaaaaaatagccagtgtctttttggaaacttttctcttttattcaggtttctataccccactttggtatcttggccataacaaaatcccaaatgtcgcggaaatcatcaagctgattctcagagacgaatctgtccacggaacctatatcggctacaaatttcaaataggttttaaccaattgccaaaaacaaaacaggaagatttaaaaaattggctttatgatttactttataagctttatgcaaacgaagaaaagtatacacacctattatatgatcaaaccggttggaccgatgacgtactggtatttattcgttataacgctaacaaagccttgatgaacctgggtcaagatccccttttcccagacactgcagaagacgtcaacccggttgtcatgaacggtatttcgacttcaacagccaaccatgatttcttctcacaggttggaaacgggtacttattgggtaatgttgaatctatgtccgatagtgattacgacatttaacctgcatattgatggatagtcaattattttaaaagaatagcaagacaaaaagaggaatctcaagggattcctctttttgtcttgctatttatcacttgtctcgcttacccaatcattattttaaaaaatcagccaacaatatctttgggtcttccacccgtaaacattacctttaaattgtttaatgaaatggtcaccatatttttaaccgattcagttgtgtgaaaggccgaatgtggtgtcaaaatgacatttggcatcattgacagcttaattaaatcagaatcagtaatcttcttcgtagagcgcgaatcttgtaagtcggccgattcattttctaaagtatcaactccagccgctgcaatttcaccactttccaaagcaaaaataagatcgcctgtatttacaattgaccctcgggcagtattaattaaaatagcattatccttcattgcttcgaaaacttcatgattaaataaatgaaaattatcttgcgtagccggcatatgcaaactaataatgtcactttgtccaaatatatcttctaaatgatcgacatactcaaattcgccatttgttgattttaaaggatacttgtcataagcaatgactttggcacctaatccccgaaacagttgaatagcatggcgaccaattcgacccgttccaataacgccaacagtttgttcactgattagacgccccataaattctgatgaaaagtgaaattcatgcttgtcttgcaattgttgttgcatataaccaactttcctagagagataaagggccatcataaccgcaaactcggcaatactttccgggctataggcaggaacattggtaattaaaaccccattatctttagcagcctgcatatcaatgttatcaattccgacatttctcaacgccaaatacttaatcccaagttgatgaaaagagtcgaacaattcccttgaataaggaatcgtttgtagacaggaaataccgtcaaatccctgcgcttcactaatcgtttctgtatttaacgtcgttgtcgttgatgtaacgtcaacctgatgatcttttccccatttttcaacaaacgggatttcatcgtcccgaacattataaactataaatctcacaagaaagcctcctgagtctgcatgccagcgttaaattcagatgatcgtcaatgttaattaagtcttacgggatcaccagtttacatgccactttaagtttactataccaaaaagaaagctgccagaccaacatcaagcccggcaacattcttttctaattaaatcatatagataattatttcaatttttgaatgaagtgatcaaatgcatgttgaccctcatcgttccacttataaacgccggcgtcttcaagtactctggcaaataccaagccgatttccttatcgacaattttctcgacgttctctggagtaaaatcataacgcgttttcagctcatcagcccacgacttatggtaatcagccatttgattatcatgaccaatcaaatagttttggacttctttcatttcggttttgagtcgtgcaggtaaaatagctcgccccatcacttcaattaagccaatattttctttcttaatgtgttgaacatctttgtgaggatggaaaatcccgtccggatactggtctgaagtttgattatctcgaaggacaacgtccaacgtaaattgatcaccctttttatacgcaattggtgtgaccgtatgatgacgaacgccatcagtataagcacgaatatttaccgtctcatcagaatacgccttccatgtatcggcaattttcgcagctgctacaaccaccttatttgcatcttcactttgcagacgaatggttgccatcggccacttcacgatacctgccttcaaaccatcaatccccaagtcaatcggtcgatctagcccagctttcatcattggaaaattgtgccgacctccctgataatggtcttgtgcaagtaatgaaccacccacaattggtaaatccgcattacttccaacaaaatagtgtggaaattgcttaataatatccattaaattgatgaaagtctgctgattaattttcatcggaacatgcttttgattcagaaaaatggcatgttcaccgaaataagcatacggagagtactgaaacccccacggctgaccaccgatcatcattctaataactcggtgattgcttcttgcagcataacccaaacgacctaaatagccttcattctcaatggctaaaggaccaacaggataccctgtcgcctttttctttcccgctgccgcaattgctttaggatccttttccggttttgacaggttaatggtaatttctaaatcaccataatccgtttcagccttataagaaatgtttttagcgattgctcgtgttttaatataatcgttattttgactaagttgatagaagtaatcagttgccttatcgggtgactgttggtaatcattccaaaagatctcgtttactttagagggaatcggggtcaataagtccatcaactggtcttcaagaatttcacgatttgtaatcgaatcttggatttttccgtgcttgatggcaagttgaaccaattcattggccaaatcaaccggtgaactatttttagtagtatcaccaaaaccatccccaattaaccgaaatactaagttggtgacataaattcggtcaacatctttgtacggcgaatctgatttaataattaaatcgacaaattgttcaactgctgattcactcattctccctaatttcctttcctatcgtcataaccctttggatgggtttctttccaattccaagctgtcttgataatttcatgaacatcatcaaattgaggatcccagcctaaaacttttctagctttgtcgcttgctgcaattaacgtgcttgggtctcctgcacgacgtggtcccattttggcagggattggcttccctgtaacatctcgggcagcttcaagcatttctttattagaaaatccggttgaggatcccaaattaaaggcatcactgtcacgtccggcttgaagatacttcaaagccagaatatgagcatctgccaaatcaacgacatgaacgtaatcacgaacatttgttccatctttagtatcatagtcgtcgccaaaaatagttaattgatcgcgctcaccagctgcaacttgaagaataataggaactaagtgggtttcaggatgatggtcttcaccaattgagccatccggcttagcgccagctacattaaagtatcgaagagcgacaaacttaataccgtaagcaacatcactccagtgcataatcttctccatagcaagtttactttcaccatatggattggttggtacttgaggatcggtttccttaatgggaatttgttttggttcgccataagtagcagcggttgatgagaaaacaatcttcttaacgttatgctcatgcatcacttctaataagctaatcatgccataggtattattatcaaaatacttcaacggcttttccattgattcaggaacaactgaaaatgcggcaaaatgaataacaccttcaatatcttccttatcaaaaaccccactcaaaaaggtcttatcccgaacatcgccttcataaaaacgtgctttggggttaactgcggcacggtggccggttaccaaattatcaacaactgctacgtcgtaccctttttcaactaaccggtcaacagtatgtgagccgatgtagccggcgccacctaatactaaaattgccatcttaatatcctctctttctcaattaactacttaatctcttttggaccatcagaaatctcagcaatatagaactctgccggatgaccgatttcttgttcgtaaactttgccaacattctctttaaatgcatcaaccttatcgcggtcaacaattgcaatagcacaaccaccaaatccggcgccggtcatacgtgcgccgacaacccctggttgcttccaagcagtttctgccaatatatccaactctttacccgttacttcaaaatcatagtgtagtgaaatatgggaggcgttgattaatttaccaaattcttccagattattattaaccaatgcatctttagcttttaatgttcgttgattttcaaaaacagcgtgacgcgcacgacgaattaaaatatcatcgttaattaaataactattttcatcaaattccgattcacttaaatcaccaagcgtcttaatcggtaatttggcctgcagcctttttaatgcttcttcgcattgcgcacgacgctcattatacttggagtcctgcaattcacggtgtttcttcgtattcatgataacgaccactctgtcgcccatttcaacgggaacatattcgtaatccaaggtattagtatccaataagattgcttgattagttttacccattccaattgcaaactgatccataatcccagtttgaagaccaagatagctgttttcaactaattgaccatatttaacaagttctacttcatcaatattgaattcataaacatcattcacaatttcagcggtcagtagttcaatacaagctgaggaggacagaccggcagcgtctggtaaattaccattaactgcaaggtcaaatccatgattaagcttgtgaccatggccaatgatctgcgcaatcattcctttaggatagcttgcccacccatcggctttactgtaagctaaatcatctaacgaaaattcaataattccttgatcagcaacgtttgcagaaaatactcgaactttattatctttacgtgcaccgtacgcgccataaatgcccatgctgattgcacagggaaaaacgtgaccgccattaaaatcagtgtactcaccaatcaaattgattcgaccaggtgagaagaatacccggctggaatcgtaaccgaacttatcattaaatactttttttacatcagaagaaagcatgaatttcatccctttacaattattttagtaaattttactcaaatacaaaatacctcattttgatagcgttgtcaactgcgtctttaatacaacgttagagattgctcaataatattatcaacaatatacctgacgtatcagtatttattgcactatccaatgctaatttcacaagatgttggaagcgcttaatttttttgccctttcaaatattcttcaattggtaaagtccagtaaatttctcaaaagaagccatcttttttgagaaatatgtcggccatcatatcaattttttgtttccaaaaaaagaaaaaaggccaaataaaaatggctaaatcagccactcttcatgcaccaatttagccatattgaaatcatttattttaaaagaatgttttgcttacaacaattgtaaacatcaatagaattactgacgatataaatgctgcaaaaaacacattttttcctcgttggaaaatcacacggaaattaacactcattccaagagcagccatcgccattcccaagaacagataggcagctttaaccaaaagggctaacgttgccgaaccaattggtaaaaatgttcctatcacacttgcaataataaatcccgccataaaccaaggaattggtaaatgccttttttcttgaccagcaattagcggactggttttctgataccaaccacctattattagagcagcaggagccagcatcaataccctggataatttagtaataattgcagtatccaagctaattggtccgcctgaacttcccgccgccactgcatgggcaatttcatgtagcgaagcaccggtcataacgccaaattgagttggtgttaaatgaagcagtggtttaattcctatttcaaccaaagtaaataccgttcctaaaatggcaacaacggcaacggcgagtacttcgttctcacgttgccttgcctgctgactttcagcaactttgatttgaggggaaatccccatcacggcagcggcaccacaaatccctgttccacttgcagataaaatggctaattctttttccacaccaaattttcttgcaataaaataggtcatcgagacagttccggtcacgaccaccactgctaaaaggattgtcttcaccccggctgaggctaaatcaatcaaattcaatttgaagcccagtaaaataattcctaagcgtagaaatttattggaaataaacccgattccctcttttgacgtttcaatcggtcgcttaaaaacttgaaataccattcctaatatcaatgaaataaccaacgcgccaattaagctgagataaggctgactccctaagaaattccccattaatgcacagatgagtgtcagaactaacgcaataaagaagcctttggtccttaacacaccataatttttcattcgtttacctccaaacatgatttactcgtaaaatattaccagaaatcaacgattatataaaattataatgtataataacaatataaataattcttattatggtggcgattttattgtgcttgacagacgatatgaaacatttttaactttagcaaaaactgtatcctatacaaaaacggcccaaaaattatacatcactcaaccggcagttactcaacaaatagcaagtttgcaaaaggatcttcaaattgaattagttcgctatgaacgaccaaatctgattattacttctgccggtagggaattagcaaagtatatagaaagtgtcaggattaaaagtcatcagcttttgcaacatctacaaagccctaatgataaacgatcacttaaatttggtgctaccttatcttttaacactatcgtagaaccaaatttcattaaacatattgcaccgaagtttaccaatattgactgcctagttgccaataccgatcaaattctaacgcaaattgataatggtcaaatcgaatttggactagttgaaggtaacttcaaactttcagattatgactctattccaatttttaaagatgattttattgctgtatgtaatcctcaaaacccactggctaatcaaaaaagaatcgatttaaaagcgtgtttaaaatttccacttttacttcgagaggttggatcagggacacgatcaattctggaagactggttggcaatggtgaatcattcggtctcggatttttctaaaatcattacgataggtgacatgtcaacgattatcagcctgctgcaaacaaatatgggaattagctttatgtatcgatcattactcaccgaaaagctttcaacccaccaattagttcagctccctttaaccagttttgatattacgcgaacgcttagtatggtctttcaaaaacaaagctattatgaaactcagtatcatcaattagcagatgatattaaaactattttagcgaaataacaaaggcaggactaaaaatcattcaactcattttgtccctgaatctttgaccgaccgtctcctttaactccattagtcatgaacatagtcacattctgttcacatatcattcacaaaaaagtcataactattttttataatgcatgatagataacaaaattagtttgaggacaactcagtttgagaggagcattttcttgcaacgttcagccacctacaattccgttcactggaaacttccgtcaattattttaatatttttaatattgagcctgtctatatcggcttatctgctcctccactacagggatcctcaaataattatgaatcaaatcgcaaaagatcaaagtggtcgaatcattgataaaaaaagcgttgtcgcattatcagcagatagccacggtgatcaaattgtcttgggatttacaaaaaatgacaatttgattgttcaatttcggcaaagagtctttggaggatattccacaaagggctatcatatcaatcaaatcacaaatcatgattttaataagccattccaattggaaaataacgtaaaccagaaacacattaataatttcgtttacggtgtcttaaaaaaggatcagactgcaccacaaattaagggtaaaaagctatctttgatcaatcatcacggtcaccgcattttttacgcatttaccaaaccgaatgagagcattcaagttcaatttaatcattaacaagcaaaaaacagttagtgcaagtttcaatgcactaactgtctttttgcttgggatcataacaaattcaagataacagttgcctaaagaatctccaacagttaatcggcaaccagccatttaaacagccctattcgggtccgtttttgtggcttgttaaccactggcagaatttgaaggaccgaaaatgcaagtgaatttccacggtaataagcaatatacttaggcttccattcatcaacatacttgtttttatacgatctcaatccttcaaaactatatagatgatatccgtattcatagattaaatggacgattctctcctgagtaaaactaaagcgagatgtcccaacatttgaaagaggtgacattcccaaatcaaagtattgatacccttcctcatgggcataatgatataaattgaccaaaatgccatccataataccggatggtgctttagacgaagacctcatcaaatcaattgacgtgatttcatgattaccatccggcataagatttgcaaacgcaacaatttcgccgtttggatccctcatgactgcaattggtgactcatttaagtacgtctcatcaaaaaagccaagtgagaagcccttttcaggtcgattatcgagccattcatcagatattacttttaatttaccaattagtccctgatcgaatggtggctgtaaaagctcgaactggtacccctcacgattaaatttattcattaaggcacgttcgccccgatgacgcttaccactaagcgtaaattcgtttaaattaaccaatccatcctcaccagttttaataaaatcaaatccgctttcgtgaagccgcatcgttaaatcttgattaatttcataaaatagcagcttataatcctgtttatcagcttccgccataaagtggtcaatagcggtcaccattttacctttgtttccaacaggttctcccatgatcaaaatcttatccgctgttttccgaaacataaagaaaacctgatcctgaccatcctcctgataaaaatataattgtttatcacgaagaaaggcaagatgactattttcatttccaccaaacttattaataacatttcgaacacgttcagcatcaaatggttcgtacagccacgacggccgatcagcggacaaataccgattaacagcaaatagtaccaacaaagcaatgaccaagccaacaaagccaaccaaccaagctgcttgcgatggaaaaagatacgccttgtcaaaatgcaacggcgtatgtggatttgctgcaattccaaccaacgtgtaaccgataaaggtaataacaaacaatgatccgttaaaaagcaaaacaccccatgaattggccattcgatctcggtaaagaacctttcttgataaccaaagaagaaccagaataagaagaaataacgtgaccatccgccaagtgaacgcttcattaaaccatgtatttaagaccgaaataattaacacaatcacagttggccaaaaagcacgttttgtccgtgcccatacgccacttgctaaaccgatcaataaaaatgccacaataatgttcataatatggctgacaaagaaaattgagtacggaaatagtcgaatataaagccgattaacaatcacaacattgggcacagtcgcaaataagagcatcattattcctgagaaatacataaagattgtcagtaggatttgtgcaaatcgtcgaattaagatttggggcagattatctaggaaggtattaatcttattcccagtatcatgtacaaagagcgctgatccgaccacaaaaggcactaaataataaaatgtccgataaagcaggatccagaccaaagcatcactccgaccaacaccaataaatccaagaccgatgataataaagatatcaaatgaaccaagccccccaggaatcatcgaaacaactccggcaacattggcgaccacaaaaataggaactactgctgcaaaatcgatgggtagccccatcaagtaaccaactaggacaaagaaccccaaagcacttgaccactctaataatgatccggttgccataaccaattcctgcttggtcgaaagatcatgaaaaaaatcggattggttcagtttggtgaaaacaaaaacagcagggaaataaattgcgccacccaaaagccatatccagtaatgagagaaggtttgaccaatgccaaatccaaaaatcatgattaaggccacaaaacacaaaagcgatagacctgaaattaaaaataaagcaacctttgaaattgcataaagaatttgcttacgagatgcccctttaccataaaaatgagctcgaagacttgcaccaagtaaaccgccaaaccccagcagattggtaaaggtattgacgacccaaccacttttaacaatgtaccatggagaaaacttggttggtaaaaatcttacaatcgaaaaatcataaatcagcattggcaatatcgaaacaaaaccaattaccagcattagcaaaagcgatagatctgactgatttgctaaaatttgtttaaactcttcaccattaatttgccgaacgatttttgccaattgtcgaacaacgaaaattaaaacggaaaacacaaatatcaatttgataattgtcatccgtttatcaagaaaggcttttaactttgccaattaactcaccccaaatatagatatcttgttttattatgccaattaatgacatggataacaaggaatcatgcccgaatttatagcaagcttattagttggttaataaatcctcacaatattaaattttagaattaaacatcattcgatgcctgaatcatctccaccatctctgacattatttgttaatactcaaagtaacatttactttcaacaagtaacagttatttagtcggcaaaagtgcaatttcgcctacgtttctcatcgattctttttcagccaacgcttttgctgttgatcatctaccaaacaagtatcataaagaattgttattttcttttatatattgatataattattaacaagataatattattaattaatcgtgttttcaacgcgttcacggtaattgtcgctagaagggacgatcaaagcctacaagggggggcttaaactaaaccaattgtccagatacggaagactataaaagctgaaaacgcctttgacagggcttaatatttgggggatatcattttgcatcaaaataataaaaagggatacacttttatcccaaagtacataattatttttgtcactatattattaacgggtggattactttcagcctgcggaaatggccaaggaaatcgctcctctaaagatcactcatccaaagtaacagcaatcagtaaagagtctgacaactcagattcaagccataaacaagctgaatcaaattcaaccagctccaatacgcaacatcttagcgcaatttctcaaaaattagtaacggctacagataaagaatctgccggtccaaccagtaactattattgggtgaacggcaaggcacacattaccggttttagtcatttaaaggctggcgattaccgttttactaacgacaatcaaggacgttctgccactgccagagcagtattaacatatgccgagtatcaatcatccaaaggctctcgacaaggtgaaccactagctcctccagcttggccttcgagcaatccaaaagttgcaatcaattatagccttactggacgcacttatcatggttatctatacaaccgtagccattcaatcgctgatagtttactcggcagtaaatcctatacgtctgaatataattttactacgggaacccgacctcaaaatgttggtgctgatcaaagcggtggcatgagatatgcggaggaaacagccgaaaattactggaacaattatcccgggactaaaaacacaattgactatgaaaccactccggtctacaagggaaatgaaaatatccctcgcggatccattgtaaacataaagtcctcggatgatgtcctcaataccgaaattgttgttatcaattctgtggaaggtattaagatcaattacaatgacggtagtagcaatgctaaaccaattaccagccccaactcgcgcacaaaaaagaatcactcatctcattcgaatggcgattatcatggaaattcggctcgcacttcaaaacgccaaaccacaaatagtcaaacgaccacaggtgcaacaagtcaagccactaacaaaacgactaaggagggccagtggacggttgctgcagccggtatggtctttgtatctgacagtcaaaaatattattctcgagttaccaacccaactaattatcaatatgtaagtgagactcaagccactgctaatggtgcaacccgagctgcccgtggaaatcaatacgcacgcccttaaatattattaggcaagcctttatcatttcattcttatttgcggtgtgcggagaatttatattctgcgtgttatattatatatttgggcatttcatcgctttatactggcttcaattaactaaagaacaacgttaccttcaagctaattcaaaaagcgcattgtatcagtactaaattactgatacaatgcgctttttattttctaatttaagccgattctaactctcttacttaagagtagtagcacctctcgctttaataccagcttataaatgccgatgttccatatatgttccataaaaagtttattttttatatttttcaagattattttcgtaaaacaccgtatataaatattgagaggtgaatgaaatggaattacttgcaaaatactatgatggaaaaaataatgttttactttttgacgacaaccagattctttgtactatcgaaaatggtgatgttaatgcttttgaaaaactgattgatataattgaagaatcagaacccgaagaaattatagagtaacaaaagccgtctgcgaaattaatcgtaggcggctttcactttttgtaattcggccaatatttttctcgcaaggcttcacgaaccttaagagcctcagctagtgtcctaacattctggctatgttgcttccctttaaattgaattgctacacgataaaatttagtaccgctgcgtataacaatcgaaatattccgataaccagttttattatggataggcactttgttatttagttgatgaagattggtgcctggtgtctcctccatatgttgcttaatataccgctttataccgttcattcgctcgtgtccacaacttcgtgtattgccacttcgtaattcttgtgatgaaagatcaacttcacgcccacaatcacagtgacaatgccaataggttctgggttgaccacccttagtgtagtgtttcggtgctcgtttcaaaacagtcaaatggccgaattgctgccctgtcaaatcaattaattttggcatacaaccacctactttaaagcatagtgctgataaagatgtgccattaaaatcgggtctgttgatacgtacgaatgcagtgacttaataacctcagtcattggatcgctattttcaacattgctttcactggcgtttttaaaccatgaattaaaatcttcgacgaaaagtgaaaacgaacgagtggcaacttgatcacggtactttagcaagtcacgtgtacctgctagtcgcttgaccaccttccagcttgccttatcgatgctggtaacaccattacggtaatttgagatggaccctcgcggtaccttacttattttagcaatctcggttgctggtatctctcgattagcaatcaattcttttgccttatcaagatcagtgccgttttctgtgatgtcccacgatttatcaacttttgccattctaatcctccttgttttccttttctagctgtttaataattttgtcgatgtcatcatctatatctagtcgccatagattaacatgatgaagtgtctcacaataataaatgttacgaatatctttattcatcaatttggcaaaagacacggactcttttaagtctggtgtaagaagcccaccaccaatcaattggattagtggtgtcataaagagtacaaagttgtcactaatgcctttccattcgctttttgggtgttcacccattgctcgctgctgaaatcggatatacgttcggaaattttcaaaaaataatttttgcgttctgttcataaaattgccttcttagattaaatcaagtccatttcgccgaattgcttcgtcaggatccaactcaatgcgatcatcatgtcaatcagcattgtttaccgcctgttcatctaataatttcgaataataatcaatgtcagaaagcactagctttacattatattcagcgtcataaacagcgctattataggttcgcaatacatcctgagtatttttaatcatagacaacatcccagatttgacgacgcctccgcccaacatgccggaataaattagatcagaataaacgtttaattgatcaaaaaacagatcattagcagaaactttgccatctgcattagttggattgccggcaaagtccgttttaaatttgtccagataatccgtagcagtttcccgtaacccgttcataaagattttttgttgttcattcataatgagtgcccccttaatcctcgtcagcattttcaagttcatcttgtaacgtatcttcagattcttgtagatcatcggaataggttactgcatcatcgatgtcatcaggccataaaatccaaacacctttttgtgtgccgaattcttcatcaccaaatttgaacttcccataagtgtcaccgtctaacgtaacatcaactgtcttagcattatcatcatcaacataaaccttactaaattcaacttttttcatttttaaaatctccttttccttaactttcaatacttattatatactatctacacaatgtgtcaatagtatttacacaaataatttaaaattaagcaaaataaaaaagcccaccccgaatcaatcgagatgagcttgatatatcaacgttttcacattgtgtaaacagaaatacaccttttgttttaatgtggaaacactatttagttttaggcttcgacttcttaaggaacttgacgtaccacttgttagatgaaacgtaaccctggccgttgatatacaggcgagtaattttaccgtgctttaccggtgtggcccagaaacgtgagccagtaccgtatctatcggaacgtttgttaactttcttgaagtccattgagttgtacattggcagccacttcatacgaacctggtagagaccaggggtcacatagtaagatggtttctcactagttttactaccggatagtgagccatcaaagtcatatgatgcatcgacaccgtgccagttatcgctaaactgccaggcattggcgttggctacaccaggctgagaagccccataagatgccacccagatatgcttgtcgatcaattgtggtcgatgaatgacatgcgtaccagccgtgccattaaaccaactagctgaaccataagttacgacatttttatagccgtgatcaattaaatatttcaaaaaaacgttaacttgtggtgttgaattgtatggcagcccaggcgcttcaacatcgatcactagcacggtcgatttgtctagtccatacttcttaacccatgctaaaaagtattttgcttcagctgtgccataaccttgaaagaagtgataaacactgaccgccccaaataccttaagcgagttgatgacttgtgcatttgctttagggttcaaatagttggtgccctcggttagtttcacaactgcaaaatcagcacccagctttttaaaattctgaaagtaagataccgaactaccttgatagctcgatacatcaattccgagtttaggcatttgcatcactcttttctacgattttaggtgttgcagaagcgggttctgctacactttcaggctttggtgcggatacttgtgcgactgctgaagcagagcttgtcggtgtttgtactggggtggccgatttttcggccggctctgttggttcaggtgaagtagcaggctcgtggttgtcataacctaattttttgagttgctgataagctgcttcaataatggcgcttgcgatttcaggtgttacccatttgtacccggcagattgagcagcgttagtcaattcttgaaccgcagccttttggcgatcggattttgacataccgacccaagtcgcaaacttagtgacaatcgttagagccacgttttccatgacttgaaattgcttgttcttagtatgagtctttaagtatgggacggcaactttaaagatggcataaagcaaagcggcaagggatgccaagatacctgtactctgtaaccaattaaatgcgtctgtgatctgtttaaaagtttccatagattattcctccagtttgccgtatcgtgcacgataagcggcgttttctttttttaaagcagcgtttttctgacgaagatttttgttctcttcttcttttagatcgatctgttcctgaagctgtttcacgatcttgtcatgataatctttaaagcggtcgtaatcatcatccatttcatgaaacttggccgccagatcatcataccgtttccgtaagtcctcattatcatctttaactgttttcaatataaatttctccaaatccgtgcgctccttagtcgcactattcgcatcggctttactcgaatgaataagcccggcaattacgcctgccagcgtaacaaccgagccaaagaacaccgttaaattgtgcgttatccagctaaacattacgtcgtccaccacctcgcatagcagtgccgatcagcagcgcaattgcgaggctggcaaacacccaagttaaattaaagcgaatatcaaaaacgccccggatcataaatccgaaggcgagataaccaaacaatggggcaataataatcatgccggcattccttaatgtaattgaatcaagtaatactccgcttagcaggacaatcccgccaatcactagtaatccggcaaaccaccaatcatcggcagcaccgaaaaccacatgttccgcaaagccaggaggtggtggtggtgtaacttctgggctatccaaataattcagatgaaaaaagatatacgtgccagccattaaggaagctaagccgaaacataaatgcgaataatattttccaatcctttttagcatttttatcacttcctaaattttgggtaaaataaaagcagacgttttccggcgtctgcaacatactattgtatatgaatgaatgtttagttagtaaataagtttccttaaaactgactaagttaattatacgatatgatgttgaataaaaaaagtatctacaaaatagatgccaattcatatatatttgggagtatatatggagatacgaagaaagctacttagactgaaatctaagcacatttatatcacatggttttcaaaatcaattaaataaaaaatgcttaccaattaaattagtaagcaccatggggttacggtgttcagggaatatctttattacgagagggtactcataataatgcttcttaacataaccccagtattatactagcagaaagaaaacatttgtcaatcccgttaatttctatactaagattcaagttatcaatgattcattgcaaataaaagcacctatctggggagatagatgtaacatcatataggggcatatgaataagaatatgaatataatttggaaagatatattctgaggggaatatattctttgagtatggatgacagcctttggggggcgctgtcatccacaaaaatattatatcatatttttattgaagttgaatacctatttatcagtatcaagtgttacataataagtcataaaaatatccttctttctattcaaaagtaccagtaatatgaatatatccacaaatttttatagttccttgtgttatgggcccatatcctgaataagaattttcgtagtaaattttatttcccgatgttgaacatttagtaatgacctttcctgtaattccggcaagagatgcgtaggtcaacccaaattcaccataaacagtgtcaggattaaggtcaccaaagctgtgaatattagaatcttgaaataggatacctttttgacctgcataattaccaacatcatcatctttcgcaataacaaacaattcatacgtcattttggcattgtcttttttgtaaaaagcattttcaatggtgaaattagccatcgaaacacttactggatgccaagcgtctgcttcaacgcttttcaaatcggccatagtagcggcctgattatcccccttatctttcgaggcgtccgtaatagtgggcgcaatgctaaatgtctgtgcggctgtaaatgtttgagcctgtcctgttcgtgcaacgtcacttgggacaccgtctttagtgatgtagggattgccagttgttttatcaattggcgcggtatcgaaagtatttttacccgtaaactcttgatctgaacctgttcgtgctagatcagacggtaaactgcttgcgagtaatagtggattgttgttgaccgttggggtggtgtcaaagttgttagcacctgataagtgagcgactttggaatcgtcagcattaataatccacccagtatcagtcacagggttagtttgggtagtaatttttcggtgataaaagttaccgtcaatgttaatgccatatgcgtaccaccaaccgtcaccttcactaataacaactgaatcaattataaaatcgtcatcccgaatataataaactccagaagtagtgaacttttgagttaataaatcataaaactttaatttagctgcaatggttgaagcaatattataactaccagcattaaatagtgcttgcttttgccaatttgaggtgtcagaggtatggacaattttggaatcatcggcgggtgtgtaaccaattttatcttgtttagcgttaacttcttcaattcctgcgacatcgctagcaggcttacgcatatctgaaacgttaacttttttatccagttgctgattaacgtcaaccgtcttggcgtaagcattccaatcactccaaacattggttgtagaattgaaatagcgagttgatcgaatgttgttaattgtgtcatctaaagtttgcatgattggcaccgtcttatctccactaccaatcgtggtcaaataaccagttcccgaaaaaccacttggagcatttaccactgtggtatcgttgataattctggtaatgctgatatctaaaatggcattgaaatcagtacctatcgaagctgtctcatttggataatttaacgcatttcctatcgactgagaaatcatctgttgaacatcttcacgggacagggtaccactgtttgaaaccataatggttacttgggtaccacgaacgatgtcagtatatagatccagataaatcgaagctgttgtcgcattattttctttagcaatcattgtcgctccggcagttaatggaataacactgaataatacctcttgattggttgaattttgtttggcatagaggccgacaccatagtaaatatagtcttcattcacatcactgttatcaatggtcactcctagccgagacttgttgtcttgtgttgcaatggctttaggtgttcgcgattgcttatagttaacactagttaatgcttgtaattgtgaaaccgaatcaccggtaatatcaccggtaatcgtcactgctttagtaaaggtaattgcgctgattcctaaagcttggttcatcatggttaatgcttgattggttaatgtatttttaccccaagttgctggcattagttaatccctcgattctgtataataaaacggctttgagtcactgccacatttccaacatataggctttgttcatcaatttgactaaattcagttccattaattcgaattgtcgcttccactgaccttgccagttgctctgtcagaaaccgaacggcatccggatcactggcgtattgaaatggtaatcctgtaatggtaattgttcgcgcttcaccaccagtttgccacggttgaataattcgaacatccgaatactgacaatctaagatataagcaactgctttaatgatagaatctgtcgttccgtcagccgtcgccgctaccattgctgctcgaattttaaacttgtaataatcatcggttgctccagcccgataaacgccgaactgttcaccaaaataatcaagcgctttaccggttaaatactccagcgaatggaaaatattcattttttctaaagcaacgtcatagtctttagaccgagacaaaatagcatccatcaactcatagaacttgctgccatactcttgattagttaggcggctcatcttgctcagcatcgtgggcgtgtcgtccatttcaatcagattatcatcatgtttgatatcagccattggttgtcgtcacctcaatctcgtcagcattaactactggcgcttgggtaatccctaaagtcacgtcagttgccgctaattttgttttatcaagccccatctgaaccgtaaacgaatcgattcccggaacttgagctaaagcgccatagaccgaactgatataaactggccgtcccatatgcaggttattgacataattctgtaaagcgttcagcacatcatcagtaccgctatcagcattccagttgctattcgccttaaccgtaattgcaaagtaaatcgggacttctgttgcccgattaaaataaattgtttcaggtgtaccagcgatatcgtaggcaattgccgataagctgccaaaggtttgagtgccagcacctttagctttcctcactgcgttagcaatgtcttggtcggtaccgccatagacaacaatttgaagcgcatgagctggtgtgccgttaacatccgtgacgccactagtgttgttatcaatatatttatctcgaatcccattaacactatccaaggcggtataaataccgtcaatcgttgagccaatgttagcaacgttagtttctagaatcctttgcctaagtgaatcatccgtttcttcgtccgacccaccaaccgccggctgtggattatctacggtatcaacaccatcaaccggtgtcgcaaactcagttatcgtgtgggcttgcacattggtatcacttgaataatcttctgaaaccaccgatgcggtggctgtaaacttgccatcgccatcatcgtcagacagtacggtatcttcaacaagtacaaaataggtaccatcgtcagtcatgagttcggttgtcccaccttcaagtagaaccgcacttgtaccggtaatgttgaccgttgcatttgcctgttgggattggttacgaaaaatcccccgattataagctaagtaatcgagggaaacaccaccggcaaattgcacgtaagcattcagccaaacttgttgttgcttttggttctctttccaattgttataagcaaccgctctaattattcgaccataattggcttgtggcccgacattaatatcattgcctaggattttcttgaaaatggtagtttgcttgctgacttcttcgttgtaattctcaacgtaatagcctgtatcatcaaatgccactgctatcacctaccgttaacttcaagttgccttgatcatcgtattggttgccagaattctgaatctcggatgaatggatattagcggagatatcactggttcgtttagccagatcatgtgtaatctcaacgccgtcaaccgcatcaacccgtggctcttggctcattaaagtatcagaaatatcttgagccgcataattatcatcgtaggcttttcctaaaatattatccaaaggtagcccacagtccggcgcaagttcgtccatctcgccttgctcaatacctagaacttcgccacaagattgcatgagttcgtcagtaccagaaacttctactaagtcatgagaaagttcatcttgaacgacatcgccgtctggcttaatcattaaatctcgcatcaactcacctccgaattaattgctacaacaatcgcatcgtttagatcatgttcccgtggatcttcttcacgaccgaaataccccttgccaacttcatagccatctaagcaataatcatgaaccaccatcgtcacttcagtgcccggcaccagccgtttaggcggtggcgtaatcttcattgtcccagcgccgtctcttggacagatcggggttaaataatcagccatatggtcccatatttcatcaatccagtagatgctaaaaggaacctcaacgtcattgataattcccattttgtcgcctgaaagatcttccggcagtggttggatgtcagcaatatgcttggccttgtcgtacttaacaatcttgccgactaaacaattgtgattatctcgggaagccgcttcggcaattgcttgagcagcttttttatacggatttgtaatttttgccaacttaatcacctcatttagcaacagcaccatcaaccgtcattgtcggctgcgtgccatcaaaactatacgttccactttgagcaactaacgttttctgaataaaatcgccacgaacctcgtacgtactgtgtacggtgatttgcggcaacagataagacgatgattcatacagttgttcgcctgagtcggaatcatccgaatacgatggttcacttaaaagccccgacgtgtagtccaaaatgatatgagtttttttactctctttaagatcatcaatcttaagctgatcacgatcgtaaaacatcttgctcttgcatcgtttaactagcttattaattgcatccaaaggcttgccggaaacggtatagccttttttaaacggcttatcctcgtctaacttcatggatgaaatctttataccagattccttagcaatcttcttaatcgcaaccgagggcttaacacccttcttgaaagacaagttactgtaaacctttttcttaaccgtgtaacgagttcgtttaattttggttttaccggcaatgtgaacatggccttccttgtaatggccgaccttcttaccatcctcattagaatagtaatgaattcggcgcttaaccgtcttgcctttaacgttgaccttaacccgtttatagtgaccgactttcttagtcttttccttttggattgacttagcagaaatgttactgaaatcctgaccggcggagaaagtaattggcacagtcgttgtcacaccatcatactgaatcgggtcaaccgacttaatcttgccagcaccaattaacatctttccgaaagcttcataggaaataaaaaaagcgatttggttcttcgcttttaaatagttcctcatactctggctggtattaatgaacgaggcatcagattccggtggcgtggcgtccatgttgaaattaatatcaaacgtaaagagcaaatctgaaccaggccgcaagttattctctaattcaagcgtcttgccatcggttgtcgtaatcgtgcaataaagcacggggaaacgtagtaaattactcattgctatcactctctaaatcgatgtcggtatcatcacttgtatccgcattggtcgtttcattagtttccgcaaccggtgtatcaaagccagctccgttagcagggcgatcatcaaacgttaactttacggtatcgttaaaattatcgccattaacttcaatctcttgccctgattcgtccattggcaccacatcttcaattggatagtcgtttgagttaagagaagcaaacaagcgctgattaattacgagtttctcgccattaactaaggcgtttccctcggcatcccacaaacgggccgtcaagaaattggcgaacttatttaaatctatctccatgcgatagacacggccaccaagaacgacatcaaacggattgccgtaatcatcttcactgacatctagagtatctaataacgccatttaaccacctcctaggaaactcgaatcttaacgcctaccggcaaaacattaactgccgacttataagaattcatcgaaattaatttagcaattgtcgtgttgtaatcatccgccaaactagcgtaagtcgtcccaagtttagtcgtgacatatttcttagccgttggcttgttgtttgtcttgctcttcataccactgctggcactttttccactagtctttaattccgaccaatcaatgaactgcaatccgaacgtaatggttaaagccgtctcgtctttgttgtattcccgatgaagcgctgtaaacaaacaatgcttgtagtaaatgcgtcctttataggtcatttcacagccttcagctttccacttcaacaattggttaaatgccgttcgttgctgtgcatctgtccccataattcgcgctgtaatcgaaatatctttctcagtttgttgtgaatgggtggcagtcggttcacctttcggtaatgcgttcggcgtaacttgaaccgtattatcttcggattctggcactgacgacatgaacacaatcgcactactatggccatcggtacgataaagcatcatatggccggtattaaattttggcttgttgttagcaatcttaccagctatcttgttcttatttgcctgaactttggcagcagtagaacgtttcgccagagttgctttttcagctttaactttggcagcatattttttgtgtgccgcaatatgagccttctgcgaacccttataggtctcaatcatccgccctagtgtcgctttatcactaccggaagccttatcatacttagcttgtagaactttggtctgcacgccaatcagataggaacgattcccctcatgttgagcgcgcagactgttgtttttaattgcactctttaattgtttggtattcaaatatgtggttttagcaaccattatttagtacctccaaacttctcaataatctgtcgagccatgttctgacgttctgaatttaacgcctgtttaatcatcttggtgattgctcgttgatttaattcaacgccaccgccaacattaaactcaaacttgtcatgcgtttcaatatggatagttggttcagttttagcaacgtgacgatagctagaagctgaaaccgccggcttcttgataactcgttcgagttctctcaacattttgccaacgctcaaagaagttttcatcatattggttgccatcaccgcagtatctttggcagtaaatactcgcccggaaacgttcggcataaagagttcggcacctttttcgccaacaattgaagccttgttagtttggggaacaccgccccttgcataacctttaagagccgcttgaatttttcttgcaccagcaacgtgttgagctgtataaccgccacgttcccaatcggttgagaactctgacgctaatgatgcaacagacccatttccacgaagcactcttttaaggattgaactattagcaccatcaccatgtaaggcaaaatctatttgcaggccagcatttttccaactcatgtgatgttttgcagcgtatcgtcttagagctggtccacgatcaagccattgcccaagtccaagagcaccagccgaattactaataccaggattcaaaccaccagattcaaattcccagttccctaaaacagcttcgatacctttcatagtggctgcaggataggcttttttaattgcagaagctaatgttttagcacgacttctaaggctgcccgatactcccaacgagccaattgaaccggctgtttcatcttgtagatgcttgccaacccatttaagttgtggtgcgatttctttggctaccaacttagataaagcactgctgtgcttattgttagttttcttattgccagtagaatgaccatgcattttagtgacatcataccaaccatgagttgataacatgttttctttcaaaggattgcctctagtaactccgatatgcacatggggaccgttaccagctccgttaagttggcctagagttgcaattttctgacctgtgtgaatagcatcccctacacgaaccttgatgttattcattttgccaaactcttgataaatttccttgaatccatcgtcacttttggcaataataacgtctcctaagtcagaaattccaacaccgccgatcttgatgacattaccaccatgcacggctctaatcgcagaaccaagcgggcccgagaagtcaacaccatcatgcttagctccggctccatacagactagctcgggatgccccaaacggatcactttcagataatccgggtgtatgtctccagttaccaccggcaccgcttccgccaccactacgagcatctttcatctgtttccaaacttcatcagcccacgggttgccatatttgccatatgcacccttagccgtgttggtagcgccttttgataattctgtcccgtgcaatttaatattgacggtcatgttcctcttcagccaaccgctagggtccttagcacttgagttaattaatttcttcaagaatgcattagatacgcctgaacctttggcatagtgagtgataccactagcctgcgataatcgctgcatctgtgtgccattcagtacggcatccccgcgctttagtccgatcacacgattcctaccctgcggtgcgtatagactattaccacggatgataccttcttgacgtggcccagactcggcatcgttaaccatcgcaatttgatcttcacttaactgaccgttcgagccttgagcataatgaatcgggttgataacagaattattgccgccgaattggcctaatgacttatcgatacccttaatcccgttattcaattgattaattgtgtcggacattgccttatgcgcgtaattgtccatgcgaccaagtgcgtgcccaaatcccgttgctgtatcatcagccgcgttggttacacccttgcgaacttgattcatttgaccttgaacgcctttttgcatgctatcaaagtcttttactgaactcttacgaatgttgttcgtatagtcgccggttttgttgtagatacttgaccattgagagcggttctgtttggataattgtgataactgaataacgctacccttttgagtagcgtcatagtcgtcaaccgtattctttttgatcttcttggtcgatttagcagtgtcagaataggttttatcccaagtccttttggacttcttactaaacttatcaattgaaccatttgcttttgaagttcctaaaccggttgtgccgttggcatagccgggtagtgattgaccataattcccagacaaaactcttttggtagcttgagcattcaaaatatgttccccaggctttaaatgtgccagttgtggcccattaacacctaataagcgagcttttcgaccacgaaccgtgtaagccagttccagtccaccttcaccaaccagtgcagtttgagatcgactgattttaccaccgttcgcatggcctggcaaagtttgaataccaagtgaattagctttattttgccttcttcgatcagttgcagttactcttcgactatttgttctagtaccagggctatagactggtaatggtaatgttgcttcatttgcggtttttgcatgactattgccacggttatggcgtgcgatggtattagtcaaaccatttttcgtttgccttgttggaagagtcccaagtcctgctaatgcattttgccgaagaatttttccaagctcaccgccaagcttaccggttgaagttactaatgagttggcaacctctgtggcttgtaattttgcttgtttaacaactttttctctttgttgctctgcccaatactttgttttttcatactgtttttcagccgcttttgtcgtcttatcatattgatgctgagcaaatttcttaattgattgatattcacttgagtgaacaccataaacctgcttagccgactttaaagtatgtcgataagttgcttcggcagttgaaacttgtccgttatatgcttttctagccgatataagggttgctttttctgcccggttactatacttaagaatcgaacgatactgcccgtaagaaatattgctagtactattttgcaatttttcataaatttgccgttgcttgttagaacccttactggtgattttgacaatatcggaatttagtctagcaactaaagccgcccgattatttccacctcgttgctcatcattttttatcgcctgaaggtcacgattaataacttgttttctactattaccccagcgagcttcttcgttataagatttttgagccgttgccgcatgaatagctccaattttttgcaaataactaattgacttattgctgcttgtttgttgccgatttacaaagcgatcaagattctttcccaacttgtcgtaaatcaagttttgactttgatagtcggctgacaaatgcttggattttgaccaggtatcataattagtcttaatccaacctttatttgcctgctcaacataaccaagagctttcctggtagttaactgagcatcttttggcaaactacttaatggattaactgcccgtttattacctgttcgtgtagaactattcttttttgggggcctgtttgaaaaactatcttgaatatgtttcccagctctagaacccatccatgaaccagctgctgcgcctaagcttccacctataagcgtaccagcaggccctaagaaactacctaatgcggcgccaccttccatgccggcaagtgtgcccccaaaattgccaattttagaaccggcattgtgcctattcatccccattaaggttgttgaggttaacgcaacatccagccaaggtattttagagccaaccattttagccccggatagcagcttagacattcgaccgccctcggctatttttggggctgatttttctacattagatgccgtatttccaaataatccacttcgaaaaagccctttgaccggattctttgatttagtacctttttctgaaggcatattcatcgaattcattgcaacatcttcggcaatatcagccttagaatttcccgttttcatgttgcccatgccatgactatcgctaagtgcagcggcggctttgcctaacatcttatagctaacgtaggcagtcccggcagatgctgcgatagcagttgcataaccggctaccgttttaagtggtttaggcatcgcgattaaatcaccaagtatcttgttaccaatcttaagagcttgagtaataccaggtagaactgttttagtgaagtccaaccccatgacgttcaaatgctgcttaaaaacgtcaatttgattttgccaggaagacatattcttcttggccagatcagcaatgtaaccatttttaccgtactttggtgcttgggcaacttgtttgttcaacgacttcatctgatcaacgtttttagacaaaatcaaagcagcttcttgcccagttgcaccaaacaacccatgaaaaacggccgctttttgagtatccgtcatacctctcatatgccgatttaacagctgaaaaatattgtccaaagacattaagttattttttgaatcacgcagatctttatcatgcaaaccaattgaattaagagccgcttcaccttgtcccattggccccttacttggagacaataaagagttaatatctttacgtaagccagtcccggcaacagatccgtccataccattgttagaaagcacaccgatatcagcaatcgtcccggataatgattggttaccactatgagcagttgcaccggcataacgtaatgcattaccaatgccactgaaatcagtagcagataaatcggcgccgtatgccatctgattaagaacgagtttcgaataattggccattttctgtcgagaactgccagcagcctttttatagccaaattgttccaacgctggcgccccatagccgactaccgcactgtatggatcaccagaagctcgggcagcttgaagaaagtatttatgcgaagctaattcttgattccccgaatagccacgccgaatgagttcttcgccacctttggccattgccgtcggtgaaaccccatattgcaaagcaaattggttgttttctttttccattgcccgagtttgagccttggaagcagaagccgactcaccaccagtatgcagtaagttttgaatggttttataacggttctccaattcggttgcttcgtcagcggacttcttaaaggcggccgcaacgggaatcattgccattgcaatcgtattgcccatattggtgagccgactaccagtgtcttttaaacgtccaaaactggttgtggttttatcagtctcattgcgagtccttcgttgagactctgagaccttgttacctgacctgttggctgaattgccaacccgtgacaaatgttcatcaaccttattaaggttgtcgttagtcttttgggttgcttcgctattagtcgctctattccacatgccggaaattttgtcttttgtcgaatcggcggcccgtcctaaaagcgtggtgtgcttagcagcactattcaaagagttgctaccctcattgccggtacgcttggtagcatcaccaagccggttcactgaatcaatgctttggttaatcgaccgattcatttggctgtaattgcggtcagctaaatcacccgtccgcttgatctcgctattagcttgagccattccacggcttaaaccggtagtatctccagttttagcaagctgtttattgacaatcgcccacttatcaaccagtttatcggttaactcattagccttaatcaaaggtgcaagatcagcttcaaagcgaacgccaattccttcatcacgcattaaatctccagccatttttcttacacccctttatttaccaaaaaggccggtgtttacaccaccggcggttacgttttgcaatcgcttgtaatgtaaatcggccagtttaatgtagtactccagctctgttgcggttgcttctcttaattcgttaatatcgacacccagcgcctcgttaatgtaccagtatgtctcgtcttcttgcgccatcttctctgctagaaaagtatttgcttcgccaaaactagttttgaagaaaggaaaccgtttctatatagaagtctcccaaaccggtatgggtatcgaagtaatcccagttcaaagtttgcggtgagatcaagatgttgctggttttgttaaagaccgcatccaagaagttactttcccgaatcacaccagcggagccacgtgagtcatcaagaatggcaaccgcctggcgacggccaggaaattgttcggttacagaaatttctttttcgttctcttcatccaccgagccgtcaggcttgagtggtgcacttttgaaagtgaatttatgttgtcgtaaacgagcctttacatcgttagttgcagttttctttgtagtttcagtcatgagaaattcctccatttattttttaatatttgtatgtacccaaaaggaccactaccgaagtagcagccctttttgagtaacttagattaccgaatagccaaggttaacacacgttaatccccaatcacgggcagttaaagtgtttgagaatgaaccatcaggcgctttagttacccaactatgctttgattcaatcatttcattatccgatttggcagtaaatgagaagtacttcgatgctgccagcaaatcgtttagatctttcatctttggtgaagcttgggatagatgaatagtaaccgtcccgtgcttatcattggactcagaaccagtaccagttccttgggcatcaatgactaagttcacgttgtcctcagcttgggtccagccaaccatatcacccgattggaacccgaaaagagaaataccatcgacaatgattgacacattcttggcgttataaatgctcatcaatccgctattatcattattctgcattttgtatccctcctctagttcataaccgagccgttaattgtgacattatggatagcgccggaacgggtataccagaatgttccaccgttataagcacgtgccagaatatcggtttgtgactgttgctcacgagtgctgaaactagtatcgtaagcacctttgccgtcagcgccggttagaataatcccgttattccaagcgtcactaaggacgtcccgaacgatttgttccagtgtgtcaatccccactttgtcatacgatactttgccactcttggggtcttgtaaacgggcttggattcggttacgcatctcaactttgacccaaatttcaccgtgcagattatcgatgtactcaccggatagcgtgaagccttcggaagtctcgccaacggaactaccggtagtagtaaagtacacaatcacatgcgctttcttcatcgctgtaaattgcgtgttgttgtacttctgtggtgtgatgccagccacattcttaaacttccaagtctgtgagccaaccgtcagggatgcaaccgccccaactagaccagcatccaatggttcatttgccggatgctgaaggccaattgtgtagttttgtgaacccaaagtagctaacgtggtgtaatcctcaacttgtagaagtaggaatttaccggcattagtttcgaacatgttagttaactcggttgccgtattagcgtcgaatttatccagaacagcaaaataccagccattccagaaaaaatcagccaaggtatcagatgctttgcctgttgggtatgaaacgatcatgaggtaattaccgtgttctgtttggtcaaaataacccttggctttggcatatgtggctgaagattcatcatagtcagtcgctacctcgtcaagggatgtatattctttataattgccgcccgtagctgatgcaatcgcaccatccggagctttgtaatttgtaactgtcgatgtaccagcagtagcattgccaaccgtagcatttgccggttgttcagtcataattaatagatttccgtaaccgacattgggtacagggataatttcttggatgttgataacaacatctgcgatttgtggcactaacgtagttgccattattaatcacgctccttgttttctttaatatttgtttgagtaatttgcggcttatattgatcggcaaccgtgtagtcgtcgcgaacgatgtaagtcactgtaaacagaaaattgtaatcttgggtttggttcgccagaacttgtgttgtctaccaccgaatccagcttgtagggacgcatgttggctttactaaactcaattaatacgtcaggacgataaatcgccttacgaacagcctcaagattgtcttgagcttcataaggcgattgggcgtgcgattcaatttggactccggtgaagaacaattcgttttcaactacatcaatcgtggctgactgatgcgagttaaatgggactatggcaaagtatggaaacggtggtcgtttatcattgctattgccataggtggtttctaatccagtcgcatctttgatcacagcaataatgcgattcataaaatcaagatggctaaatgtttggctcatctttatcacttaccttcaattcataaatcacgatatcggaatatccctgaaaatctgtaattgatttaatgagatatttcattcccgttcggacatccacaaccacagaatctttagggaaaaacttggtaccgactagttccatgtcaaaatccaaatcagtaccagtatttcgttggtaagtcatagcggtaaaagtcccaactggtacgagtgcccatttggcttcaaggtcaggcgttctatcagtaattaactgatgcgttttaaagccgccgctagacgcacccttatcactgtcagcactataaatttgaattggcacacccattttcttgacgatgctacccatttttaaatgcatattagaacttccttacttcatagataattgattgagctaaccggccagtatcaaccaggggattatcaacaccatgcttgcgagcctttgtggctggcgcattgtgaggcgttttccatcctatgattgcttttcgaatgtctgctacaacgatgttgcccatatgatgcatacaaccctcagccgtttggcgactcatgacaatctcatggatttggttgcgatattctttagtccaagcattaaaccgtttgtcataagtctcagtaaagtaatgtcgaggtggaattatgacttccttgaccaaatagaacattacttgccccgaatcatcgaccagaatacctttaccattgccccttgtcctaagatgtaagttgtcataatccttagcgcttttgccacgtggcacgtgttcactcgggatagtcagatacttactgttaatcggcttgatatgtgcaccaaattccagtacatgggcaatcattgccaaattgccgccttcctctgacagaacacctacgaacaactcccgatgcatcagcttctttagttcaggaatgcctttttccagatggttataactcattgtggtaacaccgccaaactgatacgtggcataccgttgtcaccatatagcgaccataagcgataataatcagctccccaggtcgttagttgcagccactttaaccagtcctgtgaaccagctttaaagtaagtaacttgaatcggcccaactttttcagcagaaactaacgttgaagaggtaccaacaatgtacttatgaatagttagatatcgttctgccatctccagaatgtcagtatcggtagttgagaagccatcatgagccactttgatatgcgcatcagagatgtattgctgaatggtggcttcgggaacatcctcaaacgtatcaagagccgagtttttaacggcatcaatcgtcgtgtaatttgccattcagctcatccccttactttagttttgctttgataacatctacaacacctttacggttcgcactcgtagtttcagatttcagaagtgctgctaaaacacttttatctgaaatcgtccgaatcgcgttagttgcatccgccacattcatatttgccacatcaggggtttcaattggcgcagaggtcgacacattggttgctggtgtagtcttagtgctttgttgaacgtcttcaatgactaattgtccgtctgctactagtggtttaatgagcggatcagcaagggcttttttgaccttgttaacatcttttgaaatcaggtcattcaagcctcgcttgatcatcacaccattaattacacggttaaattgagttttgttttcaactttgaccaaaatagcgcctcctaaacattatcgacacggtttaccaaataagggcgacgaagaataatgccgcctaatcgttcgtacaaagcaatccggtgagtccagaagttgacaatctcttcttgtgagcgactcattgggtcagcaatcgcaatctgaacggtatctggctgattatcaaagataatcaaagaatccttgccaccagcgccagcgcccttaagttcaggaattgaaacgatgcttgagaaccagccgtttgcttgaacgactgccatgattgaacgtgaatcgtaatcactgtagcgacgattaagttcttcataagcatcaggagctaagcccagaactggtttgatatttgagaaaccgttgatcaacgtcagtgttttacgtgctttacgaagcacttctacaatggctgcagaatcagtgattgctgaaaatgggccatcagtatttgtagtaaccgtactgtcaggtgagttaaataatccgttaatacctttggtttgatcaccaagaaagcagattgaattttctttctcagcgattgcccgtgcagcagttgcaatcttggttacattgggtgttaagccagctaaatgtgcttgtttaagttcttcatccgtccaagtagcaccaacttcaatccgaaagattgagctgtcgactggtgtcatatcagtgtcaaccatcgggatgtcattagaacgttcttccagaagttttgcttgaccaaagcttctagctacgtagtaacgatatgatgttgcgccttgagggatatccgtataaggcttaattaagcttcgagccagaagcgattgttgaggtgcttgatagatagttttatcaatcgccttcaaatcgcgagcttctagcattacatgagagtttgccatgctgttgtcattcctttctattgagccgtagttttaccaactactgcatttccaacggtggcatcacttactcgctggagtagcgtatggagcacctaaattaagctgaacgggagcggttgatacttgaccgaagtccgtcttggaaacagatgaggcattgaatttgccatcgtccaagaattgaccgataaccgtatcaccagcagcggcagttttgaatacaccaccattaccaaccgtagccggatcgccagcttttacatcagcgctaatctgaacagtaaccgcaccagaacgcattaccggaatctcatctttggcatcccattgttcgacatctcgtgaatcccagctttgaatgtaatatcgattaagtaccacgccataaacaccagtgccgttagcagccggtgcaatcacgttgttagtcttagttaccgcaatgccgaatggaactacatcggctgcatggtcagtattaacaacataaggttggttagtagcaattgttccggcacctaatggaccagagacatagccggtaccttgaggaataaaattaggcattacttttcacctccgaatttcttatcatacaaatcaaggtttttcccgatctttgtttcgttggcactatccttgtggaattcgccaccagcgttatcaaagccggtattttctgcgatgtcctgcatagcgtcgaaataggtgttgatataaatatcatccttatctttctcgtcgaagctatcgttcaatttcttgatcgcatcaaccttgatttgtttatcatctttgctttcaaactcgtatgagtcgcctagaactttcttagctttcttttcgagtgctaaacggttctttacggcttcttgaatgctatcagcagcatcttgtttggctttcttagccttagctttttcagcatccttttcagcattggctttagtagcttcactttcagccttttctttgtcgtccttagcagacttgagcttcttttcagtctcttcagcggtttccttgctctgtttggcttgctctttagcatcggtaatctgttgcttataatccttaatttgagcttgaattttgtccgctgcatctgattcaagctcaacagtgtcgcctgaatcaagtattaacttggtcatttgattccctccattcgatttgtgtttgtctagaaccatctcggcagaatcgccaaacagattgacatcatgtccggctctgccccgatcaacaatggcaatgtggttgatcttgatattcttttgtgccgcatcatatcgcgttccttggtattcgcccgggttctcatcaacattggctaaaaagccaattgataactcatgtttgccgtctcgaatctgatcaagtgtcttctgatcagccaccgtcatggacaccttcagatgcctaccatcactctgcgcatcattgtgcgtcattcctacggcatattttttatagttagcaggtttaactgtttcgctgggatgatcgttcgtaatgggctttgagttagcagactgaacagtttccggcgaaaagatatcatcagggagcttggcttccatcaattcagacccgtcagagaagcgatatgggaacacacctggcttagcaattggacaagcggtgatattcagaaaaccatcgtcgtcaatcgccgaatccatgattgccattcggtcatatctggtaacagttttcaaatctgccaccttctattcgccgagtggaaccatgaagtaacggtctggtgaatagatgatttgcccgacttgaaccttgcgatacttgcgaatgccgttgtaccaacgtaactgttcagatccacgcttgaaatgattggcaacatcggcaattgactcgccttcttgaacttggtaagttgcatcttcataataagtgcagtcgttgggatgattaacccagaaattcttctgctgattagtcaatctcaaattgccatagtgagaggctacttgctgcgcacgtaccgttggatcttcggagtatacctcatcaactggagaaacagctgatgaactagccggtgctgaattagtaggcgcatcacttttagctagagtacttgatgcagagctgcttggataagtggaagcagcgtatgaagcactggaactggttggtgctgaactacttgatgcagaactaactgagctagttgttgcatcactgcttgaactactgtcttgtgccataataaaatcccctttttctagttttgctaggcatcaaaaaagacgctcatttctgaacgcctcatccctagtaatgtggctatgtgggcttgcaccatatcgcggtctctgcctagccactattaaattaatccctgtgcctgatattcatgaagttgatcggcaaatactggtaatgcaacgcatcggcattggattggttcacctggcaccatgccgttatcaccgccagcaggatcaccatatctttgtaaactttggtcaagtaattgatgcaaatcacgcacacgggcgtcttccattgactgccagatataataatcggcaccagcttcttgctgacgatgtgcgttgatttggccaagaatacttccagtctgatcacgagcgattaaatgggcgtgagcgctggttgcgtcgtcaattttggcaatctccttagcaatttcgcccgttccttgccctttggtgacgccattaaaaacggttgattctacttgttgggcgtattgatcatgtaaggtcgtaatgcgactaacattctccgcaatcttactttgggtatactgtcttaaaaaacgatctgaagatatcggatcaatggattgcggtcccatttgaactttcagaccgttataactccacttatcaacgtctttaataaactctctaacccaagcttctaaagtaatatcattaagtccggattctaattggttctctaaatactgcatagctgctttaagctggtcggcaacactatcgttagtgtcgtcgtcttgataaatggctgattgtttgtaaatcgggataatcgtatatcgccacaattggtcggctcttttaaaccattgcttcagcaagctgtccatgtacttgtgatagcgtgtctctaatccaaagcagaaccgtgttggcacaatgtgcggtaacaattccttgggtattttgatcagtttagccatgccgtcacctacttaaatagcctcttaaaccagttttgatgcttagcagtttcaccgttgtactttttaaccagctcattcttctcactatcagttagctgttcaaagggcttaatatcatccgcagaatcgcccgtgaacgcattctgggcattattcttatcggtatctaggaacgcgtcatgagcttcctctgggctcaaagcaccacattgaactaaggctgataacccttgtgcttttgccagggatgtttgtgcattcgtctgtgaatcttgttcccaaagtggattaaagttaagctcccagttgatactatctggatcaacattgcctacgttcttagctttcaacaatagtcgaattaaacgttccagaaatggtcgtagaacattctcttgttgcgacttgatgtaagaataatagttctgcacatcggtctgtgtaccagatacctttcctgactgttgacctaagagaaccgttttaggaatgttagtcgctgccgataagttgtcccacatgaagctgattagtgaatcgacaccggttaattgtgtgccaactttggcaacctcatcattctgaccaatcaaagccagtgattcggtagtaaactggtagttcatcataccggataatttagccaactgtttggggtccgcactagctgtatcaattgaattcgatgaataggttttaaacgaaagatcgttcatgatttgccccaccgaccagttagcaatgtcaactagctttagagcatcaaagattgtttcgtaaattgaatgtccctgatcatcgccctcgtcacgcccgtattccgcatgcatatatcgtgaagcgtctatggtcttcatcaaaccattctcagtctgcatgttattctccagatcatagactgaattgcctaccgtaacttggatgttggcttctttgccatacgttgggctaaacggccagaggttagtaatgatgttgcctacaatccgtctatcaaacggttgaatgtactgaacatctaatagattatcagtgtcaagtggctcttctgaatcatcatttttctgaccctcaatgccaccgatggcaataaatgaatcgccccacttcaggcgatcactaaggaattttgcaaagacgttctgactattcaagtctttgagcttctggtttattaaatcgtccaggtctttattgtcagaggtaaactcccagccattccgcgtcatatcggttgcaggcattgtaattaccatatgagcaacgtggttatcgtggtcaagctgttggatttgattatcatctagttcccgataactgccatgtggcacaagattgctgtagctctttgccgaggcactatgatcatcggccatactgtcgacaatttttactttctcgtctagcgaatctttgctcgcttgtttctttttaatgcgtttgtttgccacactgcgtcacctcacattccatatctcgcaaatagattattagacttctccatgtacgttagtccttgcgtcgtactatcaacttcatcgtcgtgggctgcggttgggaagctcgttagctcagtaatataatcgtcaatctcaggtcgccaagccggatgagggatgtagatattaccagcctcgaactgtgcagtaacggcatatgctcgcacttccttgccaccttgcggttcaaccggaataatgccaccaatctcatgctgaagcgtgttaatgatggctggcccgttggctttgtcttcaataaacttccgtgaagctttcgggtacatcttggttactcgtcgaatagcattcagcgtttgcgtaaagtccatacgagcatgttcacgatgtagtagataacgatcagcaccccgggcaccccatacttgaccagctacataatcatcattttctttacttttaaacgtggcatcccaagactgaatttgagtatctaaaaagcgtggcaaaatcgccacgctatcgtctaatcctaattggtgtttaatttgttcgttaggcacgtagtaacgaagccaatccggtttgaatacgccaccaccttcagggatgggattttgttgatataatgccgcccatgttcgagcaccaacactcttctttgtttgttcagcccaggctttgtcatagcttaacggattctgtggtgcgagtgtgtcgccaatttcacgacctaataaatcatccgattcagtacatactgctggcaactttaactcaatccacggtcgtgctttctgcttaagcaaacggccaattagatcatcgtcgctccacctagtcataatgacaatgcaagaagaatcagcatgtagacgagttgagaaggttgattgccattcttcccatatcttgtcacggattgtcttggacattgcttcttgtgcgttcttaattggatcatcaatgattagcagatcggcaccacgaccagttgcaccagataggattgaagtggagtacatcccaccagaatgccctttaacaccccaatctgaaaccgaactggtttgctgtgagagctgtaagccaaacatctgcggtgcgtaaaccatgaacttatcacgattcttacgaccgaacttggtatatagatcttcggaataagctgccatcataacttctttatcagggttcttcatgaggtaatagcttggaaaggtttcggtgatacttgctgacttgccgtgacgtggtggcatctccacacatagaaatagtttttcaccgttaataatgcgctgcaggtatgaacaaattagtttaacgtgcggatagagcttatagcggttctcatgagacaaagtaaagtaatactcatacttgcgccgagctaatgccaactcaatgccatattctgcctgttcctttggattatttaggttccaagccatctttatcaccttctagcttttctaaatgctttatcaactcatctgtgcccaagttatcaaatgacgaatcaacgcgaccagataactcgatctcacgtttatcacgccactttttaggctgtctgttatttagccacattttaattgctgcgacattgggcgcttcgtgctgcttaacatcctttagtcgcttaccacttgcactaactttatcttcgaaataatcatagccagtagccattctataaaggcttgcctccaccacgcgatcagcaagttccttgttcgccataactgcgtccgataattttggactatcgtgtttccacttcataaatgttgaacgggcaatcccaagcttagcagctatttcatcgttactaagcccgtctctagcaagcgaaccaataatagacaatccatcatcagacagccaataatttttatgtgatttgccagtattagccatttgtgatttcacctcttaatttgaataaaattatgtactgccgtttatttctaaacgacaaaaaagaacccacagtgtgagttccaaaactattttataaagttatctgaaccatagggtacaggtgtgtctgtccaaacttccttgagcatgataaacagcaagtagtcataattattgccaattaaaggcacactcgaaaagttaccgtatgccttagacataatttgagcatgattaaagatagtggtttcaatatccccatcttttaactcttgctgaatggcggaattagtaaccttatcgctcataatcatcttagatacttcaggctttagttttgatagttctcaacaatcttttgataatctgtattatttttatcagtcattttattctctccttagttccagaactcgtcttcaatgtgtgcaacaccatgcatggatggaatgctgtacaaacgaatctctgacccgtcaaacatcttaataacactgatattcttttcatgcttcttgattgatttaatatacccacgatcaagattcttaatagtcatgtactttcgtttaatgtcctggtctgtgataatccgtcctaattctgaaccgttcttgccgccagcaatattcaagccctcaactaaatacctttgatggttgctaagatgaatctgcaaagtatttggttgatagtcgttgttaccatcaatcaaagggtcataaaatgttttgccatcgttgttcacgtcctgcaaatataaaccattgttaaactcataaactttcgagtcaccccagtgagcatcatgagcataactaacaatgtgttgaaaatgccgtggtagtttaactcgtgcatccccatggttgattacttctaacaatccatttgcttcggtcttcgtaacagaattaacgtatgtcatttaaactttttccccttcagtttaagctcgttcaatttccgtgcctgtaaggcttttcgttttcgatctttgatttttgatttcttatggctctttgtatgtttattgtgtttactcaattttgcctccaaattcctttactagttcttttgctaattttgcttgctcccgttcaagagccttactaatttttacccttatcgtatttccagatgcatcggtacatatgtcaaaagactttttctgtttttgtctgcgtgctttcatgcgcttaaatgcggtaatgtttgtcatgtgatactgttcctccttttagcgaatgaatggttttcgtgggttgagagaaattaactccgtcataaaattggctgctaattggttctatgtcgcctgcataccgaccataaatcttaaatagcaatgtgactgctggtactccgccatcaaaaagaatgtcgttaatggttccacacgttttgctatcgtactcaccatgtaatcgtatttcgttagcgtcatcaattggtgaaacaatgtcgaaatgtcgtccagagaaaatccagttccaatttttagacttaagaaccggctgtgaaatcaacaatttgttatctttaatgccaaacattggcctatccggggcaaagccttgaataagattcccgtcgataaacagtcttgattgtcgaacatcataaacgctgaaatatccggtcgcatcagaactaacttctttgtgatctttcatgctttttctcctttttgtgcaaattaaaagtgccctctttgcgaagacgcctctttaaatccttatccagttgtttgtctatctttatttcttccttggaaacataaccgtaattggtttgttgcatgggcgtatatggatgcttacgatcactcatcagtaccaccagcccttataacggccatattccgcaatcaccgccggcagcaacatgaccaggattaaaataattaacgtggccacattgccacctccttgtgatacaattatttgtgaagaaccgatgtgatagttcttcacattttactcatatgatttaccttgtgattctatatggcaatgcaattgttggtgaacgtttgcgttgctatattttgtaagcgcaaccaaatgtgctataattgcttttagaggtttagttacctcagtgaatatctcttaaacatagttagctgtctcgatgggtgcttaataagcacccattttttagtgcaaaataaaagccggcgttttccacgcaccggtcacactcacagattgcgttaacagaaacagagaatctcgagtacttaactatattttcgataaaataaatcatctgtgagtttaaaactgcctgtgagaatcggactcacaactaaccgccaggcggcagtccacttgaatactttatattttagaggtatgtgctcgttaaagcacaacgtggctggcagggaatcgaaccctgcacggtaagctatccgccctcttcgtacgtgtacgttacagccacacaactttgtttgctaatttccggagtatggaactctttttaacaaattccacaataccaatataacccctatttttgcattttttcggcagaacatcggcagattgtcggcagattatcggcgaactttttttgctcgcagtgtatcacgaggacaaactatcgcaaaaacccataaggcttgtttctggtaatcgttatatgtacgctcaggcagatagtttaaatcatacttctctgctaagcgttcacagcacttttttacggtgtaatgattaatgaatcggtactccaataggtcggctaagaaggcattctgatcatcaatcgagctcatgagttgaatagtcttcaaacgtagttcacattccatcttagcggtggcttgtttaatcattttatcttcctgccgggtatgtcttggatctgactgtgcctttggcataccgtccatcatcggcgactgcagggagaaactgaatctagccgcttcaagttgccaatcctgatactcacacaaaaattgtttagcatttttaattgtttgctttctatccaatagaccaaagacgctatccatctccgcaactcctttgttgtagctttagttgatgttataattaatttgtcgaataattattatcaccttggcttccggaaacgggagctttttttatttttcctccactttttcataagtttcttcaaaaatatctggcttgcatggataaagctcgccgtgtacgccttggataatgtaatcgccacgattagcaatgtgatttccttcgagagttttgatcaccaacttaacatctgacgtttctttattgataaaagttacggttccgttttttattgctttgataatccattctggatcttctgattgctcttgatcagctgtccatttaaatgcttcaattacaactggtttcttttgatatttcattttacttttcctccaaatcctcaattcgccccattacataactgattaccatcatcaaagtagcaacggcgtaaaaaatataaaaatctactgattccagatgccatttattcacataacccagccaacattgactggcataaatgattacccaaactgctaagcttctaatcaaagccattgtctgcctccacatcctgaaacgccttaataacgtaatcagtaaactcttcgcgattagcagcaatgtttctggctatcctggttggtttcgccaaatcatcgccatcaccaaaaaagtcaatatcatccataatttgcactgcaacattattagcattgatatagccatctgcgtattccggcagcacaacggtgtctacataatctttagtttcttgaaataacattgagattccccttttatttcccgtgtacgaatggtttatcgatgtgttcaagctcataaagagctacttttagccctggtgaatactcaccatttccactatcatcttcacttagcatcgtcaataaacgggctttcaattctttcatgtcatcattcatttatttgcctccaccaattccggggtttcgaaaacattaccgataacctcgcaatccatgtaaacctcacctaactcgtaaacaacaccattaccctcaatctggaacttaccttcatcgaaaaatactcgatatggtggatcatcagggtccacttggacaatgtcgccctcataaatctcttggccttttgcatctagcaatccggtaaactgctccaaggttaggccatccccatcataaaaacattctttcgaccctttagcacctcggtcatctaagtagcagtaaacttgcgcaccatctattggtccatcaaaaccaattcgataaacttctaacatgcgtttttcatctttgtcccaagctctgaacttaatctctctgctcatttgtcttcctccacatcctgaaacgccttaacaacgtaagcagtaaattctttgcgattagcagcaatgtttctggctagtctagttggctctgtcaaatcattaccattaccgagaaagccaataatatccaaaatgtccatagcaatggtattcccgcggttatggccatctgcgtattccggcaacacaacattgtctacataatctttagtttcttgcagtagcatttgcatttccccttttatttcccgtgtacgaatggtttatcgatgtgttcaagctcataaagagctacttttagccctggtgaatactcaccatttccactatcatcttcacttagcatcgtcaataaacgggctttcaattctttcatgtcatcattcatttatttgcctccaccaattccggattttcgtgaatgttaccgattacttcacaactctgatattcctcacccaaagcgctatcaagcccattgccaacaatcgagaatctcgcatcttcgtcactgtagataacctgataccctggatcatctgggtctacttggacaatatcgccctcgtaaatctcttggccttttgaatcttttaacccggtgaactgttcaacaatgtaagcgtccgggttcatttcggcaaagcttaaaacactgcttgcctggctatgaaacatttgttgcattggccctttgctgccgaatggcatgtgccatgctctaaatttaatttgtctggtcattaccgtcactcacctttcataaatacaagccaccgtgtcttgcttcgtctgtctccaaataacggagcttgaccaaaacaatgtaaaactttgttcatgggaatttgatcggtattccatttaaaaatcaacgtaccgtgtggctttagtacacgcatacattcagcaaatccttttgataaatcactctgccaagtatctcgatttagagtgccgtactttttggccaaccatgatgttttacctgcatgtatcaaatgcggtgggtcccaaaccaccatatgaaagctattatcaggaaacggcatattacgaaaatcaccaattgtcgtcggatcaacattaataacatgtcccgttgatagtttttcaaaatattgacgattatccataaattcgacatttggattatgtttatccatccaaaacattcgactaccacaagcagcatctaaaattgatttcaagtttgtcacctatttcatccatttaaaaatcagaaatgccaacaagcaataaattccagctagcatcgcaacagcgattgccaaccatgtaataatttgattgggctgtgcgttccaaattccatcaagtatttgtttcatttacctgccctcacatcctttaaccaaccttcaacgatcaagcacatttcgcccgaccattcaaaacgtttcgcaagttcattagcaaactctgctggcgtgccatcatactttttaaattcatgcaccgtttgtgatcgactaacatcttgtgaatcatcccatggatcaatatcaaagatttcccagtttactttatttgtcatttttcttcctcctcattttcactactcgcctaacagataattgatattttcaagttttgacagaatttcgtcagtttcttctttttcatatttttcaacaagttctttcttgatatctttccaattcgtaaatttttcaaaattttcttgattgttaaacaacgcgtcagattgatatgagtttatgaacggaatgctttcatcaccttcaacgggttttaaaaccaagcctcccaattctgtatgttgataaaagaagtaagaaatttcttcaaaatatttatttgcccgtttttctgctctctcatgaatccgtttttccaaaaatgttttatccatgttattttccctcctccacaaattcaaaatgtgggtcatccttatcaaactttggtagccattccgggtattctcactgtaactttttatacaacgattcagtgaaagttgtttgtaacgcagaagtatcgagacaatcagcaataatcaaggatccggaagtttgtccattgaaatcttctttcaaaaagtttaaatagctcttgctgtctccatacatcattcgtacttggaacttaggttcatccctgcgctcatcgagtggggtgcgtgaatatttgtacgcaagcttctgtaaggctaagcgatcatgttccggaatgattcctatatcatttgcttctcgaacacttccaacggtggtttcagaaatttgatacagtccaaataaattcatgataatcgtagatcccgtgttacgttccacacgataattgcttcctgttcctaagctcaatgtggcaaccctgctttttaactctttaaatttcattctccgatcacctcttaattatttttagtggctccggataaattggcgtattcgcttgtttcgtccgagtaccatcaatcttccaactattccgataagtcggataaattaacgccagcttcttcatgagttctgccttgtactgtgccattgcgtattctttgtgactcttcacacccactgctcgaaaactcattgtgccgccttcttccgtggctcttccggttctttggttagctcgtccatatgcctgcgataggctttattgcactttgggcaaggttcaaccgttactccaaatcccaaatctgtgtaaaccctacctgttccaccacatacatcacatttttcactcatacttctcgtaccccttccattttgtcgaagagcaattgatgttccggattcttcggataaacccgatcaataaatttactctcgtacatctgctttagttgcggtttactgttgtttgtcgtgataatagttgcgccacgagatttgttattttcgaaatccacgcgggcgttcgatacctggtacatcaggtcctgcaaatctttgtggactggtttgatgctgccagtcatgccaccttctgtgccgaaatcgtccagaattaaaatatcgacgtgcttcattgccgaaccaattgattcaagctgtcctctaataccgtcgtcagtgtacttatcgttaaccatccgtaacagttcagccgttgagacgaacatggctgtcctaccggcattcattaggtaatccatcattgccaacgcaagagatgttttgccgactccccgatcaccagccagtgcaacattaaaatcgttgcttttaagctgtttggctagtaggtacgcttgatttcccagggcttttgcctttgcagaattaggttgtttagtgacatccccatctttaaacgtaaatttgagcggcatattacccgaccaaaccgagcccttatagaagccacgaatcttgttgcgtgccaatcgttgcattgcaccttttacaaactggcggtcaagttcttctttggtgggtaaatggctgacatcaatctgcttggatttaataatctcttgaattgctctgcttttatctaattcgctaaatgctttcattcgccaaaccagtccttcctcgtcttcggtttctgtgaaccaaccggcgtattgtttagatagccctcgaacttagaagcctggaacaacgttatcggacgcagatactgattcatatgagaatcctttaaccattcagcacactggttatcgatagcccgtcgcatgtcctcagcactaaagccttctttatgcctagccatcactaaacgtttgttagcttcagtgtgtcggtagtgtttgcctgctttttcgtttaaataatcgataacagattcccaagggaaggacgattcggctttagccgaactacgtttttctttattacttgttcttgttaattcttgttcttgttaattcttgttcttgataattcttattattgttaatacttagtgtgggattttccgtcggaggggtttcacgtcgaacgggttttccggatgacgataaatccgacaaaatccagtccattccggcgattttcccgttaacggttaaacggttcttacgagttaaatatccgagcttttccagttctattaatccagaacgcaaagcatcttcaccatcagtcgcatgttttgaaacttcagttacataaaactgccaattatccgcctgactccaaagataaacaaagatgcctcttgctttccaactcaatcgcttatcgcgaactagcagattactaacgtttgtatagttttggctggtcctcttaattagccttgccataatcaccacgtactccaatctttttaagtgtttcaatatccaatttgattccactaaccggcatgtgatacttttggctgaattcttttgctccaatttggtggaactcagtatgatgctccctgcaaagtgccatcacatgccgtttgctgtggtcaagtttgtctcgattcatccccatgccaacaacatcgatatggtgaatgtccgcatgccgaccacatacagcgcaaactcgatgccgacaacattcgaactggtaatactccgcattttttggaagtaactcatagccttttttaaagggcacatgccacgagaacatgaagtcgatcactaaatctagaagctggttggcatcactgaccgatgatctggtgttgtttgccaggctgatttgtttacctgcggtataaaattgatattgtgtgtaaaataattcttttaaaaaatcttgtggcacaataaaatgtgatgaaatatcatttaataaggcaaaaaacaaacgccgttgttgcactctagctttgcgtgtgtcagctagttcccaatccacgtaaaattgttcaggcgagccactaaccgtctcaatatggtcgaaatttggcttctggttcaattctgtgagtagataatacttaccatttcgtttgaagcatcttgtttgcgatcgttgcaataaaagcccctcctaccaagagcgcttaggtgccacataaaccggcacgccggtcaatgcttgtgttttacttttaaataaatcctcattgctgttcttgtcactcaaatgaatgagcaccacccatttaagggttggtgataaattcgacttgatgaaatttaaactgtttttcatttcaaaatgactcgttaaaattcgattgcgaagcgaataattcaagctgccatccttgacgttttgtgaagcaatggcattgctgtaattcatttcgactaacatgtacttgatatctttaaaccggtactttacaaagtacgtatcagtaacgtataacagcttttcgccggcagcatcttggattaagaagccaaccggttcagcagcatcatgcttaacggggaacggtgtgacaacccaactaccaacctttacaggtgtgaatggttcaaccgatacatagttcatcccagataatttaagcgcgtcaaatgtcccctgagtggcatagacgggaaatgaagtatgctcaacaaatgaacgaatatatttcgagtgatcagtatgttcgtgcgagatcagcatcccttgaattttggaaaaatcgaagtccattgcttcttcaacatgcttataggagataccagcctcaatcatcagttgtgaattgccatcgtccagcaggtagctattgccgctactgcccgaaccaaataccttaactttgatcaaaacggatcatcctccgtttccggttgagacttagatggttcttttggttcagcgtcgatgatttcgggttgcttgggcgtttccggctctggttgctttggctcttcttggggcttttcgtccggtttaactgtcttgctttgttgttctacagctttctcaaaatcctcactgttggcgtcttcagtgacgtctcggcgcatttgtttcaaagagtcattagtagcttcttcgtatttgatctgaaccaaaccattattaaagtccttaggaatcttcttaacgatattgttccgcatcttacgaatgatcatcgtttctcgggactgcggttcacgccaagctggtgagatgtgccccgttctaaccatgtcttcgctatctagaatttcgtcaagcgtgtggtctttggcaaactctttaatcttcttcaatttgtcttgtttatccttatcacgcatgagattgttcgacatatgagctagaagattattcttaacttgttcacgctcggtaatgaaatattcagtggtggtcttacgttcttggtcattgtggtaatcaggaccaacgtacatatcaatgggatagactacccgaacaactttcttatctgtatcgccagttggctcccaagttggtggcgttaactgaatccccatatgtttgggatattcgaaatcgtcgccctcacgaacgagccaaaacggatgcacataggcaacgttgcgcccgaaacgattcagcaaagcatcgttaccatcgccctcgatacccatttcaatttctttgtgccatttgcctgaactgtctttagaattacgggtttggaaataaatctcacgtggctcagcattcgcgttaagttgcagtgcggcaacggttagtagaatgtccttgatgttattttgaacgctggcaatatcaagaccgttatctgtaatgacttggtacatttgttgcatagcgccggtaacacacatcttctgataattagttaattcaatttggcttttagccatttgattttcaatttgtgggacaaagtagttgcttaccttagttaaacttgtatctgtcattttttattcctccacttttgcgactaattttttatctgcgctaacgatcaatttgatctgctgtgcttgagtttcaataatccggttgaccgattcagcgttgtctacaaagattggtgcagtaacgtcatagtgtttcgatagtgtgttaataatgtctaaaccagcgtttattttggcagcgttattcaggtctgtgctgtatggcacaccatccaccattgcttcgcagatatcgtttagttcaccattcttttgtgtttcgaacaatttgaagttcacaatgccgaaaagtgaattgatgcggtcttctaacacagcaaccttggtacgcacataatcgtccagcataaaggactgcttatcgagtttggcataagctttcttcaatttgatttcttgagctttcagctccgtaatgcgttcacgctgtttctcggcagtggcgaacttagcaagctcatcatttacctgatgaataccggcatcaattttgtcaattttgctttgaacatcctgcttagctttgtcattactacctaatccagcagcaatttgctgatcgcattcagtaatttgtttctgcaaatcttgataagccttagtttcctcaaagggggtaattgacgatttacggtgcgcatactcagtttgaatcttctcaagttgcttttgacgtaattccgcctcttcttgaaggtcggtatagccatcaacttgcttctttaattccgcttcgtggctctcaagttttttggcaacctgcttacccctttcgataatgccgctcttcttttgagataggtgagtgttgaagttgtctcgcagttcatcctgtttttcagccggataggattgtccgcaagtcgggcaaaccagagaattttcgtcaaacttttgggcgatgagttgatgatattcagtcagcatgtctttacgagcttgggtttcttcagaaacttcttgcttcaaagaatcaatcttttggcctgctaacttcaaatcggtttgagcctttgcattgctcatttggacatcgcttaaatcggttgccagatcagaaatagctagttgactaccttgcaaatagctggcttgtttagtagagagttccgattccaattgagcttttttatgtcgcgcatcaatcgaatcattagaactttcggctgcctgtaagttggcctgctctgccattaactgctgttgataacttcctagcatgccctgaagtacgtcctttgaagtcgttgaagtttccggaatggcccggttggcttcatcgattctggcaggaatcccatcaatttcattgtgcaacttacgacgacttgccacgataatctttcgctgttcatcagcggaatgagaactcaagagcttttgcaattcatcggcatatttggtttgcttgataacctcgtgatcatcaacatcaccaatgagtgagagaagaatttcacgacgttcttgccatttcaaattattgaatgccattggattcgtcagcagcttaaacgtatcttcatcgatgattgaattaacataagtgctgtaatctttaagcttataagggacctcattgacatagagttccgttttgtcggacttacgaaccttctcgacctgtccacggggcttagaccagacttcgcttaacttacggcgtaaggtaactttttcgccatcaatttgcaggatggcttcaatctcgggttctaatccaagaacttcattgccattttcatcgagcggtttcggattgaacttggtttgctcttcactattcttgccaaataacaaccacaagaagccatcgaacagtgatgttttaccaacagcgttctcgccagacacagcaatgcttttgccattcggttcaaactcaaaatccttaatacccttaaaattgtgatacgtaacttttagaagcttaatttgtttcattattttgcctcctaataccgtttgtagattccggtaagcttataatcgtctaatcggtctttttcttcgcggagatattcgatcagactttctttgataggtgctaagtgcttatcagcaatcgcttgttctaatccttgaactcggattttggcgtatttaacttccgtttcggttgttggcttttgaatttccttagttttcaacatgtttttagacctcttttttagtgagtttgggatgtgcctcgcgaatatcttccaggacagaattaagtgcatctacaccttcgccttcacttaaccccattctttgagacagcataagtgctgaggtaagtagcgcatatactgcgtcaaaaccattcgtttgtgttatcgaaaaatcaaggtcgcctttctcgtcttgccgaaaattcttaatgatgattgctgattgcccgttaaactttgtcattcttcaaaatccccctccagatacgttgccataagcttggctttggcatagaataaacttgtaaattaatttgatttgctgttaatttcgaagcgtttcgcaatgtccgttgcgaggcgcttttttcatacgtttttcccataatttcctcctatttgaaccattcacttgggttctttaccatcagatatgctaagtagcatccagcaaagaagccaaaatataagcatccatatacgatgaattttccaatttcgtaaatcatttttaagctccttccgcaaaaatttgttgtcgcttgaagtacttaatgcactcttcacggttgtacttactctgattaccctgcacgacatgtgggcaatccggataatacttatcaaaagttgtcgtgtccttgcatccaaagacttctagcgccacttgcgatttgctaagtgttgcttcccgatacttttgatcaagttgcttagaaacctgttcggtaataaccggaacaagttgcttgattacagcttcaacaacatttttcgaatccagactgtcaagattgaccgtaacttccatatgccacacctccttgtggtcttgcaattgcccactcacgtaatacttgccgaatagcaattaacatattgtcttcagattccacttcttcgctaaactccttgaagtatctttcaacatcctgaaaatcctgctgagtgatttctttagctggtttattaaagattgccaacatatgatcatccagcgccttgcgttgcttctcctcttgagaagctgcaaataatcttgtctgtggaatttcaatacttaacttatcttttgctaataatggcaatccaaccagatactcagctacctgataccgaaataagtcgtcgtctagataattcatcacgccgagtaaccgatttaaaggtatctcgcgatcgctcgtcaaccagttagtaatgttggattttgacaaatgcatttcggcggcaacctggctctgcgaataacccgatcttgtgatggcatctttcaaatcctttcttatttcgtcgctactcataaacatcgccccttaaattgtgtaatttttgtaatgctgttcatcccccatagaagtacattgatactagagagatggctgttgatcagttgtaactggctcgcccaaaaacttagttgcaaaatactgttgccccttaccagtaatcaatggtgtgaagttattgatcgctccatgattggtattaataaccgtctcccgaacttccattaccttgagttccatcgctttttgtgttggcgcgttatgtcgtcgaccgcctcgaattaagaagccgtgacttcgtaaccattcaaataagcgattttgtccaattggcacacccttttgtctaagaatctttgcaaatgtgccaaccgttaccgaatcatcagaagcactcactgcattgcctaagagtgccggaacacgcaattgtttattctcttctgccaattgtttacgttcgagatactccgttttccagcggtcggcacgctcaattgggtcatcgatcatgtatgaatctttcgattggttgataatctgctgctccatatggttaaaagcttgaatgtactggagcttgaagtttaatgcctctttgcccgtgaatcccattgccagcaaagtgaacccgtcacggttcatatagtaaattttccgatcacgtccatatgaatcagggaagttggcctcaacaaacatctccccaaaattgggtagatctttttgaaagtgttcgatatcacgtaaaatgtgatcatgtcgtttctcaaatgtttcagcaacttgcaaacttgttgtgactgctttttgattcttcataattactagttcattcatttacatcattcctttcactatttaattttttagcaagagaagttagtttggcagccccgtctagaagtgcctcgctggcttcttttttcttagaaacgtcgattccgtttaacgagattagaatttcaatcagttcttgttccatttattgcctccttttgaaagtccaacaaacccagtattcactttttcttcactcttagtgaacaaaatctgtaaaaaaaagttcatcaacagttttaccgtagaacttggctgttttccacatcgttttcttcgaaggatttttactaccattctccatcttaactagcatagaataactaattccgatgccctttgcagattcaaattggtttaagcctttttcccttctggcttcttttaaaggattcattttatcacctccaccactctacgtgaataatataccaccacttagagtggagagtcaacacttttagtgaaataaattaaaaatcattcactttcaccggcagtgatagtattctataaataaatacagggagtgaaaaaatatgactaacggacaacgaattgcttatttacgtaagcaaaagcgagaaagccaaagtgagctggctaaaatcatgcacgtaagtccaagtactattggtatgtgggaaacgggccagagagctattaaagacaacgatttatccaatttagcagatcattttaatgtaacaactgattatatacttggccgtcccgaacctgacgatggcttacgggtagcggcccacttatctgatgactatgattcactacctgaaagtcaaaaacgtgaagtgcaggaatatattaaatttaaaactgcgcaatatagaaaggaacagcaagataaaaaggactgatgcttatggaaaacatcgataagttaatgtcggattatcctcagtttagttacaaatatgaatcgatgccgaaaggaatagatggcatcaacatcggtaatgaaattattatcaattctaaaattagtaaagaagaacaactgcaatggctatacgaagagattggccatgcgatgacatctgagggagacattacagactatggtgatcgaaataatatgcgccaggaacacgaggctcgtatctggggaatgaagcatcatatttcatttgaccgccttgctgatattccagcggacgaatatgaaaatgattatgaagccgcccgtgatttaggtgttcaagtcgattacctacatacagttggctttatgtacggatttagatataaaactatcgattaaaatagggggaaatatgaaaactaaaaacgtcattttatgtagtatagcttcattaacttttttaacctttggcgtatttggcacttctcaaagtgcatctgcacacacttggtgggacggaacgccgtccgctgtaaagggatattggagaaccagatctgtttacctaaaagatattggcatgaataatcacgcttcaattaaagcaactagccacactattacgtttgcttactctgcctcgtcccgtatcaccttgaaaagtacgtactggcgtaaaactggttcaaattcttacacaattcatggagctatggttcaagacgaccattttgaccaccgaataacggttaaaaagattggtccgtattatctgcatgcttattttgatggtcactcaattactcgtggctcagtatatccaaattcatttttcaaaaaataggagattaaatcatgaaaattaaaagatcgttattattgacgattactgcgtttacactcggattaggaggatatatctctgctattcccacaccaaatgtgttagcaagttcaaccttcgcatacggtcgatgggtaacaatcaccaagacaactcgtgtccggactgtaaagcttggacatccaatgtcaagcagccatacagttggctggcatacactttatagagggcatcacatcaagattcgcgaatcatgggtctttggttgggttggcgaaagtggacactttaattcaggtgcgcactatgcttatgtactatgccatcaaggacattcatggtttaagcaaggcattcattaattaaccagtccaaatatggatgaaaaataaaaaaacagcttcatggctgttggggggcaagttatgaaaattaaaaaatcaatattattaggagttgctgctttaactttaggattcggaacattagcaactacagcgtcagctaatcacaatttcttttattgggaacatccacactgggtaactgttactaaagcatcaactatttacaaaattaagagagtctatccattgtcaaacagttatgtggtcaagaaatatcgagttcatcgtggacatcatttacttattcaccacgctgccagctatacctggatggttgaaagcggtcattttaattcaaatggatattacacatattcagttggtcggtctggctatagttggtttaaacaaggtattcactaataaaatgcccatcaatatgggcttttatttaggacatcaaaagaacatatgtacgcggatttgtgtaaaaagcagattgaattacacatttgaaaggatatgaaaacatggcaaaatctaaacgagtttataagaagttgaagcgacatccctacatttacgagtacgagacggaaaatgggaaacactatcgagttcgctggtcctactatgatagtgaacataagcggcaagaattcaccaagaacggatttaacaattggcaggacgcggaagtaattctacgaagagcacaaacaaatctggacgttggcaatcaagacgtgcttgctaaacgtaaaataacgttaggtcagtactatgcccagactagaaaaagatcgatcgaaatcggtaaatggcgccctgaaactgtcgatcagaaagacactcattggaaaaatcaaattgaaccaatttttggaaatatgaaaatgtcggaaatcagtcgagccggctatcaaaatttcatcgataatttggtgaaaaagaaatatgcgtataccacaattaaatccataaattcaattgttcagctactgatgaatcgtgcttctctaaatgatgttattgataagaatcgattgaaatctattattatcgaaggagcaccagcgaagaagactgcaaagctagagcctgagcaatatcaaacctttatcgatactgcccgtaaagtacttaacaagtatcaactaacattagtttatttatgtgcaatgggtgctagacgggaagaagtaatcggtttacgatacaattcattcaaattcttcaaacaaaataatcaagaaatttgtgagattacttataacttaggccgtaaccgactagaaacactgggtggccctttaaaaaatgaatcaagttaccgtcagaattatgtaactggtgaaatggctgatatgctaaagttttcaattcaatattccaaaaatatttgtcaacgaaccggacatattttaaaagaagatggctttttatttttaaacgagcaatctggtatgccggtttatatccaataccccaaccgcctatttaagaaagtcgaaaactcatgtcacattcacgtttatcctcacttgcttcggcattattttgcgactatggcacgttcgcttaatctttctccaaccgatgtgatgcactggctcggtcactcctcacttgatatgacagactcatatactcgtcctacccaacaaggcagcttaaaagtgatcaacggcatgcaagatgtcctctttaaaaaagatgcgtcaaatgactgatatgcatgcattccaagcaattttatggaacatgatcgcctaaatttacccatgttccacagatgtaccataaagttttcattctgattcgcattcaatcaaatttaatatacaaaaaaatcgctccgtaccagtagtaaataccgatacggagcgatctgatttgaactatttataactctcttacttaagagttacaacgccaccaacagcctcaagagtttccttgatcttgttagcttcgtcttctgaaacgccttccttgatagttgaaggtaccttgtcaacaagacccttagcatccttcaaaccaagaccagtgatttcacggacagccttaattgctttaaccttttggtcaccagattcagttaattcaacatcgtatgaatcttttgtggcagcttcgccaccagcagcaccagcagcggctacaggagcagctgcagaaacaccaaattcatcttcaattgacttaactaagtcgttaaggtcgctaattgaagcatcttttaattgatcaataatattgtctttatcgaaagccattatattttcctccagtttaattggaattatttttaattattaagcagcgtctccgtcgccatcttcttgtttcttgtcagcaatagctttaacaccatatgcaaagtttcgtacaggtgcttgaagaatattagcaagagttgacaacaattcttcacgacttggcaatgcagcataagcattgatttcgtcaagagttgcaactttaccatcaataacgccacccttgagttcaagagcatcgttactcttagcaaagttatgaacgatcttaggacctgcaactggatcttctgatgaaaatacaacagctgtaggaccagcaaatgtatctttcaaatcatccaaaccagctttctcagcagcacgtactaaaaccttgttcttaataacttgcatctttacgccttcgtcacgcaattgcttacgcaaatccgtcacttcagcaacagttaaaccacgatagtcaacaacaacaattgatgaagcagccttgatactttcagtggcctcttcaaccttttttgctttaactgcaacagtttgttcactcacgagtttcacctcccaaaaatttttatgggatttaataaaaaatccctatgccaacctagacataggaaaaagattcgtttcctcggcaggatattaaggcatttgccacctgagtcttaggcatatatcagcatttaacagcatatcacataatgtgattgcacgtcaatccgggatttaatttaaatcgaaaatcattattcaaatgattcaagatcaactttgacaccagggccaaaggttgaagaaattgaaacgtttttaacgtaagtaccacgtacagaagctggacgagcctttacgataacatcttcaattgtcttcaagttgccgatcagcttttcactatcgaatgataccttaccaactggcacagcaacgttaccgtcacggtcagtccgataagttactttaccggcttttgattcttggactgcttttgcaacatccattgttacagtaccagtcttagggtttggcattaatcctttaggtccaagaactcgacctaaacgaccaacttgagccatcatatcaggtgttgcaatggcaacatcaaagtcaagccagccaccctgaattttttcaactaagtcggcttcaccaacaaaatccgcaccggctgcttcggcatctttagccttgtcaccctttgcaaatacgatcacagtttgttctttaccagtaccattaggtagaacaaccgcaccacgcaattgttggtcagcttgcttagtatcaacgtttaatttaaatacaatttcaacagttgcgtcgaattttgcataatcaattttctttacaagttcaacggcatcttgaaccggatataccttagcgggatctacttgttcaagagctgctttatattgtttacctcttttacgagccatgtgttttcctccttgtttgtggttctaacggattaacctcccacgcaacgttcaaacaacgctttaaacgatattagtctacttcgtcataagtcttttgttgaaattagtcttcaacagtaaagcccatactacgtgcagtaccttcaaccattcgcattgctgcttcaacgtcagctgcgtttaagtctttcatctttgtttcggcaatttgcttaacttggtcttttgtaaccttagcaaccttgttagtgtttggttcaccggaacccttttgaacaccagcagctttcttgagtaacacagcagcaggtggagtctttgtgatgaagtcaaatgaacgatcttcatacacggtaataacaacaggaataatcattcctgcttgatcagcagtacgagcattaaattcctttgtgaagcccataatgttgatacctgcttgacctaaagcaggaccaactggaggggcaggtgttgctttgcccgcaggaatttgcaatttaacaatgttagctacttttttagccacgagacatacctccttaagtccgtgtgtggtaattggagatcaaaatttctcctcccacgtcagtacattcacctaagcaaacataccagtacaatataccacaaacacgtaacggaaacaatacgaattattgcttccacaaaaaatttacaatactttcatcaacaatttgattttcgtgcaacaaccgatggcttgcacgacgtcccttgataattaattcacgataatatcccaacggccgttttaataaaaagcgcagagaaaaagcactgttaacagaaacctgaccgtcatccttttgccgatcactaatcctgccggcgatatttaaaactttaatagttgtaggtaacgtcgaaatattagcagacaaagccgaaaaaatcggtcttctgtgaatcgggccagttgcggttaacggaacagagtcaacaatcggtgtgtttcgcgcaatttcagagtcattaaacggccctgcaattgcaacaactttgtcaatcataattgctgcttttcgatgctggtgggttaaataccaaaagattgtaatacaacccattgagtgtccaaccaagttaagatggtgaatttgataatcagtttcaagcatctggcaaatatcgttaagccacgctgcttgttgcttaggtcgggatgtcttattttcaaacaaaacctggatgacacacctctgatttttaatattgccatacagtttgagacgtccatttcttttaacaataataaccatcgatttatttgcatcatattttcgtacaagccgtttgagtaaaaagccgaacgaaaaacgattcccgaagtatccgggaataaacaaagtcggcacgttgtcaacaaagggctggttttcttttcggttgttaaatggacgtcccatgtggatactccaaatcattaaaaataaaaacaagccgaaaaagattacaaatataataatcaataaacgtggacttatcaacgccatcaccatcttttagtcattaatcaggttaaaattgttaatttctatatttctgtatcaacctggttaaattccaactcagtactggtttctcgaccaaacatttcaatattaacttttaatcgcatcttttcattgtcgatttcagtaacttttccattcaaaccggtaaaggcaccatcaacaattttgacactgtcgccaacgtttacatcaagatcttcatgtcgtgaactcatgccaattcgtttcaataccaaatcaacctcatcgggaagaagcggtgtcggcttactaccttgtccgtgagagccaacaaatcctgttacaccaggtgtgttacgtaccacataccacgcttgatcggtcataatcatttcaaccaacacgtaaccgggaaaagttttatccatcttaactttatcttttccctttttatcaacttcatgttcttcggtttcgggaacaacaacccgaaaaatcaagtctgccatccccattgattgcttacgactatccaagttcattttaaccttattttcgtatccagaataagtatgcaatacataccattttttctctgctgactccaccattttttagctcctcttttcgattaatccaaataaagaaattcaaacaaaaaaacctgacacattccgcaggttttaacaacataactatatcaaaatttcgccaaaatggctatgcaagaaatgaaagtccccactgaacaatcaaatcaacgaggcctaaaaagatagccataataattgatgtcccgataacagtcgttgtatcggttctggtttgcttaacgttgggccaagtaacaactttcatttctttaacgacatttttacaaaagttccaaagtctcaaattcgtatccccttacatcgtttgtctaacgagtttctttgtgtaatgtgtatttaccacagtacttgcaaaacttattgagctctaacctctttgttcgattagggtttgcggggatcgtataatttctcgatccacaaacagaacatgccagagcaactttcttttgtgccattgtggcacctcctaacaagcatagtaattctagcattctaaatcaattcagtcaatttatccagtgatatatatttatatttacatctctcgaatgcattaataaatgttcgcgcatcaattcgtttttcagtatccaaattaagaatgacataaagtacatctttttcaagcggcgaacatttgatatacaactgagctagccgttcttttagtaatgttaaccgttctggattgattgctgaaggatcactaagggtcgtcgaataaaaatcccggttttcatccaatctctgcaccggttgttgtggtgctctttttttagctttgtattttctaatcaaatcatatatccgatttcttaaattatgactataaaaagtaccaaagctaacactacgctcccacctgtatcgttgcgcggttcttatcaaaaccaaactggcttcctgatccaagtcatcggcatccattccttcaataaaacaaagccgtctaagttttctaacaatcggataatacttatgaaaaagcctcgaaaacgcttgttcatcacccttggcaactaatctaatcatattaaactctttttcactaaccacaatactgttctccttcttctgtattaattaacgcaaattacactacagaaggatttaagcagcctcaagcgaacaaaagttcatatatgtctttataaactataccaattgaataatattaaatcgttaatattattatttattatctttatcagtaagattgtcacgaagtttttctaatgccatcaattgcttgggattccacggtgtttgtcgaagcgcatgagatttgtcagtcatttttcgagcttccatatcaacttcctgctttgcccgctgaacgtcacgtaaaagctccctcgcaggaattcgaagcgcgccagccgcaaaaattgtccactgctccgcctggtcacttgtcgcaacaataacttgtgtaaaacgattctgtttttttcgagacaatgcctcaatgtaactatcggcagtttgatccttactggtccaaacaatttccatatcaaattttcggaaactctttgaatttccgggaacatacatcgcatcaaaaaccacgatcatattgatgtcacgatactttttatattcagataattctgccaataattgatcacgtgcatcggctagtctgtcagcctgctttaatttatttaaatgtggccaattaccaatcatattataagcatcaacaattaaaaggtcctctttcattacgttccaccaactttatttaatagtcaaaggatggcgggaattgaagccctgatagattagaacactcgcggccacgctggcatttaagctttggatatcaccaaccatcggaatggtcagcatttcatcaacctgcttttttaataatggtgaaattcccttaccctcgttgccaataataatagcaaccgaccctttcgcatcccatcgacgataatcggtaccctcaatatctgttccaaagacccacatgccccgactcttgagttccttaattgttgcagccaaattggttacccgagccactggcacccgctcaatggcgcctgcagaggttttcgccacaacagctgttaaaccaactgcacgatgtttgggaataataattcctgaaacaccggcagcatctgccgttcgaataatagatcccagattatgcggatcttcaatattatctaagataacaaaaaaaggttcagtttcttgcttcttggcattaacaaataaatcatcgaccgtcgcatattcaaatgctgctactgataaaacgaccccctgatgattttggccgacagaaagtcgatccaatttttgcttaggtacttctgaaataacaagtcgctttttccgtgccaatttcaaaatttcagaaataatattttcatcttttttaataccggtttggataaataacttattaattgggctatcgctctttaatgccgcaacaacagggtgtctgcccataacaaattcttcattttcttgatcatgcttcatgttttaagttcccgctttctacctgtttgatacaccaagttgcaatttgtttcattcgatcattctgatcacttaaacagagatagccgaaaactgcctcgaaacctgtggaaattcggtaagtaatcacgtcagtgttcttggcatgagtgtgactcttcgcatttctaccacgtttaaaataatcccattcatcatccgttaacagtttatcttttgtcattaaatcaattaatgccgcttgagctttagctgaaacatagttggtcgcagcatgctggagcctggtaggctttgcaatgccatcttcaattaaatgacgacgaataaagacttcatacgctgcatctcccatataggctaatgcaatgccattaagctgtgaaaaattgtctgccataaaaccatttattcctttctaaaacgggttccctgaggggtatcctcaagcacaatcccccgtgcttttaattcttcacgaatttcgtcactacgaatgaaatctttattggctctcgcctgttgccgttcatggattaacgcccaaatttcatcatctttaagttcgctttgttctagtttaataccaaaaacggctgctaattgtttcaaggtattgataataaactgcaggctgttttgaaaaacaacatcacgttcactatacatatttgcaaacttagccaattcataaacagctgcaatcccattctgaacattaaaatcatcgtccatggcatcgataaaatcggcaacaatctgacgaacttcctgctcagtcttaggatcactccccgcttcggcgttatgcaaacgataggtcgaattgttaaaggctgtttgcagcttcttcagattacttttagcctcctgaacactcgcatcactatattgaataggacgacgatagtgggttgttgacattaacaaccggatcacttgaccatcgattttcttcaataaatcgtgaaccgtaatgaagttccctaaagatttgctcattttttcattgtcttcaccaatcgtcacgaacccattatgcatccaatactttacaaaagtttgatgagtttcggcttcactttgagcacgttcattctcatgatgggggaaaatcaaatcttcaccaccaccgtgaatatcaagggttttaccaagatacttcattgacataaccgagcattcaatgtgccaccccggacgcccctttccccaaggagagtcccaggaaatctcgtcaccttttgactttttccatagtgcaaagtcaattggatcttccttttgttcaaattcgcccttttcaacgtgttgactggcaccaacttctaattgatcaacgttaatatgaggaagctccccatatgttggaaatttgcgagcacggaaataaacgttaccatcaacattataagcatatccctgatcttccaaattcttcacaaaagcaatgatctcgggaatattttgagttgcccttgggtgagtcacatctttggaaatgttaagtgcggctgtatcctgcataaaagcattaatatatttttcagcaattgcgccaacggtcgtatgattttctctggcagcattgatcatcttgtcatcaacatcggtaaagttggaaacgtaattgaccttgtatccgcgatactcaaggtatcttctaatggtatcaaacgcaattgcgcttctggcattcccaatatgaatatagttgtagacagttgggccacagacatacatgttaacaacgcctggggtaacaggttcaaatttttcttttttacgagtgagcgtattaaaaatctgcaacatgtctaattcctttctttgtacattggttatataagaaatgatagcatagttttcaataattttttcactattgcctaataactataataaaaggtctcgtcgaattttcaacgagaccaattaatttaaaaatattttttataaattattatttattaatctgtttcaacgtttgtttaatgtgctgaatggctttatctcttccgaccagttcaactgattccggtagttccggtccgtgcatttcatgcgtaacggcaattctaatcggcatccaaagcttacgccccttaataccggtatccttctgaatagccttaattgtatggaagacttcaacagaatcaaacggattgagtttttgaattctctccaaaaattctttcaaaacaactggtgccgtgtcatttgaaatttcatccaatgcgtcgccactaacttcctcaggttcttggaaaaatacggatgccatgtcattaatttgtgccatataactcatctcacgcttatataagctaattaattgacgtgcccattcaatcgtcttggtatccggattttcaggaatattgccacccttaatcaattgacgaagtgccaagtccataattgtgctgtcgtcggcttccttaacgtactgattgttaatccactcaagtttcttggaatcaaatttagccggtgacttactcaaacgcttttcatcatacattttgatgaattgctttttattaaagatttcatcctcaccaaccggcgaccatcccaaaagcaaaatgaaattaaacatcgcatctggtaaatagcctaaattacgatattgctcgataaattgtagaacagactcatcacgtttgctgagctttttaccagtatcggcactgataattaaactcatatggccaaacataggtgctttccatccgaacgcttcataaatcattaactgttttggtgtgttggcaacatggtcatcgcctcgaaaaacgtgactgattttcatcatatgatcatctacaacaaccgcaaaattataggtcggtgtaccatcacgctttgcgatgacaaaatcaccgccaattgtatcggaattaaaggaaacgtttccctttacgatatcatcccatgcatagtcatgatccttaggtactttgaagcgaataaccggtttaaggccctttgcctttgcatctgcaatagcttgttgcttttgctcatcagtcattccttcatattcgtactcataatgaggcatttcgccacgagctttttgagcatcacggtcggctgtcaattgctcttctgttcggtatgattcataagccttgccttcatccaaaagttgttgaagcagtggcttgtaaatatcatttcgttcggattgacgataaggaccaaaatcaccaccaacatcagggccttcatcccaatctaggcctaaccacttgaggttttcaagttggcttttttcaccatcagcgacatttcgcttagtatcagtatcttcgatccgaataataaacttacccttgttgtggcgggcaaataaataattaaaaatggctgttcgtgcgttcccaatatgcagatggccagttgggcttggagcatagcgaactcgaattgcattgtttgccaatgtataagcgcctctttcttaagtttatttcaaaattttatcagcattttaagtttacaatgaagtgtcgaaaaaataaagtggctgaggcatgcagtttaaataattacactaaacttatctttcattatagcaaaaaaagagatggcaccaaggttttgaaccttgtccatctgtttttttacactaaataatcaattatttctttgctgtgtttttcttaccattttgctgcttggaattctttcttgcattatcatcatcgatcttatcggtaatattttttgttgaatgctccggtcgtgcaaaaatcattttcccagcatcagtttgaatggcacttgtaacaacaacatcaatatgctggttaaagaagtatcgaccatcttcaacaaccaccatcgtaccgtcgtccaaataggcaacaccctgttgtcgttctgtcccgtttttaacaaccatgacattaagctgttgccccggcaaaatcttttgtcttaaggctgttgccaatgcattaatgtttaatacttttacatgttgaaactgaatgactttgttcagattataatcatttgtaatgataaccccattaacgtcctttgcaagttgaattaatttcgtatcaacctcatcaatatcttcataatctttttcataaatttcaattggaatcattttttccttctgaagtttattcagaatatccaggcctctgcgtccccgaacacgcttaacgctgtcactggaatccgcaatgtattgtaactcgtacaatacaaatttaggaaccagtaatgtcccttcaacaaaccccgtcttaatcacgtcataaattcgtccatcaatcaggatgttggtatccaaaattttataatgactgtaattatcgtcaacaggcttgtcgatgattttttcacccggtgtcctgggtgtctccgtcttacgtcggaattgaaataccttacgccatcgatcactttgtgtgttcccaagtctgaagccgaaataaccaagcaccaacattaaaatgattgggatcatagtatttaggaaaaacgtatctgccttgaaaaaaacaattgaaattaacacagcaagtactaacccaacaatcagccctaaagtaccaaaaagcagtgagattggactctggctggtcaaccgggattcaacacgatcaatggcctttagaacataatttccagtaagtaacgaaataatataaaaaataattgcacctaaaattgcattggtaataacattattgaaaagtgttccatacgcaatttgaaaaataagccataggagcgggaagtaactcgctccgattgccgctcctgcaagtgtcaaaacaattcggactattctctttcttttcaacatctcaccctctttacatttattattttaacccaatgccagcttaagcgcctgcgataaggttgatacaccaacaacgtcaattccctttggcggtgtccatccctgcaagttatttgcaggaactaaaacccgtttaaagcctaacttttgggcttcggaaacacgttgctcaatccgagtaactcggcgaacctctccagttagtcccaattccccaacgtaacattcagttggacttgtaccacgatttttataagatgaagcaatactaacagcaatcgcaagatcaatggcgggttcatccagttttacaccgccagctgctttcaaataggcatcctgattttgtaaaagaagcccggcacgtttttcaagaaccgccataattaatgacacccggtttcgatctaatccagtagcagtcctagtcgcatttccaaaaacagaagctgtcaccagggcttgaatttcaaccagtataggacgggtaccctccatagacaccacgattgcagacccggtggcatctttaagacgctcttccaaaaagatttcggaagggtttgtcacttcgtgaaggccatccgtcatcatttcaaaaacacccagctcatttgtagacccaaaccgatttttgaccgttctcaaaattctatatgagtgatggagatctccttcgaaataaagaaccgtgtcaaccatatgctccaagattttaggaccggcaatggcgccacccttggttacatgaccgacaacaaaaaccgtaattccttgaccttttgcaatattcataagatcagccgttacttcccgaatttgggcaaccgaaccagttgccgactgcaactcagggatctgcatcgtttgaacagaatcaatgacaacggcatccggcttcatatcactgatcgtacttttaatgacattcatatcggtctcaggaaagacgtacagctgtttactgtcaacatctaatcgatctgcacgcatttttatctggctggcactttcctcaccggaaacatataaaatcttacccgacctgctcaattggcctgacacttgaagcatcagcgtcgatttgccgattccaggatccccgccaattaagattaacgatccgggaacgacaccaccgccaagcacccgattgagctcttccatgccagtcttaaaacggggctcactctgaaatgtgacactactgagtggttcgggcttaacctcatcgacacccgtccttcttaggccggcagttcgggttgaattggactttggcgcaatcgtttcttcaaccaaagtattccattcgttacagttaggacaccgtccaagatatcgcggtgaaatataaccgcagttttgacatacaaattgggttttaactttcgccaatcgaattctcctctttacctaggttatcaatcaattttatcacttaataccattcatttactaaacaaacaccgggtttaaacgcttcttatactttacaaagcgaattaacgacccgaagaaccgaaaccaccatgacgggtttcctgcttcgaatgatcatcctgatcggctaaaagatatggcataaagattccctgagcaattctttcgcctttagaaattttaatgtcggttattccaaaattaatgatttgaacaaaaatttcaccttcgttaccactattattgtaataatcagcatcaatgacaccaatcccattcggaattgctaatcctcttttcaacggattactcgaacgattggcaataattaaaacttcatcaggttgcatatacgctttaatgccggttggaatcaaaaatggttttaaaatctgctttgcatgatcgattttttcaggagatgcttcctttccatgcttaatggcccacaaaacctttaaaaaatttaatttccaaatagatgggattgtcatatcaacagcactttcaaaatcataacccgccgcattcacagtcgttcggtaaggaactgttagtttttggtcctggtactttgacacaatttcgaatccacgtttcataataaaaaactccttttacaaaatttgcttgttacagtataaactatatttagcgctaaaacgatagattgacaaattaacaaaaaaaagccaaaatatgagttagtaaaacctttaagcagtaaaaaatgaaaggaaatttgtaatgacaaaacaagatgaacttaaacaactagttggccaagaagcagttaagtttattgaagatgggatgatcgttggcctgggaacaggttctactgttaaattcatggttgacgcactcggcaaacgagtcgctgacgaacaactatcaatcgtgggtgtcccaacttcccaaagaactaaagaacaagctgccggccttggcattccaacaaaagggcttgatgaagtggatcacatcgacttaacgattgacggcgccgatcaaattgataaaaattttcaaggtattaaaggcggcggtgccgctcacctttgggagaaaattgttgcaattaattccacaaaaaatatgtggatcgttgataaaagcaaaatggttgaccaactcggttcttttccattaccacttgaagtcatcccgtacggcagccaacaactatttaagcgcttggaaaagcggggatttaatccggtttttcgaatgaaaaataataactatgtcacgaccgattccaacaattatcttattgacctacatcttcacaaaatcgataatcccaataaattggcacttacacttgaccaaatgaccggaattgtggaacatggtcttttcttgaacattgtgaacactgtcattgtcggagaagacgatggtccaaaggtacttcaagctaggtaatctcaatacaacttttatttgtaagggactgagacaaaagtcattttgtccagtcccttttaatttcatcacgactattacactctggaagttaaccaccatctgtctcactttttttagtttaggtacaaataaagcaaaacgcaattaatatttttaatggatgtacatccatcccaacatcacctcttcactagctctttttagtcgatgagagtaaactattaaattattaaggagagtgatttttgttgacatcagaaattaaattagaccaaatcaacaagtttcaacaaaatcttgataaccgaaaggattcaaaagttgttgaacgagccgtttcacatcaaggcattttagcaagcagtgaagatttcactgcagaaagtaaaatgcacccggtattttcaattgatctctcaactggaaatgttgccgatcaaaagcaaagcggacgttgttggatgtttgccgcactcaataccatgcgaattcgcttaatgaacacctttaaagtatcagacggtttcgaactttctcaaaattacaccaacttttgggataagtttgaaaagtctaattactttttagaaaatgttcttaagacagccgatcagcctcttgattctagaaaagtttcctggttaatgaccacccctcaacaggatggcggtcaatgggacatgctttgcgcacttattgaaaaatatggcattgttcctaaatatgcaatgccggaaacttttaatagtgaaaaatcagctcagattaacaagttccttaatttgaaacttcgtcatgatgctgttgccttacgtgaactggttgccgataaagcttccgacaccaaaattgctgaaacaaaggaaaccatgttaaatgaaatttatcgaatgctggtttatgcattgggtgaaccaaccacttcatttaattttgaatatcgggacaaagataataactatcatatcgataaagacattacacctcaggatttctttaagaaatacattaaccttaacttggaagattacgtgtctttaatcaattcaccaaccgctgataaaccctttaataaaacttataccatcgaaatgttgggtaatgttgtaaatggtcgtcaagttaaacatttaaatcttgaaatgtcagaactgaagaaacttgccattaaacagcttcaaaatggcgaatcagtttggtttggtagtgatgttggccaaagttccaacaccaaaaagggcatcatggacactagtctttatgttccggatgaacttttcgatgccgatttatcactatcaaaagcagaacgactagactatggtgagagtttaatgactcatgcaatggttatcaccggtgtggatcttgttgatggtaaaccaactaaatggaaagttgaaaatagttggggtgaaaaggttggtactaaaggctacttcgtcatgagtgatgagtggatggaccaatttgtttaccaatttgtcattaacaaagcctacttaaccacggaccagcttactgcgcaaaagcaggaaccaactgttttaaatccatgggatccaatgggtgctttggcttaattaattatctatattaataaatacgacaaaccaagaatatttcttccaggtttgtcgtatttttgtttaatccgttttatcacatcattactttatgatgtatccattgatgacgtgattaatttccacaatactaaaattgtctcagtttaaccattgttccatattataaaagtcttttcgtttatttatcagtcatgaactgcttatgaacgatatttaagtggtcatcaaaatcataacgaattggcttgccgtttggtacttctacattcggaatttcttcgtcagaaatatcctccaagtatttaattaatgctcttaatgtgctcccgtgagccacaattaattgattttttccgtcaagaaggcgtggtgcaacttgatcaacccaatatggaatcaaccgttcctgtgccatctggagactttcaccacgtgggattttgacaccatatcgatcatacctgggatcttcatcccgatttttcagcaaaggtggtacaacagaaaagcttctccgccaaacttttagttgtttggcaccgacctttgctttgacagccaatttgttttttccacgtaatccgccataatgacgctcgttcaggcgccaagacttatgttcgggaataaagttctggttaatttcatttaagacaatgtttgttgtaatgatggctcgctttaaaaatgacgtgtggacatcattgaactgaatatccgatttagaaataatttttccagcctgatgtgcctgagaaatccctttttctgtcaaggcaacatcagaccaacctgtaaaaatattatcgcggtttgcctgactttcgccatggcgcataattaccaaagttggcacaatttcatcttcttttgcaaaatattcaagcgtactgaaaaacaatgaaaacagttaataatgttagtctaacatatcctcaaagttaaacaccagatgatagtgaaaaattgatcaaattttctcaactctttcagaagatgaatcggattgtactttgccattcttaacggctttatcattttcaatcaatggttcgcgaactactcctgaatttttaagttccttatcagaaacacggttaccaataaatgtcacaacggatcctatcaaaataacaacaattccaaccaacattggtgttgtcatcttttcatgaatggttatcatcgcaaggataggtgccaaagccggtttgataaaaaacaccaaagaggcaatcgaaacaccatcaagctccatcgctaaaaaataaaaagcaaatcccccaccggttacacataccccaatgaaaaatagaaccccgaaatgtgctaaattaacatttgttaaaactggaatattcgcaaattgtttcatccaactgattgaattcatagcattcgaaataaaacgaacatgtgtcagtaaaactaaaacaaacaactctgcagacccggctatgaatgtataagctgtcattgtgattccgtcaaagccttcaagaatcgatccccatcgagaaataatactgtagagaccgaacgttaaagctgatagaatgccaagaatggtgcccaccggatttgtcaaattagcaggattaacaataatcaatagaccgataacggaaataaccagcgaaatcatcgatacccgattcaacttttcatgaagaatcagaaaggcaaaaatcaaggcaaacacaggattgcaactaaacaaaacagctattgtagcaggtttaccgtaaacaattgctaactgataaagtgtcatgctgacgataatacaaagaaaacccgtcaaagcaaagaccagccaatccaaaagcattaatttttggcctgcccgcttaagatgatgattcgccaatggcaacaatactaacccgccaataaagaaacgaatcaaatttaattgaatgggactaaattgattactaaccgcttttagcacaatttccatagaactaaacattaaagttgaaattaacacacacaataatgattttctcatttttgcctccctatattttttgaaccaaaaccattaaaatcggaataacaatcaaactaagtaaagtggtctctgcaaccataattgatgcatattccgaatcagcatgatacaaccgggaaacaactggtgcattggtcatgatcggcatagcagactgcataatgaaaacctgtttcataagagttggcatccccgttggaataaccaaaagtgacatcactgcaggcgcaagcaaaaatcggccaaataaaatcaaaaaattgcttcgatcaaaatgaatattactcaaatcaacgctattaattgaaatcccaataaaaatcattgataacggaattgttaggccaccaacgtaatttaaatcctgcataataaagtttggtagcttagcatgtaatagtaccaaaataacgcctaccacaaaacccagaagcggtggagaaaaaaccttttttaacgtttttttccaattaacagcagcctcgctgcctacaccgtccttttgaatcaaatacacacctaacgtccaaaagaaagtcgtgttaaccatgtagtagaccaaaacaaacggtagactgggactatgaaacagtgccatgttcaccggaagcccaacaaaaactgtattggaattagaaaacattgactggaacaacccagaatgaatcttcgggatcttaaataatttgacgattactatcgacactatgtatagtaaaaacattgaaacaaagggaaataaaatgtcaggaagtgttgttaaaagcttcttggctgtaaacttttccattatggtcgataccatgtaagcaggcaacgctatctgggtaacaagcctagcaatcatgctcgtcatcttgctatcaaaccagtcatttctggctaaaatgaatcccaatgcaatcatgattaaaatgatcagcaccccagaaattgctgaaacaaaaacacccatatcaattcctcacctcaattcttaaaactgtaacgagttattattataacacaattagaatccacattctgctgtaattttatacaacagaaaaaagatccattttgcgttaatattgaagttgtcagttttaagaatgattcgttatcttaagaacaaaagttggtgatcactaacttttgcttcaaactagacaagaattgttaaattatgtttaaataacgaagtatttgtgcaatcaacctgtaaagtgcaatatacttttgtaagaattttttgtaaatgaggagtcaatatgccatcagacaagaaacgggattttgaacccgtatattcacgtagggctgataaaaagccacattataagaaaaagaatcgacgaaggcgacggattgtcggctggagcatttttgcagtactgttgctgatcgttggaggaggactactttggggttatggcgcgtataagagcgccaaaaagacttttaagcaaacctatgactctaccaacgttcaaaaggagcggaatgtttcatccgttatcaaacaaggaaagccactttcaattctgttacttggcaccgataccggtgcgctgggacgtcatgataccgggcggactgatacaatgatcgttgccaccgttaatgccaagaagaaaacgattcatttgaccagtattgctcgggatacaaaggttgttgtccctggtgatacccaaccatatgaaaagattaacgctgcctacacaattggtggcgctggaacagcggtcaaaactgttcagaatcttttggacattccaattgatttctacgccattattaacatgggtggtttggaaaaaatggtcaatgccgttggcggtgtcgatgtgaagcccccccttacctttaattatggctatgctcatgtcgtaaaggggcataagactcatttaaacggtcgccaagccttagactattcacgaatgagagatgatgacccgttgggggattatggccgtcaggctcgccaaagacaggttattaagcatttggtcatgaaaggactgggaattacttccctgccgagatataaatccattctttcatcactaaacggtaatctaaaaactgacatgacttttgatgatatgattgctgtcagagcaaaatacggagatgcaacccatcatatcaaatcccagaccttacaaggtcaaaatgcaatgattgacgggctgtcatatcaggtcgtaccggacaatgaattactccgtgtttctaatgatattcgaaaaacactcggattgtctgaatcaagtaaacttaaaacacaacagtcccaaaccgattcaactaacggatactcaacgggcggttactcaagcacaactggtcagtcatcagcttataacggttactaatttattcaaaaaagcagtttggataacatctaaatgatgttgtctaaactgctttttttattccggtcacacaaatacgccaccggcatatcctaaaatgcctaaaagaaataaaagcaaaatcacccaaattggagatatccgatgacgaatcaaccaaatacaactaattgtcagcaataacgcagcaatcgctgaaaatagagaattgatccactcaatatgtcgaaatatcactatccttgttaagtcaaaatcaacttttacccacttggcaataaaaatacctgtcataaacataccaaagaccgcagaagctcttgtaacagtctttaaaatgcctgacccaaataagtctataatatccgttccgtgacgataacctatctgttgagccttataacggaaccctagccgcaacacattccaagctgcaaaaaaaagaataggtccccaaataccaaagccactcatcacaacacttgatgctaatgcagataaaacaggtcgaattgtcccattccatacaggatctccaatgccacccagtggacccatcattgccgttttaacagaagtaatttcatttgcactgattggctgaccatcagcttttttctcttccaagttcaacacaactccagtaaccagcgattgcataataggtgacgtattgaaaaagagcaggtggcgtttcattgccgcaacccgatcttttttttctggataaagccgttttattgccggcgataagataaaggcaaagccaaggttttgcatgcgttcataattccacgaagcctgttcgaaccctgaacgccaaaaaatactgataaagtctttcgtttgaagtttaggctgattatttaatttattttgcttattattaaaatcctgacccatcgttaattaccaatcctctataaatcatctaattccttatcaaaattatcctgttcgtcaatatcactgctatcctcggacgaattgggatgttgattggaaaaccaaatataaataatcgttaagataattccgactatagtcagaataaaaatattaagaccagataaagccgctaataaaaagccggccaataaccaccaccaaagatttttatcaatagtcatattcataataatagcgaatccaactgctgcaatcatccctatcgaaacgtcaattccgttggtaatgacactaggaattcgattggtaagagaatgaagataaccgggactgatcaacatgactaaaaatgttggtacaacaactcttagtccctgaaggcccaaactcaaaagatgaattcgatccagccaagccaaattaccctcttcggccgcttgatctgctcgatgaatcaacattgccattcgcttacgaatgaagacatttaatagttgtccgacaacagcaaatggaatcgtaaaagcaatcccatgtttaatactaatagctgccggcccacaaaccagcaaggcggaaatgacagcaggcagtcctatatcaggtgctaccgcagcaccaacattcatccagccaattgtaatcatttgcaaagttgcgccaagcaaaattcccgcgcttatgttcccagttgccgctccgactaatgtacaggcaaccaatggttggaaaagttgccattcatccaaaataccatccattcccacaaaaaaagctactaataagacaagtaccccagaaatgattcccattattttaccttctaatcgaccttaaaattcttttttttgattaaattcactaaattaatttttttatcagcggggatcttttgagccgttacttccaagtgaaagtcatttgtcagtgtctgaatctgttttgcaatatcatcattcatggcaactgcatcggtaatcattgtcatcccgtcttcgtatgcaatactaccaacgttgataccaattttgctgaaatttactccaccttcagctaatcgcagcatgtctttgacattttccgttagaagtaatgtattaaatgaatcaaaccgagcatcaaaataggctcgaatcattttattcacggaaacgacatttgcccgaacaccaggcggtgccacctgcgtaatcaatgttttcctgagattgtcttttgcaacagtatccgaaacaaccataatccgattaggctttacatatctcgtccagaaagttgcaacctggccatgcagaagtcggctgtcaactctggctaaacgaatatccattgtcatagcaagtcatcctccccatcactttgatccggtaattcaaactgtttaatagaacttgcagcaacgttggttaaatgatcaactacctttgataaactctgatctttgatcatataagcttccaacaataaaggtaaattcacaccggcaattaaagcattgtgtgccggatcttcagccacgaacttggaggccgcattaaagggtgaaccaccccataaatcggttagaatcaatacatcatttcttggcaactttttaaaaacatctttaaatttactttccagcgcatcaatgccatcacttggtgccaatgtcaccgcggctacattctgctgcttgccggcaatcatttctgaagtatgaattagtgcttctgcaaattcgccatgactggcaacgataattgaaatcacttatttcactgtcccttccaaatcaacttaaaaacagttgaacactactgaaccttcatcaattgttaaatcaaatataacacggctaccattaaagctcattcagccaaacttccaatcgttaacaaatccgctggtgtttcaaaataataatcactgttagcaaaatcaacggtttttttggttcgccagcctgcaagtccaaaagcaacgtgagctgcatgtgctgcctgcagatcatagatcgtatcaccaatataaatagttgctttaggatccgcatttaacttttcaatgcccttaaggatcaaatcgggagctggtttaccgtgtttgatttcatttgaaaagacaaatgcgccaaaatagtcatccaatccaaatcttgtcacatcgcgatgaaactcatcttctatttttgaagttgcaattgcaagacgattgtttttatcagcatgaagtttcgccaagctatcgataatgccatcatataccttagcatcatctttataatttttaatttgatcaaaccattgttttcgcacagcttcaacgtctttaacacctaagattttaagtgcatccgaagccgtaatgccaaatacctttttgacatcatcataactaacgttatagccattggcccgtaacgttttgtgaagcggcaacaggtacattttttctgtatcaattaatgtgccatcaacatcaaaaatataatcattcatctctgttcaaatctcccttaaacctcattatcttttgcttcttctacttccaacataactcgatcctgccaaatcggcaatcatattcattaactaatcccatttttcttcacaatactttttcacttactttctgaaagatcggattaacatgagccatcttgaaattttctcacaaagttttgcatgaaaaaagtccgaaccactactaaaagtaatgactcgaacttagatatgcggccaagaagattcgaacttccaccgggataattcccgacaagatccttaatcttgcgcgtctgccaattccgccatggccgcatcaacgaataaaattataacaaaaatttcgtaggatgacaatctatttttgaaaaatattcacgattaaccttattttattcgtttttcaagtcacacaagccctattcgccgcgaacagttgcaccttgttcatcgacttccaataatctcaaactgccatttaaatttttttcctgtaattcaattctcaattgcgttaacgctgatttttcgccaagtgttgcaactgtcggccctgctccggataaataggtgctgtaaatgcccaactcatgagctgtctctttaatcacagccatttcgggaactaagtctttacgataaggttcgtggaactggtcatcttcaattaaagagaccgccttatcaaatttcccctgtcctaccagtgcaataaatacattttccttactgcttgccctaaccgcagtttgataagcaattgtttgaggaagtttcttgcgactttgagcttcacttaaaccatccggtcggatataaactaatgcataaaggtcgggtaattccagctttgttgcaatcgcgtgctttccatcaaatgttgagacagccagcccacccaacattgcggcagcaacgttttcaggatgagtttcaaattttgcccccatcgttatctgatcatccagtggtaactctagacttcccagcgcgtttgcaatctttattccggcaaccaccgctgtcgtacttgatcccaatccatgagcaatcggaacatcagaaataacagtcaactgatgaggatgaatatcagggtcaactttcaaaacagtctgcacaatcaaattacgctcatcagtgggaatatcgctccccaatgcatgattgactttccagtgatcggtttcctcctccacgataacggtatagtacatatgaagtgcaattccaacagaatccattcctgaaccgacattagcagaagtggccggaactcgaataataatttttgccatcgaacacatctccctaatcacaatgatttatccaaacagaatcttatctattacctattaatgactaagcacttgctgaaatcaagcgtaattgacttcgacatcttccgcaaacataccgcttcaaatcaatctttctctttctatgatactctaagccacaatgagggcatcgataaaaatacctaaacggggttcttctttcattttccgacagcctgggtgcatatctggatcccccgaccgcttttaacaattgtttgaactcttttgtattatgttttcctgaatagcctgctaagtgtaggtggtagtggcataactcatgcttaatgatcccgattaaaacatcatgggtaccgtgatcatccattttaggattaatatcaatatcatgcgagtccaagtgataccgaccgcccgttgttttcaagcgatgattaaaataagcgtggtgattaaaaggtttagcaaaaaattgaagcgatactttttccactaaacgctgtaattgttgatctgtcacgagaaaatcctttctaaacctctgaacctaatcagcaggttcaatcattgacaattgaattcgatgccgatcgacatctactgaatctatccaaaccgttacaatatcacctaccgaaaccagcttactgggatctctaacaaacgttttgctcattttggaaatatgcaccaagccatcctgcttaacgccaatgtccacaaaagcaccaaagtcgacaacgtttcgaaccgttccctgaagcttcattccgggcttgaggtcttccatggtcaaaacatctttttttaacaagggtgtcggcatatcatcccgtaaatccctgcctggtgtctcaattcctttaacgatgtcccttaaagtttcttctccaatatcaattgtttgcgcaaccacaggtaaatccaaatggactaatttttcagccacaatcggtttccctaaatcattaattgtaaggtcgtattgtgaaagtaatttagttgcggctgaataactctcaggatgaatatccgtattatcaagcggattactgccattaataatccttaaaaatccaactgattgttcaaatgctttaggacctaatcttggaaccttttttaaatccgttcgattgctaaactttcctgattcgttccgaaatttcacgatattattagccgttgacttagttaatcctgaaatatgaaccaaaagatccggacttgcggtattcaaattaacaccaacttgattaaccgcggtttcaacaacctgatccagtttttcaccaagttgtttttgagggacatcgtgttgatattgaccaactccaattgcttggggatcaattttaaccagttctgccaatggatcctgaattcttctagcaatgctgacggcagaccgctgttcaacactgaaatctggaaactcctcacgagcaaccctgctggcagaatatacggatgcacctgcttcattaacaatgacgtaataaaccggcgcatctattttcttaattgcattcgctacaaattgttccgactcccggctggcagtcccgtttccgattgcaatcatttcaacgtggtttttattaatgaaatcaataaataacccttcagcagcctttcgttttgcctcactggctggcttatgcgggtaaatcactgtcttatccagatatttgccatttgaatcaacgacagccaatttgcatccagtacgatacgcaggatcaaatcccattacgattcgtccttttaagggtgcctgcatcagcaggttatataaatttttaccaaaaatatcaatggcatgctcagccgctttttcgctcaattcctttcgaatctcacgttcaattgcgggtccaatgaatcgctgatacccgtctaaggttgcatctttaacaatgtcggctgccaatcccgaatgctttccaatcatgtttgatgtcagataccaattaatcggtgtttcgttaactgtgattttgacatttaaaatgccttctttttcaccgcggttaattgctaacgttcgataggacggtatttctctgacagactgggtaaaatcataatactgttggtaagtgccggtctcatccttttctttagcgccacgcttaactttcgttgtcatgaccccataacgatttgtgttttgccgaatccactttcgaaaattagcgctgtccccaacttcttcggcaatgatttcatggattccagaaataaccgtttctcgatcggaaaggtctttatcaggatcaattgcctgactaattttgttatcaagttcattgtcaaaactagttgccgcctttgccaagggtaaaagtcccttttctttggcaatggtcgcttttgtacgccgtttctgcttgtacggcaaataaagatcttcaacctgttgaagaacggttgccgtctcaatttgttttttgagtttaggcgttaatgccctttgctcttcaataatcttaataacctcatccttacgtttatccaacgtttggattctatgagccgaggcttgaatatctcgaatttcaacttcatccaagtttgatgtccgttcttttcgataccgggcaataaaaggaaccgtatccccttcttcaagcattttcagcgtttcagctatttgttttacgcgaatcttcggtaaatcatgctgtattttctcagcaagcgtcatgtccatgaaataacccacctcattattaatctagctttcattatatcatgccaaatggtcaaaataagttgaaccaaaaagagaaccttcttcaaaccccatatttgggagaagaaaaaggttctcaaatttatgtcacactataaagaaatgctcattacggcctaaaatcgactattaaccgctttgattcgcacactttttaggactgctcctcaaagcagcatcactcctcataagggatcaaattgaaaaatcaaaggtcgtgatttcccaatttgacgccttatgctccggatgctaaccgctttgattcgcacactttttttaggactgctcctctaatcataaacctgcatgtaaaccaacacccatcaaatccccaaaacaggaatttgatgggtgttggcttacactccggtttattccagattagattcgcacactttttataacattcccataattcttgtcgtaacgtcagagacttttgcaatgtgattttcctggtctttttctgatcgattgaatttttcggcatcaatcgatgcatcttcaggatttaagctgtctgtcatatcctgacatgcatccgcataatccgcataggctctgaccagtattttatgtttacccagtattttaaccggtaccggtgcctgttcaagtttatttacattgtcttgatacttatcagtcccggactgaaaatgagttttaatttgtgttaatctatctgaaccaaggtcagaaacggtcttatcatcaattgattttctcagcacttcgtagtctgcatttaaatcttcaccgtttgattgtgttgaatcgataatatcggaaacaattttggcatatcttcttaagtcttgtggtttcaaaaagaatgacccccatctaaaaattattgttgattgaagaaatgacgctgtacatattttactacttctgagataacaacgatcataaatccgccaataatcacaacaatccattgtgaaagacctaattcagtgacatggaacatatcattgaatcccggtacgacaattgtaagcactagtagtaatgtagaacccaaaagtgcccaattaaagaatttatttttgaaaagccccaccttgaaaatggattgatggatcgttttcgaattaaatgcgtggaataattgaatcaatccaagggttgcataggccattgtcaatgcatccgcatgaattaatgcttctgacgaatgaaccggattcaagatggcaaacgcgtatacacttaaagtgataaagccttcaaagaatccttgataaagaatattactcataatcccgcccgacaggaaatttgacgagcgtccacgtggtttacgtttcataattcccggctctgccggttcaacacctaatgcaatagctggaaaagtatctgtcaccagattaatccaaagaatttgaaccggtgccaaaatctcccaacccatcatggtcatgacaaacaatgtcaaaacctctcccaggttggcagacaacagatattgaagtgacttttgaatattggcaaatacttttcgccctgctttaactgccgttacaattgttgcaaaattgtcatcggccagaaccatatcgctggcttctttcgaaacttcagtacctgtaattcccattccgacaccaatgtcagccgcttttagcgccggtgcatcattaacaccgtcaccggtcatcgcaacaactttacccttcttttgccaggcattcacaattctaaccttgtgttccggcgcaactctggcataaacggcaatgttttcaacctggttctcaaactgactgtctgataattcatccagttgcgccccattaatgaccttatcagttgaatgatcggatctctctagaattccgagtcgcttggcaatcgcctgagccgtatcctgatggtctccggtaatcatgacagatttaattcccgcagtctttgcttctgcaactgcttgcgctacttcgggcctctcgggatcaatcatgccgatcaaccctgtaaagatcatgtcatgttcctgggcatcactcgttaattctgttggtaccttatcaaccattcgatatgcaaaagccagtacccttaatgcttgcgtagctaactcatgatttgtttcgctgatcttttgcttatcttcatctgtgatttgccgaacttgaccatgatcaagaatttgggtaacgcgagccagtagttggtccggtgcacctttcatcgtcatcataatttggccgtcatcaactttgttataggttgacatcaattttcgttcagaatcaaacggaatttcagccaaacgctgatgctttttaatgaattcctgaaccggcaaatcatgatttaaataaaacgaaatcaaagctgtttcggttggatcaccacctaatccgtcttccaaaaatttagtatcgttatttaaaatcataatctgtggtaatttgtctgataataactgcttcgtttcgccatagtcctttagttgaccatccaaataaactttttcaacggtcatcttattctgggtcaacgttccggttttatccgatgcaataatatccgtacttcccaatgtttccacagcttgtaattttcgaatcagcgcacggtggcgagccatttgttgcgtaccaattgccaaagtaacagtcacaatagcgggcaggccttccggaatagccgcaaccgctaaagaaatggctgttaacagcatattaatcaggctttcctcgcctcgccacataccaacaccaaagacaataactgcaataactaaaatcaggattgtcaataccttaccaagcttattgagattttcttgaagaggcgttgttgcttcttccgttgtgtttaacatatgggcaatcttaccaacttcagtgttcatcccggtgccggtaaccaccccgactccgcgtccggaggttacattgctgttcataaagccaagattcttacgatcaccaagtggcagatctgtgtcattaatcgtctcaacctgcttattaaccggcaccgattcccctgttaaagctgcttcttcaatttttaaagtatttgtttcgatcaatcgaatatcagcaggcacaacatctcctgcttcaagaagaacaatatctccaggaacaatctcttcacttttaaccgttgtctcacggccatttctcagcactgtagccattggagccgacatctgttttaacgaatcaattgcattttctgcctttgactcttgaaagacgccgaagaccgcatttaaaatgaccacagcaataataattgcagcatcaatatgttctccggcaatccccgcaataattgctgcaataatcaaaatgataatcattaaatctttaaattgtgcgataaatttttcaaataacgttgtccgacgctttgcctgaagtcgattataaccaaattgtgcccgccgctgttcaacagactggtccgataacccttcaggattcgctttcatttgctgcatgacgtcattaacggattgttgataaaataattttccctgctgcttcattaatttcctcctttttaaagaaaaagagacccataaactcttgtgaaaagaattcataagtctcaccatttaagaaatatcccggaaatacaagatttcacgttgacgagatattcgcaattactattgctggttactccctttatttgagaatattatacctaaatattcatgttttgtcacctaatactacttccaaaatgtatcataaacattaattggtgtgtgacgcttatgctcagtctttcgataccagctttcaatcgtttcagctgacttttgagaaacttctctgccttccagataatcatcaatatcttgataggtcaccccaagtgcaacttcatcaggcaacgctggtcgattatcttccaaatcggctgtaggcgtcttttggtacagatgcttaggagcatccaatacttcaagcaactgctttccctgacgtttatccagccgccaaagcggtgtgatatcagcggcaccatcaccaaactttgtgtaaaaaccggtcacagcttctgccgcatgatctgtaccgaccacaacgccatttgtactaccggcaattgcatattgggcgatcattcgttggcgggctttaatattgcccttattaaaatcactgacgttgacgtcatttgcttccacggattcaacagccgcatcaactgcagactgaatatcaactctaaacgtctgatccgcttgaatatacttaattgctgccaatgcgtcagattcgtctgcctgcacaccatacggtaatcgaacagcaataaattgataacgattgtcacccgtctcatcgcgtaactctgaaactgccatctgtgacaacttcccggctaatgtcgaatcctgaccaccggaaattcccaaaatgagtgatttaaaaaaatcgtattttttcaaataagattttaaaaaatcaacacttcttctaatttccacttttggatcaatcgttggttgaacccttaacgcatcaataatttcttgttgcttttctcgcatggccatccatcccttaacttaaaaattaatttgctgtacgtagttacggactttttcaataatgtcacgtttattgtcccagcacttttgcgataggtcaacaggatatttttgtggattaagttcacgtttatattcaggccacaatgacgcgacctgttttttagcataatgagaaatttcttttaaatcaggtacttggtagaccaattttcctttttcaaaaatcggttgaagaagcggttgtgcattaaagttttcgaccgttttgttaatatacgtgtaattcgggtggaacataaaaattgatttttcctgacggggatcctcatcagacaaggtaatataatcgccctccgatttaccatcccgagcatccgtaattcgccacacctgctttttgccaggcgttgacactttttctgcatttcctgaaatcttgattgtatctttcatcctaccgtcagaatgctcaactgacaccatcttgtaaaccgcacccagcgcaggttgatcaaaggcggtaatcacttttgtaccaataccccaaacatctatcttggcatgctgcattttcaagctggcaattgttgtttcgtccatatcatttgaagcaaaaatctttgtatcctcatagccggcattatcaagtaattcccgaacccgcttggacaaataagccatatcgcccgaatccaaccgaacaccggcaaatttgattttatctcccatttcgtcagcaactttgattgcactcggcacaccactcttaagtgtatcgtaagtgtcgaccaaaaaaacacaatcatgatgggtttgggcgtatgctttaaaggcatcatagtcatttccaaaggattcaaccaatgaatgggcatgcgtgccgctgatgggaattccaaacgccttaccggctaaaacatttgaagttgaatcaaaaccgccaataattgcggcgcgggttccccacaaagcagcagaaacttcttgagcccttctagttccaaattccattagtggatcatcaccaacaaccgttcgaattcgcgaagccttggttgcaattaatgtttgataattgaccatgtttaaaatggctgtttcaacaagttggcactcacaaagcgttccttcaacttgaaggatgggttcattagcaaataccaaatcaccttcaagagcagatctaatggttcctttgaatttaaaatgacgaagatagtctaaaaaatctgttggatagttggtcacttcttgtaaataatcaatatcgtcatcagtaaaattcaagccttgaatgtactcaatgacatgttgaaggccggcaaaaacggcgtatccgtttccaaaaggcagtttacgaaagaatacctcaaagaccgcatgccgattttgcatgtgtttttcaaagtaagtggccatcatattaatttcatagaaatcagtatggagggttaagttgtcaaattttggcattttattaaattatcctcccagataaatgttatataattagtttaattctatcattattctgaatattgaaaagaattatgcaattatttcaaattaatacaattagaaacagggagattttatggagaagcaaagtcaaaaaaagcccgtttcaattctgggcattccttttgaaaacaccaaccaagaacaatttgaaagcctgctaaagcaacgcattaatcatcacaaaaatacgtttgttgttactgcaaaccctgaaattgtgatgtatgctcggcagaacagaccatacgagaccctaataaaaagggcggactatatcattgcagatggcatcggcattatcattggcgcaaaactgttgaaggatccccttcaagaaagaattgcaggctatgatttatttgtgagcctcttggaatggggaagtcagaatcataagtcagcttattttgttggtgccaaaaccgaggttatcaacaaactaagagaagttgtggctcaaaaatatgccggtctaaaaattgccggtactcataacggttattttggtgatgaccgcaatatcatcaatgacattcgccgcacgcaacctgacatgatctttgttgctacaggttatccaaaacaagaagaattcattgataagaaccgacagaccactgacggcctatggatgggaatcggtggctctttcgacgttctaacgggaacggtaaaacgggcgccggggagttggcaaaaaatgcatctagagtggttataccgagtcgtcaaagagccaagtcggatttcccgattgtcagtactgccaaaatatttgatagccgttttgaaagaacgcttatcaggaaattaaaggggtaatcggtcacgaaaagcacacaaaatcaagaacaattgaaagttgttctttggggcattttcctgatctcgttgggaatcgtctttttcaacatgataacacatcaatttatactaaaacatgtcccggttgaaatattgggtatctttcttttggcatatgtcactaactttatacacttaaataactatttaatcattggcatcatttctattggctatcttatttatcttatgttttttggtggcttcgttaattggacatcactcattattttcattccggtatccctttttagtagctggatcacagtctggctgagtggttcccttttcaacaccaagtcattcgaaaagaaatctaaataaagcaaaaccggttgctcgcataaaaagcggacagccggttttgctttattcatttgagtttaatccattaacctttttccagataaaattcaaaacgatcaccaacgtactgtgttctgacgtactcaaacgggcgaccatcctgcaaatatgtaatctgtcgaagtcttaaaattgcgtctccacgcttaatatcaagatattctgcaattctttcagaagccagcatcgcagaaacagtctgctgtgcctttccaaggcttaaattctttttttgctccaaagccctgtatagtgaactcgtgacttcggacttttccaaaccggcaacgatattttccggaacggttgcgacttcaaaacaaattgggatattatctccgtatcgaattcgttccattcgcaacaccgattgatcttgggtaatctttaatttctccatttcactcaaagacggttccatcgtatgatatgaaattgttttgctggaaggtttcttgccttgtgccaacattaaatcggtaaaaccggttacccccgacattcgttcctgaaccttttggttggcaacaaacgttccggaaccaacccgtcgttccaagatcccttcatcaactaatgtttgaattgcttggcgaagtgtcattcgactaacgccaaactccgttgataattcccgctccgaaggaattcgatcaccgattttccatttctcggcttcaatatttcgcttaatatcattatgaatttgaatatatattggtaaacccattgttaccacctactttaaatttgtgtaaattatttaccataactatacgttgccataaggtctagttggttgtcaaacacattgatgtccgcatcgcttccaatttcaagggatcccttcccctttaaattaaattctttggcttgattggtcgagctcatttttaccgcatccccaatcgagcagccggtaaattgaatcacattcctaaatgcctgatcaaacttgagcacagaacctgcaagtttcccgtttccaagaattgcccggttttttgtaaccaaaacgtgctgaccgccaagctgataatctccatcaaccatcccttttgcttccattgcatccgttacaagttcaagtcgatctgatccgatgattcgataagctagttttacaaccggagaaacaacatgatacccgtcacagataagttccactggcatgtcagatagcattgaaaaaccaacgacgcccggttctctttgatgaagtccccgctgagcattgaaaagatgggttatgtggtcaacctgacattgttgcaatgttttgtacgtggcatcactatgccccacagaaattctaatttggtgggcattacaatatgcctccagggatcgatgatcatttatctctggcgcgtaggttatcagacgaaccaacccaccggataattgattccagcgtgataagtcgctgacattgactgactgaatctgatcaattggctgggcaccattaaatttttttgacacaaacgggccttccaagtgaataccaacaattactggattgattaaagcagcctctctaatcgtctccatagcatgcgagatctttgagggggattgagtcatcgttgtcagtaaaagcgctgtaacaccctcagatttcattttagataccatctggctgatgtgactgctatctcctgtcatcgagtcgatcccataaccgccatgaacatgcacatctataaacccgggaacaactaacttccctttcaaatcattaacatcatcatcccgttgaagatgaaaatcctgcatggagccaattgcattaaccttatcggaaaatctgataaatccacacttgatttcacgccgaccggcataaatatgaccattcgtcaaaacttttgacatctcagtaaaatttcaattccttttattttgaatttccggttgatttatcaattgttgcatcaattcctttaataacagagttcaaaaggccagcctgttccatcgcgagaataccggcaatggtatcaccacccggagaacaaactttgtcaatcatctcagcaggtgtttgtttagaggccaataaagattgtgcggatccaagtgcggtttgggtggcaactttagtagcagtttctttattgaatccatatttcacaccggcgcgacttaaacaatcgataaagaaatccacataagccaccgcgctaccggaaatagcactaaaaatggcaaattggtcttcaggaagttcactaatctcacccgttgcctcaaacagcgagaccgctgtcttcttttgctcgcctactaaattttcattagtagcaatagccgtcatgccttgtccgtattccgagttaatgtttggcagacttcgtaaaattggcagattataatcggttaactcttccagtcgattgagaccaatgccagatacaattgaaataagcgttttattagattttaattcaccgtttatttcatttaaaacatctgccgcaattccaggaacaacagctaacacaaccaaatcactgttctgggtaagttccgcatttgttttctgtgccgttaatccatattggtctgcatattgttcataacgagcctggtgtgcactatggaccaaaatgtcttttgctggcacaaattttgctctaagtaagccctgaataattgcttgggccattgcgccaacaccaataaagccaattttcatattcattctcctaacagttatatcggactattccaatttttctttaattcgacaatagcggaattttaagtagattgcaactactaaatttgtagaacagcaaaaaaacatattaatccattgtcattatatataacatgattacgttgattcactctatttatgatgataaataaatgaaaaatcaaccgtaaacttcttgattaaacgttttaaaaaagtgtgttgtagactaatgaccagcccccatccgacaaggacaccaaatgtatttgttaaaacatcgttaatgtctacccatctggataacccaacactccaatccaaaataaattgtaatgtttcaatgccaacgcttacgatcaatcctaaaagaaccgtcctaaaagaaccgtgtgcttggctttaaaatccggtcttaacaacgcaatgtaaacacccataggtaacatcattaatacattttggtaaaaatccgatgttgtactccaaaagggaattaggttcacagggacattaccaaccattaacggtgcaacttgttgtgtcccaacaaatgcatatgaagtaggtgccagtgttagataactgacagtgatcacgtaaataactgctgataaaattgtcgttaattgccaccgtgaaagcttcgcaatctgacttgattgaattttcagccagattagaacactggtcacatcaataaaatacggaatccatttaaccataacgctcaccttcccttaatttaactattactgtttttgattgttgcaataagcttaaagatagtgggttaagtgaagcttaagtctttttataacgacgagaggctttaaaaaaacataacttctgatcaaaaaaggaacttaatttaccgtggtgatctaagaaataacagatgtagtttctgtctaagcacaaattaatgcatattggcgttcatcatgtttattcggaaccaaagtatcgttgtgtttacgacgtttaaaattacagaattacttgataagtttataatcatttgtgtgatgtcattctaaaattgtttttaaaacattcttgttatatttcttcgttatgtcttggaaagacttgtattgtcagcatgtgacgaaataaaaatatgtaaaaaacgtaaactcaatctacagagaatgagccctacaccatccaaaaaaagcagttttaggtttaaacaaaagatgatgcaattcttatttttaggccgatatcgctatgaattgattataaaacagctcatattggacatcacgatgaaaaagtaataccagtaacacagtaaagattttaatcgatcagaatttattttgaccaaacactgatgtcattaaaagctgatatttaagagagagggtcttgactatgattacatcgtataaacgtttttggaaaaatatttttaacgtttctggtaccgctagtcgttcagattattggtggcctattattatcaattacgtattaggtattatcgctgtcattattattagtcatgtcactgggtactcatttgattcgatcagaaatttgaaagatttagcagtggattccaccgttcgaacagtcggcttgatcgtttggattgctacatttacagttaagatacgtcgattacatgattctgatcatgttggctggtggattttaattgatttagtaccattaattggaacaatctggttctttattttaatggtatttcccagcaaagctaaccgttgggataaaagataatcgttttttattttaggggttgatgccgtaagatatcaacctttttgtatttaaacagaacatcatcttactaaatgaattagctattgattcagataaaaaaagtgaaaaccgtctcctccaaacaaatagacgacatataggccaaaatattgaaaactatttatgatagagaaaaattgcagcatttcattggatacctcaaagatgataatcaagtccttcaactattctttctgcatgcaagaatcggaactgttggtcttaaaatggaacgatactattttaaaaaacaactttttcagcgtcaaacagcgtcatcaaagggtgttgggaaccgttggatgaccaaggggctcaggactcgcccgaaatcgtcgaacggcttatatagatgtcaaaacagcccaattttgccagactgacaaaaagagcaaggaggtgttttagcttctaaaccctttaatctaagaatggctagctttttgctgccccatgagtgatagtcaaagaaatgggagacacaaaaaatcccgttctcacaggcctttgacaacctatgaaaacgggtaacaatcaattattgggctagctgggttcgaaccagcgcatcacgggatcaaaacccgttgccttacctcttggctatagcccaagaataaaatggaggggagtggattcgaaccaccgaacccgaaggagcggatttacagtccgccgcgtttagccagacttcgctacccctccgcaatctgtgtcggtatcaaaccaacgaatataataatacaaaattatcgctatttcgtcaagcaaaatttttaaaaaagttgaattgtttttaactgctttagccactcactataaaaggtattggtttgccactcattatggtgatgattatggtatccaactgcaccgttataataccatgtgtttccaattttcctgggattcatatgatcatgaatgtgtccaaaaataacaatggggacagcatattcgtcaatcagttgcccgactttcacactaccgagcattgcattagccatgttccaaaatcgattatcacctgtatatcgaataaacaattgatttggaacaaagtgtgtcattaaaacaacccttttttgcgccttttgggccatctcaagctgcttttttaattcgtcaataactattccctctcgttgtggatcgctcataggctgcttaataaggctatctatccaataggccattttccattggtgaaactgtgcttctgtttttccggtgttctttgcaaatgaatagtcataccaaccatttagccctataattcgataatttgtctccggaatatcaaaatagtgattatttaaataacccggccaatgtccattttccaattgatcataggtcacgtttcgtatcatatcgtgattgccagcgataaacaacacttgagtactagatagttgtcctgacaattgctgaatataactgacagtttcgtgaaaatcattaaacaaatcacctgccactaaataataatcagttttattttcagttaaatattgagcttgctgatgaatgatgccgtcagttggtactttattcaaatccaagtggttgtcactagaggctgctattcgaatcatcttttatctcctcataaaaaatgtgctatcccaagtaggataacacattttatgcactttaaaactaattgacgccttccattaatttcttaattggtttaattaaaaaggctaatagaatacccgcgacaactgcagcaattgcaaccatcgtaaagtacctgacttcattgtctggcgtatagtatttaacgatttgagaattgacagcttgagctgcagaatcggctaggaaccacatgctcatcatttgcgattcaaacgatttcggcgccaacttggttgtcacagaaagcccaattggtgaaataagcaattcagcaacttcgacaattgcccaacttccgattaaccaaaatggacttactttagcagagctgccaaacaacgcaacgggaatgaccataaagagatatgaaagtcctgcaatcataagaccaagtgaaaatttacttggcgaacttggctgtttcttacccagtttaatccaaagccatgcaaagaatggcgtgtacagcataataaagaatgggttcaatgactgataccagcttgcgggaatctggaaaccaaataaactattattagtttggttagccgcaaaaagcgctagaacacttgacccttgctcctcaattgcccaaaaaatagcagcagcaataaataatggaatgtaagcaatgacacgcgagcgttctgtgctggtgatcttcttgctggtgatgatgataatgaaatagataattggtgttgcaacggcaataacacttaataaggtaataaagttaccaatgtttaaagcacccataacgttcattaagagtaatatcaacgcaaagacaacgacaccaagtccaaccttgacggacaattttttgacatcttcaggttccaatggatcggaagcgtacaaacttgagcttggaagatgcttctttccaccacggatatactgaagtaatccaaaaaacataccgatagcagcaagtgaaaaacctaaatgaaaattaacatgctgcccgagatacccaacaagaattggtgaaataaaggaaccaaagttaataccaaaaacaaaaattgtaaaaccggaatctcgtcgattgtcgtattcagtatataaatcgccaaccatttcagagatatttggttttaatagaccggttcccaacgtgattaaaacgattgagacaaacaaagcaatcgaacccagtggcattgatagtgcaatatgaccaaacatgatcaatataccaccataaaaaacagttcttcgactacctaaaattcggtcactaataaatccgccgacaactgatgacaaataaacaagtgacccgtaaattgacatgattgacgcagccaagccaggctcaaaaccaagtccacccttagccacactccaatacatgtagtaaagaagaattgcgcgcatcccgtagtaactgaaccgctcccacatttctgtaaagaacaatgtagaaagcccacgaggttggccgaagaatgacgtatctgcacgtttctcctggtcactttgaccttgttgttgcatgtgacaccctccaaaaaataaatctaatccgtttaacagattgttagcgggattagatctttatttaaaattactctcgtttaaagaataaatcataagagtaattataagctagatacacaacgaattcaacaaaccctatcctctaataaagctgtctcaacaggcaaatgcctttacatcgctgatttttcttcagtaatttattttttggaatttaagattatcggaatgaaacgcttaactataaaatagatagtctcagtgttcattaatgtatcctgagcatgcgttaataaaactgaatattgtagttgttgcgcatgctgcattattttattttgttcaatgtgcgcttttttaagccaattataagccgttgataaattttcagtatgatcttgtttttctactgaatttgataattgatccaatatctcagctaatattttctttgcatgtcccgaatacattaacatcgacattgcaatttgattaagttcatcatcattcacttacatggcctctgctggtgtgaactcattcataataaatttaactaacttttctccattggcccacccataaacatcatctggaattgtcttcaccttggctctgccatcaatcattttgatttctttatcgtgatatgacgcctgaggagcaattaaaactaaatcaatattgctatccaaatatgtatctgctttggtataatctgcagaaatcaggttaaattgagcgtcatagacttccataaatgacttagcagattttaaaaggaagttacttgaaataccattttcacaaattaataatacatttttcatttaaaagatcccctttaactatttatcttacttatacagattatcacatcgtccaatttttagcaagtaccaatataagactaactattaacaatgcctgtatataagcttttaatttcatattaatgtatataccaatttcaatcgccaatctataccaatttattttaaagacttatcccagaagaataagttcatttataaccttatgtttttttaaaaaactataaggttataaaatatttgctcatctaatagatttttgaagtaggcaaagcatataatggatttcgaagtttaagattattaacatttgaaaaatgttaaattattttttcttaaattaaaaaagttatgttggggaggagtttaagattatgaaaaaaatggtatttattgccggggttagtttagcaattccatttatattcgcaagtgcagcaagcgccagctattacagtagcaacgcattgaaattaaaggttcggcctgtaaataattcacaaactaaaattgccggcactgctacaaagggatccagcgttaatttttatcaagatggtgatttaaaagccaaagcaacgactaattcttctgggcattttacgattccgttaaaatatacgctctcacatattggaagctataaaataaccgccactaaatttaattaccgaccagttagccaaacgtttaaagtagcaatgtatccttatactgctcaaattaagccaattcaggctcaaattgatacattgcaaaaacaacttgattctattcagtctcaattatctactatgcaaagcacagcggatggactagctaatagtgatacttcctctgcagactaccaacgtgcatttacggccgctggtagtaatccacaggcttttcaagctagttatctcgggttagaacaacaatcaattgatattcaaaatcaaatttcaccattacaggcacaaattcaacattatcaagatctgagtgaacaataattttactagtgaataaaactgatcatttttttagttcgtattggtatataaaagtcttcacattaaaaaagattaagtcattatgcgatttcctgcaattttttacggcgttagttttcctgtagctatgatagctatcatcagtagtatgatttctttactgttgatagcctgcttttatgcttcaattaatgggccttagcctttatatccatttgtcttcaataaactttaggaagacttctggctatgattattgcttgtcaactttgaaataaagagttaagcgtgtttagtatgagtttattgaaatttgattctaatgaaaggacctatcattagaatgtctatcaaaaaagtgtcataactatcaaacaaatctgatagttatgacacttttttgcagaccgaattttaaacgatcaagttagcttgcctgcaaaggcccatattttttacggtgaaccttgatgaacattggttgattaagacgaggttattgggggattaaccactgcttttataagtcatgtgatgcgaatcatcaaaaaaacggaaatgacataacctgcgtggttatatcatttccgtttaaatttcgtttataactcagtatgccggctgcaggagttgaacctgtgaccctcggtttacgataccgatgctctaccagctgagctaagccggcgaaagattagacaaaaatgctaacgtcttgttagcaccataatcaatctccggcaggcgggctcgaaccgtcgacaacctgattaacagtcaggtgctctaccaactgagctatgccggaataattgcgtggcaacgtcctacccttgcagggggcgatcccccaactactcttgcggcccgctagtagagctttgaactttgtgtcggcattgggaacggtatatcttctagccatcatcaccaccctccctacgacatacttgtatgtgagaacttgcgctctcaaaactaaaataatatctacctttttcttaacagcctgttcacccgctgctctgtggttaagtcctcgaccgattagttctttggttccgcgtcccagtgcatcaactgcaacttccacttccaaccttctacctcccatcatctctgaggggtcttactcttccccgaagatgaagactggaaatctcattctcgagggcgagctcttcacacttagatgctttcagcgtttatctcatcacatacgtagctaccccgctatggctcctggcggaaacaacggtacaccgcggtatgttcccatcatccgggtccttctcgtactaagacagctcctctcaaattttcctgcgccgcgccggatagggacgcgaactgtccacgacgtttctgaacccagcttgcgtaccgctttaattgggcgacagcctaactcttgagtaccgacgacagccgccagctaatatacgatgaccgacaatcgctgtgtgccaaacctccccgtcgatcgtggactcttgggggagataaccgctatccccagggtactttttatccgtcttgagtcgagggcccttccaactgtaccaccggagcacgaagctccgctttcgtcccgctcgacctgtctgtccgcaggtcaaaggctccttgtgacctgtgtacatcctgcgaatgatttccaaccattctgagggtgaaccttggcgcctccgttacttttttttatgaggcgacctgccgccagtcaacactgcctacctgaacactgtctcccaccacgattagtggtgcgggttgagtggtcaaacacgaggggtagtatccgcactaatgccggttctcgccgaactagcttcccgcctctacggtctcctaccctattctgtacaatcggttacaaaacacactcaatatctgagactagcatgtaactccactggggtctgtccgtcctgtccgccggtaacctgctttccttcacaggttatcactatttcaccgagtctctcgtttgagtactgtgcccaatctgttacgccttgtcgtctgcggtgtcggaacacccttacctcacagagacgtttctctaccttaggaccgttatatagttacggccgccttactggggcttcaattctgagcttcgccgaagctacccatttttaaccttccagctccgggcaggccgtcagcccctatacttcatcttacgattttcagaaacctggatttttgataacagtcgcctgggaccgattcactgcggctgcactgacgtgcagcaccccttctccgaagttagcgggtggtcattttgccgagttcctctaacgagttttcactcctcacacttaggaaatttcttctcctcgacctaccctgtgttcggttttgcggtagcgggcgttaactattcagctagaagctttttctcggcacagtgtgacatctggcactcgctacttaaatttcgctccccatcacagcttgtttccgtataattaaagcattttcactctaatcagacttgctgcgtggccagtacctatccaacagtcgtggctttggcttagcctccttcctagctgtcccctccatcgtttcaacacacagttaacgggtacatgaatatcaacctgttatccatcgtctaacggcctcttcggcctcaaccttaggttcccgaactaccctggaggtccgagggccttcccagtaaacgctctattcccattttcggggggacaaggattctctacttgtcgtattcgctatcctcataccggcattctcacttccaagctgcttccaccagtcctcacgtctgatcctttccatgcccttagaacagctctcctagttcaacgcaagcctcttacggatgtccccaccgtttcgttcatattgcttaccctgtacattttcggcgcaggagtcactcgactagtgagtgctatcatacgcactcttttaaatgatgctgcttctgagccaacatcctagttgtctaagccacgccaatcttttaccacttgcatatatttgggccttataactggtgatactgggctgttcctgcttttgacatggatccttatccactcaccgtcctgactcccggacataaatcaatgcattcgggaggttatctgaattcgtaaccccaagacggcggcctctatccaaacgttgctctacctccagattcttattcccctagtagccctaaagcatttcggacgagaaccagcctatctccaagttctttggaatttccaccgctaccccacctcaccagccttttctacttacacggtttcggtcctccagtgcgtttttacctgcacctttcaactggacatgggtaggtcacctgtttcggttctacaacaacatactttcatacgccccatttcagactcgcttcgctacggctccggtttttccacctttaacctggctatgcaatcgtaactcgccggttcattcagtaccatagggcccgcgggtcacccattaaacgggctccactgttttgtaggctcatggtttcaggaactattttcactcccgcttccgggggtgcctttttcacctttccctcacggtactggttcactatcggtcactcgggatgtatgctagccccttgtgagtcatggtcctcccaggattcgacggtaaattctacactcatggtttcccgccgtactcattatcctgaactgagtagtaagccggtgtcggctatacgggattatcaccctctctgagatagcgttcccagctcatttcgatacctacgtcctactttgtgtaacctcaaatgttccagtcctagaaacactccaacaagctagcttcgttgggttgggtcttttcccgtttcgcctcgccgctactcagggaatctattttttttctttctcttcctgcatctacttagatgttttcagttcactgcgttctaccgtctgcttagctatgatttcactaagtagtaactaacgactaagcgtgttgtgggtttccccatttcggaagatctcggaatctagtgtaacttaccactcccgaagatcatatcggtgttagtcccgtccttcatcggctcctagtaccaagtctgcaccatgcgccctttataactataacctgcttttaccacgtcgtggtcgcacagataattgagttttagcgatgtaatgtaatcattcaaaaactcccataacgcggttgttctcggttgtttttctaaaaaaatcatttccgtatatattttaggtttcaagtacaagtcttatgaggcggtaacccctcaaaactaacaaatgtttcatgtgagaatcaaacgtgcacaggttctgcttttcattcctttagtaaaggaggtgctccatcgccggttctccactggctccttgcttacggacttcaccctaagcatctgtggccaccttacagcggtgcgggctcccgcagtaaaggggttggacccccccccgactttggggtgtttacaaactcttcatggtatgacggggcggttgtgtacaaggtccctggaacgtattcaccgcgcatgctgatccgtccgattcatctagcgatttctccgacttcgtgtactcggtgcgagtgctgctgccctacaggtcgaactgagaacggcttgtaagagattagcttaccgcgcgagtcgcaactctgttgtaccgtccccattgtagcacgtgtgtagcccaggtataataaaatgggctgatgatttgacgtccgtccccaccttcctccggttgtcaccggcagtccgcaccagagtgcccaactgatgctgtcaactgatactaagggtttgcgctcgttgcgggacttaaccgcaacatcttcaatcttcacggtaaccgagctttgactacaaccatgcatcacctgtcttagcgtcgtcccaagggaacgtcctcatctctgcctagattggcgctagatgctcaatgacctggtaaggttcttcgcgtgcttcgaattaaaccacatgcctccaccgtttgtgcgggccccgtcagtcctttagtttcaacccttttcggttcgactgtcccaaacatgcgtggaatgcttaatgcgtttagctgcaggcactgaagggcggaaacccctcctcaacattagctaattcatcgttttacggcaatgggactaaccagggtatgctcatcctttcgctacccatgctttcgacccatcgtctagttacaggatcccgacagccgcctccgccactggtgttcttccatatatctacgctttcgaccgtctacacctggagttccacgtccctcttctgcactaatttcccagtttccgatgcatttcttgtgcgttaagtccgaaggctttcctatcagactaaaaaaccgcgctgcgctcgctttatctcccaataaaatccggataacgcttgcctacacctaagtagtacctgcggctgctggcactaagtagccgtggctttctggttaaataccgtcactacctaagcagttgcactcttagaatacgttcttctttacaacagattttaacgaggccgaacccttcttcactcacgcggtgttgctccacaggcttgcgcccattgtggaagatttccctactgctgcctcccgtggagtattgggccgtgtctcagtctccattgtggccgatcaacctctcagtgtcggctatgtatcattgccgttggtaagccgattaccttaccaaccgctatctaatactccgtcctgcgggtccatccagaagtgatagctagacaataggcacatcttttggttcaaaatattccgacactatgtttttctatctattatgcgtcttagcatcctggtttgccaaatgtttatccccccacttctggcaggttacccacgtgttttactcacccgttccgccctcattccgatgttttatcatcggtgtcacgctccttcaattcagaaaacgggtcgacatgctgttacgacttgccaatgtattaggcacactccgcccagcgcttcaactcccgagctcaggactcacactctctataaaataagaaagtgtccttgtcgcctctttttttgatttgtctactttaccttatagggcgcattgacttcgctaaatgttccttggtcctttaaccctacgggtgcctaaagggtaccctatcacctaactagatttgtcgaaatttttttcagttttcaaaggtctaccatatgagtctgaatatcactcaagaacacatttaagatgttaccatgaataatgaatcatgcaagcccctttttcttactgaaaagcaacttgaattagttcaaaaacccatgtgtgttctagtaataacgaaatcataacctaacgttacgtcttggacgcaaaagatgataaactcatacctcgctatcttgtaattcctcgtcaacttaaactctaaatgctgtgatatatttgttttaacattcttacttaactgccaatcctcaatagccctgtgcatcagtagacactattaacggagaaaacaaagacggcggtgtaaaacaacacgtctcatttatttaatcattccgacgcattgaaatgtgaggtgaggagaggtaaaaggtgcattaaaaacaggaagaggtcattagactactactacactaagcgggtggtgtctcaacaagactatcggttaacagcatcgtcaaccgatcaatcccagcaacaacgacacacaccaaccacccgtgcaacaggtggcgataaaaaacacaaaaaaattccaagcccgataaaggggcctcatcattccttcagcttcatcattgaccgctgccttctttgacctgagcttcaaacggtccgcgttgagcaattggattcgttcaatgtcaagtaaaggccatttggcacattcattaccaatgattataaccaaaccgtcatgaaccgtaatccatcagcattttctttgccaatggtgaaattttcaaccgatgtccgtatacaaacgttggttgttcaagattatcttggcacaaacggtcaaaaattcattaataatattacccacctgccagtattcttcatactacaggtgttcatccgcaagcttc

SEQ ID NO: 437 - DNA, 124291 bp, Unknown
  Metagenome-assembled genome
aaagaccaacgagcgaaagcgctcgttggtcaataaaatactttacctaactaaattatactaattttttcggtatttgactaccgttaggttagtatgtccttttttaggttactttcttataaaatatagttttagcatgttttgaaaaggcgtgctgattgatgttcaacatgattcattgtgttttatgaagaactaccgggcttgttggtaattgaatgccctgcttattaagctcggatagatatgaagctaaaaagcgatgcgaaatttcagcttgagcgccattttttgttgtaatatttacctgaacaaccaacttgccatctggtaggtttattgtaccaatgattttcgggtctccgataatatctgaatatttggggacttcttgttgattgacttgattgatgacctcaatgactttgtcaattggcgtttcgggcaatataccaacttgaatcatggcagtcatgttattacgagacatattcgcaattgtcgtaattgtcctatttggaataaaattaagtgttccgtcatcgccaacaatttgtgttgtccttaatccaactgcagtaattgtgccgcgaatagtgttgatttgaacatactcgccaacctcaatttgtttttcaagaagaataaagaagccactcacaatgtccgtcacgaacccttgagcacctagtccaattgccaggctaaatacaccggcactcgcaactaacgtccccacaggtactcctaaggtggaaagcacggagtataaccagaagaaccatagaatgtaactcagcacgttaatagacaaggtatgaaatgttcgaattcttttttcagtgacggtatcttgatatttttttcggtatcgtttaaaaaagtgattaatgagcgatttgccgatctttcgaaaaatcagcattaaaatagtgaaaaaaactaagatacctattttttcactaatggtgacgagtagtttttgccaatcaataaaattaatatatttttgccagttaatggcaaagatcattatgctttttagttgcatttccgactttccatccttacattgaatctatttcattcatactatcaaaaaaacgctgtctgatacaagtctacacataaaatgtcgtgacagaataaacaattttattgtcaaagccctgctagaatgctattctaaagtaaatcgttgcacaaggaggaagaacatgacagctgggcaaatcgcagggcttatcgcagcaattgcattcttacttttagttatttttattggaatgttccttttaaaggtaagtcggacaatttctgaagttaattcatcgattcgttcaatgacaagtaatgtagatgttattgcgaaacagacggataagataatggcaacttccaatacgttagtaaaagatgttgatgaaaagttaaacattgttacgccggtatttcaagctgcagctgatttaggtgagagcgtttctgatttaaataaagcaactcataacctgacatcaaaagttaaagatacaggtaaaaaaggtgcaactgcaggcattgcaggaacagtcggacggacggcttggaatatgtttgctaaacatcgacaagctaaaaagaaccgatcttaacaattaatttgaaaagggatgtttgttatgggaaaaaaattagtaggcggtttatttgcaggattactaggagcaggattgtatgctgcttatcagaaaatggatgaaacgaaaaagaaccgtttaaagcgtgacttccgcgaaaaaacagatgaattacgagatcgagcagttgattatgcgttttatgcaaacgatgctgtaagtgattttaaagatgcttttaaggatgaattgaacagcacgaaagggaacgtaaaagatgcttcctctagctttgctgataaagcaaaatcatttaaaactgccaaagattctgatgggactgatgtttcagctgaggaaaaagccgatcaggatgacattattgtagatgccagggatgcgtttaatgattctgattattcaaaagcaaccgaatctgatactcaaaatgatgcgaatttaagcaatacagataaagagaaagacaatgaaactgaggatcactcaaattctcagccgaatcaagatcattcagataatcaatagcctttgaatcagaaaaggtaaaggaccaccgacgcacttatgtgtgagcggtggtccttctttagtgtctgatgttaaccaaaatactgtaattctttggttgtgtgtgtgaacggttcattgccattttccgtaatgtggatacaatcttcaatacgaacgcctgcaacatttggaatataaatccctggttcaattgagaaacacataccaggctgtagcactaattgatttccttccatgatcgaaggaaattcgtgttcactcatgcccattccatgacccaacctatgattgaaatagtcaccatagccggcctttgtaatgatgtcgcgagcaactttatccagttcttctgcagttattcccggttttgcggcctcttgagcagttaattgtgcttctaaacaaactttatagatatccatcgatttgtcatctggtttacctaccgcaatcgttctggttgcatcgctaatataaccatcccaaactgttccaagatcaaagaggaccagagcattgttttcgattttcttatctgaagtagcaccatgaggctcggctgcgtgagtgccggattgaataaggggtggaaagctcaattccatgataccgttcttcattagtgcataagacatttctgcggcgacgcgtgattcgggtctaccggcttttacggcctcaaaacaggttttgaatgcaaagtcatcccattttccagcaatttttaacttctcgatttcatctgcacttttaattattctcatttgatccagcatttgatcaagattaacagagaaatcaccggttggaaattcactctttaccagttcaagccattcaacagacatattagccttttcaattgcaaaatttgtttcggctgtattgcgggcatgaatttggtctgcaatcatttcccaaggcttttcatgatccaagtaaccgtaaaccggatttgaccatcctgattctttgatcgcttgcgtttcaagtgccggcccgaacaagaaagggtcagaattcttaaagacgaccagcagtaggactcgctcgttgggatcgctataaaaaccgcttaggtattgaatggttttaggatcgctgattaaagcaatatctctattattgtcagagagccagcgctgtatcttttcaattttatccatgtgtcagaacaactccttagtagattacaaacagtatagcatagataatttgctcgatttgtcataaatcaccgttttcacttgaattttcacagagggtagtttatgatttatttgaaaacgttttcagtttgccgtaatcgtttttatttggtatattgaatgatgttttgaaaatacgtgaaaacttattatatctcgatagaaagggctattaaaatggataaacaaacaattacaatttatgatgttgccagagaagctgatgtatctatggcaacggtttcaagagttgttaatggaaatgccaatgtaaagccggcaactcgaaaaaaagtgttagacgttattgaaaaattggattatcggccaaatgccgttgccagaggattggcaagtaaaaaaacaaccacggttggtgtgattgtgcctgatgtaaccaacatgtatttttcatcgttggcgcgaggaattgatgatgtagctactatgtacaaatacaacattattttaaccaactctgattcaaatagtgaaaaggaaattaaggttcttaatacacttttgtcaaaacaagttgacggaattgtgtttatgggtaatgaaattactgataaactgcgtgaggaatttaaacgaaccaagacaccgattgttcttgcaggttcagttgatgaacaaaacttgaagccaagtgttaatatcgattacgtggcagcagttcaagaagaagttaaaaatttgattgatcgcgggaataagcgagttgcgtttgtctgtgggccactcgagcaggcaattaatggtaaattccggcttgaagggtataaaaaagcgcttaaaagtgcgggaattccttatgatgacaaactggtctttgaaacggatgatacatacaagaccggaacgttgttgcaaccagctttaatgtcagttaacgcgacagctgcgatggtaactgatgacgaattagctgcaggaatcatgaatgggatgtctgatgccggtgttaaggtaccggataaatttgaaatcattacaagtaatgatacgaaattaacggaaatggttcggccaaagatgtcatcaattacgcaaccgctatatgatattggtgccgtcgctatgagactgctcacaaaactcatgaacaatgaagatgttgacgagaaaaacgtcttacttccttatgggcttatgaagcgcgaatcaacaaaatagatcatcgaccatacaacagataggagagtcatgatagttattagacggttagcttttctatattaagcagactctggatcaattgctgcccttttatttaggttttgttattggcgctgtaaagatttggattctttgcgttggcttgaaaccgttcttcgtatctggtaagatattgtcgtatgtttgaaactagctaataaattttagaaaagaggagtcattatgtcaggacattcaaaatggcataacattcagggacgtaaaaacgctcaggatgctaaacgtggaaagattttccaaaagatatcacgtgacttatatcaagccgctaaagcaggtgatcctgatccagaaaacaatcctcaattacggttggtaatggaaaaagctcgtgctgccaacatgccaaaagataacgttcaacgtgctattgataaggcttcgggacttggcggagctaaattcgaagaaatcacttatgaaggatacggtcctggtggaacagctatcatggtttctgctttaaccgataacaagaatcgtaccgctgctgctattcgttcagcatttacacatcatggcggttcattgggtgccagtggatccgtttcttatatgtttgatcgtaagggatatattgaggtcttacgtgacggcttggataaaagcgaagatgatatgttgatggatgcattagacgccggtgctgatgacatgaagacaacagatagtgaatttcaaatttttaccgatccttcatctctagccgctgtgcgtgatgagttgcaaaaaaagggttatgatttggacactgctgaagtacgaatgtttccagaaacaacaactgaagttcctggagataaaatttctcaatatagcggtttgatcgacgaacttgaaaataatgatgatgttcaagatgtttatgaagcagctgtattaccagaaaatagttaaacttaactaaattatttttaagatatttagtctaacgctaaatcaaaacagaaatgttttggtttagctttttttttcgaaaaaatttctgattgacctcgtatgtaattattgtgaggtgaaaaaatggaaattaatgaacaagttgccacattatataacacggcaattaactatcatgcgagtgatatctattttcttccagttaatgatcaatatgtgataaaaattcgaaattcggaatcattgatggattggaaaataatgtcggcagtaagagccaggagaatgatgaactattgtaaatacatggccgatatggcattaagcgaattacgtcggccacaaattggttcaatggattggcaggtagccgataggcaatattcgctgcgtttatcgtccgttggggatttttctggtgctgaatcgatggttgtcagaattatttatgatctggaagaaatcaagactgctttctttgatctggaagctttaaaaaaagtgagacaaatgacgagtcgtcgcggtctcgttattttctccggcccaaccggatctgggaagacaacgactatttataatctggtaaaccagacatcagcaggaaaaattgtgatgacaattgaagatccggttgaaattaaacaaccgaattatttacaactgcaagttaatcgggaagcggggatggcatattctgatcttattaaagttgggttgagacatcgtccggatgtctttatagttggtgaaattcgggacgagttaacagctaaagcggctataagagcagcacttagcggacatttagtctattctacaattcatgcgcaaagtccccgtggtgtggtcgatcgattatcgcaattaggtatcgacagaccgtttatctcccaggcattaacggccgtttgttatcaacggttgattccaacaatagacggtcaacaaaaagttttgttaaaaactcacacactccaggaattaatgaagacgaatacttatgattgggaggactggcaaaatggtcttgagcaggcaattgttaatcaacaaattactagaaaaactgccgaacaattttggtacggttaaacggtggccaatagcagttcaggctgattttttcagtacactggctaatttactgaaaattggtttctcactcacggcggcattgaaatttatttgtgaaaccgaccagcatttgaaatcagggacgaaacaaattattgatggattggaaacgggttcagatttttcaaaatgtgttcaaccgcttattagttctcaggcatatcagcaaatcctaatttctgaaaagcatggccaactacgagatgttttgaacgaattggcaacgttcaatcgactgaaacttaagcaaatcaaaaaaatcaaaaccgtcatgatttatcctgcatttctttgtatcattttgctaacgttgatcattgttattcatacttttgtattcccacaaattgaaacgttgctgccaagtgtttcaacggcgcaacctgaattgattgattttcatcttcttgaagtcatcggcctagctattggcactatattaatcattttaacgataggtttttttaagcaaccggttcttaagaaagctgagattgttgttaaaatcccatttttgggttccatttttaaacgttacattgcttattatttagccagcaacctggcaacacttttgagaaacggattaagcgttaaagaaatttattcggtcctttgtgcacagaaaactgattcgattatatatgcactaggtgagatgctaaacacatcccttacaaagggcaattcattgaaaaaaattgttgagacgcatcattttattccaaaagaaattgttaaattcctgaattcaggtgatacggttaccgagatggctaattcaatgactgcatattcaaaactgatgtttgacgagattctcttagcaactgataaattaattgcctttattcaaccgacgatgtttctcatgattggggtcacgattgtggcaacatattttcaattgttaattccgatatatgattcagtgaaaggactttattaaccgtgaaaaaaataacaaaagacatgacaaaccagacgcgatcaggattcactttaattgagatgacaattgttctttttattatctctcttctaattatgatagtaattcccaacctatccaatcagcgtaagcgcgctcaaacagtgcatacttctgcaatgcagtcaatggtgcaggcacaagtcgacgcatatcaaagccagcatcctgacgacgagcatgtttcatatgatgacttatcaaaagatggctatttaaccaaaaaacaagtatcacaagccagacacgaaggtataaaaatttcaaaaaatgatgacaggtagaaagggatttaccgtattggaattaatcatttacctcggcattgtctcgtgtgtgctattgattaacttggttttgatctcattcattaaaggcaaccatattgaaaatcgtttattctggcattcgtttcaggaatgctggacgcaagcccaacagacagccagagtgaatcattgcaagtatgaagtgatgattgaaactaaacctcaacaagttgtttttaaaccatatcatcaaaaaataaaaaagcaggtgcttaagtgcccaaacggattagtcccccacaatgcccgacacttatttattaattcaaacggatacgcttcgccgacaaccatttattggcaatcaaaatccggtaaagaaatctatttacaaaaaatacaattaggatggagtggctttagaattgaaaagaaaaactaaggacgggttcaccttaattgattcgttgattgggctcacaattatttctctgttcagccttttttatattggcattacccatcaaatgaatgatcagattgaccaaagtcagaaaacgttgaaagttgaacgaaagcattatgaggatttgttgaggaatgagtagaaaacatcgtcacggctatctgttagccgaaagcatgattagtctacttgtatgtgtttttgcaatctggacaattacgaccatgctggtttatgttggacgtgcttctaataatcagctgattaatttttattcatacattgatttactggaatccgatcattttaattttagggttgttaaagtatctaacaatgatgttattttatatagtccaaacactaagaagaagtatcacatgcagcaatataaaaatatgttgagattcacaggtgatcacctggggcatgttccgacgttagtaaatgtgggcagagtgtattgggacaaagaagaagggcggttaaacacagatgttaagtttgaaaatggtgaacattatcaagcgtattctaaactgccgagtgatcgccagtaatcatcaaaatggctctctgacagttgttgcgcttgtttttatcagcatgatgttggcgtgtcttatttttcagtgtgtttcttatcaaagaaacatcagtacaattgaatccatgacacaaacatatcgacagcgtcaaagaaaacttctaagcagacagaaagaaagcgtacctgtccaacagttcacaatcgctaatcattaattaatattctggtaaagtcacttgaattgttaaagccttttctggtagtatttagtagtattatagtaatttgtgaaaaggagttgagtgttctgacagaaggacaaatcgaacgcttctttagtgtacttaacgaaacaacagagattgttcaaaagcaaaaggatcaatcgtattttgattcgttgattgaagtgctggatactgttcaaagtaatgatgttaatgctctggacctgaccgatgaaaatgccaagaaggtttctcgtatttattccgagtttgatcgagacaagtatgattctgaaacccttcgtaaggcgattcagatggcaatactgaaggcaattcgagtagacaggattcaggccaattatcaaatcactccggacacaatagcaaatattgttgggtatattatttccggaatctttaatggtcaaaaacaactaagtatgcttgatccagcaatgggaacaggtaacttgttgacagctatctataatcaacttgataaaagcattcacgtcaaaccgtcaatttccggaattgaaaatgatgatgccatgtttgaactggcggccggttcttttgatattcagcacattcatgccgaattgttccatgaggatgcgatccaaaacgtactcgcaccagtagtagacatagctgtgagtgatttgccggttgggtattatccaatcgacgagaataccaaaggatttaacacgcgttcaaatgatggtcattcatacgttcatcatttattgatagaatttgccatggatcacgttaaaaaaggtggttatggatttttcctcgttccaagtcagattttcaagacgagtgaggccaagcaacttcttaagtggatgcagggtaatgtttatttacaaggtcttttgaatttaccaaccgaactttttcaaaataaagcgtctcaaaaggcgattatgattttgcagaattcaggtggaaatgctaaacaggcaagtccgattatgttgggagaatttccatcatttaaagatcaacctgcatttcaaaagtttttaactgaaattgatgattggcaaaagaaggatcttttacaataatatatagaggagtaatattacgatgggaaaatcgattgcaattaacgctggtagttccacattaaagtacaaattgttccaaatgcctgaagaaacggttttatcaagtggtgccattgaccgaatcggtcttggttcttcatctgtttcaattaaatatgatgatggtaaaaagtataaagatacccttgatattgataatcatgaacaagcaattcaattggttctggacaaattattaagcttaaatattattaaagactacagtgaaattactggtgttggtcaccgaatcgttgctggtggtgaagattttaaggactcagtgattattgatgatgatgttatcaaaaaaattgaaggtttaactgaattcgcaccacttcatgaacctgcagctattcttggcattaaggcgtttaagaagattttaccaaatattattagtatcgcagtttttgatacttctttccatacgacactgcctgaagtgaattatatgtacagcctaccttacgaatactatcaaaactataaagttcgtaagtatggtgctcatggaaccagctacagatacgtttcccagcgtgctgcatctattcttggcaaacctttggaagatcttaagcttgttattttgcatttgggtgccggagcttctattgatgccattaaggatggcaaatcttttgatacatcgatgggattttcaccagttgcaggaattacaatggcaacacgttcgggtgatgttgatccatctgcacttcagtatgtgatgggcaaagccggtattaaaaatatggatgacatggtagacattttaaatcataagtccggtttagtaggtgtttcgggtgtttcagccgatatgcgtgaaattgaaggtgtcatgcatgaaaatcatcgtgcaatgttggcacgtgaaatctttaaaaatcggattattcgttatatcggaagttatgttgctgaaatgggtggcattgatgcattagtgtttactgccggtattggcgaaaacgatattatgattcgtcaagaggtctcagacaagcttggttactttggaatcaaggtcgatcctaagaagaatgatattcgtggtgaagaaagagatctttctgctgaagggtctaccgttaagacactcttgattccaactgatgaagagttaatgattgtccgtgatattgaaagattgcgtaagtaattaatttctatccacgaacgtaaaaataaatacatttttagtacactgaaagtatttactcaagttttgtttaatctaatcaattttgtggaggctgaatgcaaaacagtttgttttgtttcggcctctttgtttgaagtatttgattgattcttattttaacttgaaaagaaggaggcgctttttttggagagtcaaaatgacgatcatcagttttcacgaggtcttaaaaaccgtcatgtgcaattaattgctcttggtggaacgattggaaccgggctttttctaggtgctggtcaatcgattcatcttgcggggccatcgataattcttgcttatttattagcggggtttgcgtgctttttactaatgcgagcgctgggggaattacttttatcggatctcagcggtaattcgtttgtattttttataaaaaaatatttgggagataaggcgggattcgtcattggctggacgtattggacgtgttggatttccatagctatggcggatttaaccgctacgggattatatgttcagttttggttcccgaagattccagtctggttaaccggattggttgtactaacgatcttgttcttagtaaatatcattgctgtttctgcttttggagaaaccgaattttggctttcgattattaaaatcgctgctattgttgctttgattattattgggattgttttggtacttgtccattacaagaccccattcggacatgccgagttaagtaatattgtaagcggtgggttctttgcaaacggatcatctgggtttgtcctttcgtttcaaatggttctgtttggttttgccggtattgaaatgattggtatgaccgcttcggaaacacaagatcccgaagtaacaattcccaaaagtattaatgaagtaccaacgcgagtattacttttttatgttggatcactattagctttaatgagtattttcccgtggcagcacgtttcaccaacctccagtccgtttgtacaggtcttttccggaattggaattcgttctgcagcaaccattatcaattttgttgtgttgacagcttccatttcggcatgtaatagttcaatctttacaaccggtagaatgatgttttcattaacatacagtgggaagtccaaatttcacaaaacagttggtaaattatctcgacggcaaattccatttaatgcaattctattttcaacctgcgtcatcgcattaattgttgttctaagtattttaatgcctggaaatgtttttagttttatttcgagtgttacaacgacttgtttcttgttcgtttgggggatgattgttctagctcatttgcgctaccgcaaagtaatcaaagcgggaaggcattcagataaattaacatttaaaatgccactctatccattttcggattattttgtcttagcgttcctgattttcgttggcattgtcctacttttgaagacagatacgctgattgcgttaattggatcattactttggttactgatcttgttcgttggtaaatcagttacaaataaggttgaatcagaaaattaatcattgaataatgatgaaggttgggaccaaaacgattttgttcccagtcttcattattttcgttataatagcgggaaaagattaagtagcggtgttattatggttaaagtaactatcgcgtctgaaagaagaatgttaaatgcaattttttacggccgacactcatttttttcatgaaagattacttggaattagtgaatttgcgccccgaccttttttaacagttgaagatatgaatgatacgattattgaaaattggaataggcgagttggtaaggatgatgttgtttaccacttgggagatattgcaattcttcatactcgaccggaaaaggacgcttatcaacgcatttttgaagttttaaaaaaactaaatggcaggcttattttaattaaaggaaatcatgattcgagaaacttatttaaatatcttgaaaaacataattatttagtagggaaccatttaaaatttgaattccatgatgttggcgtcctaattaaaatgaatcaccgtcagtattatatgacgcactatcctatgatgatggggattgtcaaacaaattattaatcttcatggtcatattcatcactactcggtgccaattaaagagaatattaacgttggtgtagatacaccggaggctgattatttaaaacataaacccccatttggtacgcccttttcacagcaggaaatagaggaaatggtggcgcaaaaacaaatcgattttgcaaaacgacaatgataggtggtctcatgacggaaaaaataacaatcttgcatacaaatgatctgcattcgcattttgaaaattggccacgaattcgcagatatattttagaaaccaggaataaattattacttgaaaagaattcatcagttattaccgtagatttaggcgatgctgtggatcgcgtccatcctctaactgaggtcacaaatggacaagcaaatgttgaactactgaatcaaattcattacgatgcagtcacaattggaaataacgaagggcttaccaatacacacgaacagttgaatcaactttataatgatgcaaattttgacgtcattcttggcaatatactggatatgaaaaccaagttaatgccaaaatggtctcaaccggcaaaaatcatcacaactcctaaaaaaacacgtatcttgattttaggtttgacagctccttatttgctaacataccctattttaggatggcgcccaattgaaccggaaaagatacttccaaaacttttaaaaaggtatgctgggcaatatgatattgtcgttctactctctcatttagggctcccagaggatcaattactggcaagaaagtttcccgaactaaatgtcattatcggctctcacacgcatcatttgttagtccacggccagcgtgtcaacacatctctattggcagctgctgaaaagtggggacattatattggtcagataacgcttacggtcgatcattcgcatcaaattactgacagtgatgcaatggtggtcaaaaccagtacgcttcctgagcttcctgaagatcaagaagagattgaaggctatgaagagaccggtgaaaaattattagccagaaacaaattagctagaattaaggcaccaatgacgacaagcctgactggaaactcacgattagtaaatgaagggttacatgcaattatggagaaggcaaatacgtcagctggtattttaagctccggactatttcttcgtgatcttccaaagggaattgtagatagaaatgaattgcatcaaatgcttcctcatgcaatgcatgttatgagagtgactttaggtggttatgacctttggagattaattaaagaaatggaaaagaatcggaacttcttaattaaatttcctcaaaaaggcatgggctttcgggggaaggtatttggcgagcttcattatagcggtttgagatatgattcggataccggtagactattttatcgtgaagaactggtttccccaattaaaaaatatcaaattgcaatgcccgatcattatttattcattccattttttccaacattagaaattgtgggtcataacgaaattttgtatgatgaaaacctaagggatgtctttggtgattatatggctaaacactatcctattaacggatgaaaggaggaccagtatggaccgtaaacagcttgatgttttaattgcacaacaggatgaaaaacgtcatccgcttgcacagattcagcgtgattcggaaaccgaattcagcattaataatcatcaatatgaagttgagttgaattctcaaaatggttttcaatttgaagagtttgttcgtcgatacaatccggctttaagccaatttgatttcattgttggcgactggggttatggccagctacgtctcaaggggttttataatgacgacagagaggttgtcaccggcccgtttatttctgcactcaatgattatttgcttgaagacattaattttggtgcggcttattttgtcgttcataatcttgaagcccgaccgatcgtccataaatcaagaagtacacgtagtcgtcatcgctcgagtcggggacggtctcgtaataatcgtcggaatagtcgcaaccatgcatttgttgaacaaaaagtagcacccgtaaagccccctcttcagaagagaaagaatttgattgttaaaactgaggaaaaatctcataaacatcactttattattcgtgaaagtaaaaattaattgtcgaagggataaaagaatgaaacactacaaaggctattttatcgatcttgatggaacggtttatgcaggaaaaaagcgaattcctgccgccaaacgttttattgaacgactacaagcaaaaaaaataccatttctttttgtaacaaataattcgacacaattgccgcgagacgtcgtcaaaaatttagacgaaaatcatgatatccatgttaagccggaaaatgtttatacatctggaatggcaactgtagattttatgaatgatgataagaaaatagttgccccgtcggtttacattgttggcgaaattggtctaaagcaggttattttagcaaataactttcgcttagaatctgatcatcctgattatgttgtcgttggattggattcggatttaacctatgagaagctgtcagaagctgttttggcgattcgaagtggatctaagttcattggtaccaatcccgatacaaacatccctaaagaacgcggtatgatgcctggtgcaggctctgttgtaaagtttgttgaatacgcgacccaacaacaaccgattatgatcggaaaacccaaagccagaattattgaaagtgccttgaaaaaaattggattgagtcaagatgaagtcgtgatggtaggggataactataatacagacattaaggccggtataaatgccaacgtagatacactgttggtatatacagggctctccaccaaggagcaggttcgttcagaatcaattttaccgacctatcaaatcgacagtttagatgaatggcggccttagtttgaaactaacaatgcaacaaatcgggtacgcacttatcatattattgggatgtttatcatttgcgatctttttgacaattaattcggtttggctctttgacctgaacattcatgcattacacttatcagctgcaaccggcatgtccgccgaaaggatgcacgaagaatacttgcgaatgattaattatattcaaaaccctttaactaattcattgaactttaaatattttatcagctcgccaaatggccttcagcattttaaagatgtgagacatttagttatttttaataatgttatggcagttatttttgttccggtgtcatttgtacttgtacggcggttaaataaaaaatcactaacgtggatgcttttaacaccgataaaaacggtggtcatcttttcgttagtgattgtttcaattatgattgtcaatttcgaacaggtatttatttattttcatgagctattgtttcgaaatagtgattggattttcgacccggatctggacccagttattaatatgctgccggatacattcttttttgaatgttttaccttattttttattgtgtttttggcattacacttatggttatatattttggccaaaaaatcactcagatcggatcctccattaaaatccacaagatcaggtaagcaataaagccggggaacagaggagtaaatgcgagtaacagaaaaacaattctcgcaagtagtggatcccagtcatatttttcgcttaatccaccaataacgccggcaatgactcgatgctccttggagcgatggatatgaattttcatctgataatcctccttcgagttgattaataaaatcttaacttaaccatacctgaatagaaaacagatttcaattatgatacactactatgttagataatcgaataagtgggagagttatatgttaactttaaatattaatgcaaatttaggaaatcaagaagtcgttctttcggataattcatatgggcaactgtcagggattcgagtgtttggttccccaacaggtggttcgcaggttattcaatggacattcacctcaaccggtcataagcacgaaggtttcgtattcgcaggcaatttgaccgagggattggttattgattcgataactgggaaagatcagtataaaattcactttgttattgaatagaatgatcgttacaaagatgctgcttgatacataatgagacgaagatactctgcttgatgtttgaaaagccgtatcttggtctcattcttttataaaggagttttttggatgacagtagggattgataaaatcggtttttacacatcaccatattttattgatatggttgatctagcccatgcacggaatgaagatccaaggaaatatttaattggtattgggcaaaaaaagcaagccgttataccgtcaactcaagatgttgtgacaatggcggctaatgctgcccaaaagattttgagtgagggcgataaagaaaaaattgatttggtaattttcggaaccgagacaggtattgataattcaaaatctgccgctatttatgtccagtcgttacttggaatttctaaacaggcgcgatcttttgaaattaaacaagcatgttatggtggcacagctggtgttcaaatggcagtggatcatattcgtttacaccctgaaagtaaggcgttggtactggctgctgacattgctagatatggtctgaatacgcctggagaagttactcagggtggtggggctgttgcaatggtgatttcttcgaacccacgaatcctagaagtggaagacaaaagatcgtttcactctgataacattatggatttttggcggcctctttatcgccatgatgctgtcgttgatggtcattattcaaatagtatttatgttgatttttttcaacaaacttggacggattaccggcaaaaataccatagaacaattgatgattttcgagcattaacttttcatctcccgtatacgaaaatgggcttgaaggcgcttcgctcaattattgatcaaagtaaacatccagaggctatattagaacaatttgaagcctctagaatgtataatgcgcttgtggggaatctttatactggttctctatatttaagtttaatttctttattgtcaaactcggaagcgctgaatcaagatgatctgattggtcttttcagttatggttcaggagctcagggagaattttatagtggccgattaagtgatcaatttgatagatcgcaattaaaaactgatatggatacgatactatctgagcgatctcgaatcacaattgagcaatatcaagaaatgtatcaaacctttttaccactcaatgaagaagacaaattgtttgatgtctcttcggataatagttgctttgttctaaaaggacgcaaagagaatagaagaatatacttgaccaaaaatggatcgggagatgatcagtccttggactaatcaaagtgaatcaaattcagagaaaaaataagtcaattagattgaaagatttctctggcagtctatgtgagtgctaaaaaagagccaagacacattgtatcttgaactcttttgaagtggctaaactattagtcgatgtcatttctatatagactaacgaccttgcctaagatgctaaccttagtcagaataataggcgccattgtatcattctctggttgaagcctgaaatgatcactttctttaaagaatcgcttgcaggtcgcttcattttcatcagtcatagcaataacaatatcgccattgtcggcgtaagcttgcttacgaaccacgacatagtcgccatttagaatgcctgcattaatcatactttcgccacgaatttgtaacataaacagggtctggtcatcctgcgcaagttgtggtggtaacgggaaataatcagttgcgtcttctacagcgagaataggttcgccagcggtgacagttcctaagattggaatctgtttttgcttaggtgcaatgcccaacagttccatccctgcagccgtgacttcaagtgctcttggctttgaggggtccttaacaatataaccctttttttgtaaccgattgatatgaccatgaactgttgatgttgaagaaagattaaccgcttcgccaatctctctaacggttggcggataacccttatcattaactttttcccaaatatagtgtaaaatcttgtattgcttactttcagaattctttgccattttccgacacctcataagttactttaattgttgttttaatcgtatcataagtttgaatagatttcaaacacacgttcgtgtaattttaactttttttgttataatagtcttattggaggaatatctatgaatgaaaaagagaaaaaagagctacaatcaaaaatcggtgataacgttttaaaggaaatcgttccccgtattaatgaattagcacacaaagcaaagaatgaaggattaacagaagttgaaaaaattgaacgagctgaactacgtaaaaagtatgttgctcgttttcgagaaaactttaagagccaaattgagttaatgaaagtttatgataaaagtggcaaagaaatcacttcaaaaaaggtgaaaaacattcaacgtcataagggacttcgagacgactaaccattaataatgacttttttagctcattttacaattaggcttttattttctttaagaattgtgtaaaattaaccaatgagactatataaggaggccttgttttggcaacttggatttggattctaattgttattgtggccttggtcattggtttaattggtggtttttacggtgctcgtaaatatatggaaaagtacttgaaagaaaatccgccatttaacgaagatcaattgcgtcaattaatgttacagatgggtcaaaaaccttctcaaaagaagttgaatcagatgatgcatacaatgcaaagcaatatgggtaagaaatagcattatcttagtcaacaataaagaggccattcaaagaattttgacttggcctcttttttgatatcatcaatgttcatagatgattaattattcaattttgtcggttgtatttttctttgaaatgtcaacgtatttgaaatcgggattgacggcgtaatctaaagcatcaaaagcggtttgcatctgctgttcaacttctttttgatagttgtcatccagcttgtgtttccggtcgatataaattggttcaccaaaagcaattgtgactttttttcggctgaataaccgtttaaagcttaatggtccctgataaacggttggaaccagtggtacattcgccaattgtgaaatgagtgctgcgccactttttaattgctctgaatggcgagtcccggatggaaaaaggataagcgataaatctgatttttttaaaattctgacgggttttttaattgctgaggggccgggatggtcccggtccactggaaaagcgttggcgtgatccagaatccattttaaaatcggatttttgaaaagttctttttttgccataaaactaaatttttttggactggctgctagtgcaaaataaatcggatcaaaccatgtccggtggggcccaactaaaatataattccctttgggcaggcgttccttatattgataatgcgcatttccattaataataaatacaaaaatacgcacaagcacacggacaaatgaataaaacaatcccattccttctttcttaatctgataaaataatagtaacttaaacgagaagcgtttggcaaacaaatttgtgaaaggttcaaaaaataatgcgagtgaaattaaaaaagaatgaacgaattgatcaattatatagtaataatgtttccattattcaaagcaacgacgttttttcgttttcattagatgctgttttattagcagaatttgcacaggttggaagcaaacgggttaaaaatatcattgatttgtgttctggtaatggtgcagttggcctgtttttaagcagtgaaacatctgctcaaatcaccatggttgaaattcaggaaaagctcgccgatatggcagcaagaagtattcagttaaatcatttggagaatcaggtacatgttgttaatgatgatttaaaaaataccactcattatatttccaaagattcagttgacgtgattgtttgtaatccaccttactttgtcaattatgaaactagtgaaaaaaatccaaatcagtatttggctattgcacggcacgaaattaaaacgacgattgatgaaatcactaaaatttcagcagacttgctaaaaacgaacgctaagttatttgtggtttaccgtcccgatagactcacagatctcctactgagtttacggaatcatcatttggagcctaaaatattacaatttgttcggtctaaaacgacctcggaagcaaatatggtgttagtagaagcaattaaaagcggcaaaccgaatggattgagaattcaagaagatttaattactcatgaaggtaatgactattcagacaaagtgaagcgaattttatatggggaaacaaattaaaaaatattatatatatgttttactgtgtgaagaccgtactttatatacaggctttacaacgaatgttgaaaagcgttttcaaactcacaaactgggaaggggtgctaaatatacgcgatcacatcgaccaattaaaatactatttcaaaagcaattcccaactaagcatgatgctttaagtgcagaatatgcgtttaaacaattaacaagaaagcagaaattgcaatacattaataacccggactcgtttttataaatatcagtgaaaaaatgcacaaactttctaattttcagcaaaaacaacatataaaagtgttataatacaagtaacatgtttaggaggtaatattcttgaaaattattgcttatggcattcgtgacgatgaaaaaccatatttagataagtggagtgaagaaaaccctgatgtagaagttgcatcgactggtgaactgttagacgagtcaacagttgatcaagcaaagggtgccgatggtgtggtaacataccaacaaaagccttacactgctgctgttctagacaaactaggcgaatttggtatcaagttcctttcattacgtaacgttggtgttgataatattgatgctgatgctgcaaaacgcaacggtattcaagttaccaatgtaccagcatattcaccagaagcaatcgctgaatttacagttactcaattaatgagattgttacgtcgaacaaatactttcgatcgtaaacaagctaatggtgaccttcgttgggcaccagacattgctgaagaattgaaccaattaactgttggcgtttttgccactggtcgaattggtcgtgctgcaatgcgtatttataaagggttcggtgctaaggttatcgcttatgatatcttccataatccagaattggaaaaggaaggtgtctatgtcgactcacctgacgaactttatgctcaatcagatgtcctttcaattcatgcacctgcaactaaagaaaatgaacatatgttaaatgatgaagccttcagtaagatgaaggacggtgtttatatcttaaacccagctcgtggtgctttagttgatactgatgcacttattagagcacttgattccggaaaagtcgccggtgctgctcttgatgtatatgaaaatgaagttggtattttcaataccgactttggtagttttgataaaattcctgatgaacgattaaaaggacttatgaaacgagaaaacgttctagttagtccccatattgccttctatactaagcgtgctgttcgtaacatggtttactttgcgatggatgctaataagtcacttatctcaacaggtaagtctgacaagttggttaagctttaaaggatcaaataatctgtttaataaaagggattttcaacggtttatagttgaaaatccctttttaatgcaaaaattgttggaaattaaaaaggtgaaaaaacggctgggttaaacctcagccgctaattctaataataattcttggagttgttcgctgttattgacagtttgatctggaatgatatttgggtcaataatcgacccatcatgattgttgtaccaaacggtttgccaaccagcccttttagcaggcacaatatcgtttaaatatgaactacctacatacatcatctcattaccgcgaagttcgaattttcggttcattagcgtaaaaatcattggatcgggttttttagcattggcgtcctcggaagtaataatactttccctgtcaaaccagtgttgaagatttaatctagtgatttttgaaagttgattttcagtcgatccattagtaataatgccaagtttaaatttttcaatcagtttattaaaaacgtgagttaacccgtcaaataattgaatgtcctgactaaatttgctgtaaagttgccaaaagtcttctgccttcttttgtgtaaggccatcaagattaaattctttaaaagaatgatggagacaatgaaagctaatgtctgtttttgaaagttgaaattgattatccagattattttttgctacaactaattgttcctgctgaacatagttggagaaaattttatttatcaaattgctatcaacatcatttgagaatatttgtttgaaagcttcattaaatgatggtttctgatcgtacaaagtatcgtcaacgtcaaaaacgatggctttaatcatatagattcctcctcgtcacgattaatcattttaacacgttttacaaaagtttaacaattttcttaatatttttaacagcaaaatcatgttatcacttgctttcgcagtcaattttagctatactcttataggtgttttaattacacactcgatgtgatgccattggtgttgctacaattatgtagttccaataacagatgatcatcggggaggaaaaaactttaatggaggctactatattatggctgtaatttctatgaaacaattgttggaagccggagttcatttcggtcaccaaacccgtcgttggaatccaaagatgaaacagtacatctttactgaacgaaacgggatttacatcattgatttgcaaaaaactgttaaattaattgatgttgcttataacttcatgaaagaggaagcttcaaagggtgctgttgttttgtttgttggtactaagaaacaggcacaagattcaattgctgaagaagctacccgtgctggtcaatattatgttaacaatcgttggcttggcggaacgcttactaattggaataccattcaatcacgtgtaaagcgtcttaaagatcttaagaagatggcgactgatgggacatttgatgttcttcctaagaaggaagtttcattattaatgaagcaacgtgataagcttgaaagatttttgggtggtatcgaggatatgcctaaactcccagatgttttgtttatcgttgaccctcgtaaagaacaaattgctgttcacgaagctcaaaagctaaatatcccaatcgttgcaatggttgatacaaatactgatcctgaccaaattgatgttgttattccttcaaacgatgatgctattcgtgccgttcgattgattacgtcaacaatggctaatgcaatcattgaaggccgtcagggtgaagatgaagttaacgaagatactttcgaaaacggatcaaagactgacaagaaagattcaaaagaggattcaattgaagatattgctaatgctgtagaaggcaagagcgatactgataataagtaatagcacttaggctgactctatcgctatagacctatttggccttggtgaagagtcagtttttatgtaaagaattaaggaggccactaaaatggcaaaaatttctgcatcacaagttatgcaactacgtaagaagaccggtgttggtatgatggatgccaagaaggcacttgttgcaactgaaggcgattttgataaggcgatcgaagtattacgtgaaaaaggggttgccaaggctgaaaagaaaagtgaccgtgttgccgcaaatggtttagcaactgttgctgtaaaggataacacagctgcaatcatcgaagttaactccgagactgactttgttgcttcaagtgatccgtttaaagccgctgtttctcgaatcagtgacgctattgtagctaataagcctgccgacgttgatgctgctttagcactttcgactgaaaaaggtacaattaaagatgatttagtggaaacaactcaggtaactggtgagaaagttagtttacgtcgatttgaaattgttgaaaaaaatgatgaccaagtctttggttcatacttacacaatggcggtctaatcgcttctcttgttgaacttaaaggtgcggatgaagcaactgcaaaagacgttgcaatgcacgttgctgccactaatccagagtacctaaatcaatctgaagttccggcagagcggttagcccatgagaaggaaattttaactcaggaagccttaaatgaaggcaaacctgagaagattgttgaaaaaatggttgaaggtcgtcttcacaagttcttggcagaaatttgcttggaagatcaagagttcgttaaagaccctgatcaaacagttgcacaatacgttgcttccaagaacggttcaatcgttaaatttgttcgctatgaagtcggcgaaggcatcgaaaaaaagcaagaaagctttgaagatgaagttcgcgatcaattaggtaattaattttttatgaagggctggaacaacgagatacatttgttccagccctttttttcggctttaaaaaatttgacactattttatagacttttgacactattttatagactttagttttgaaaagctgttaagaattactgaatttgttagttttattgttgtagctaacttgagtatgctaaaattgatgttaatgattaactatgggaggcactttgatgtccaaagtaaaatataaccgaattattttaaaattaagcggtgaagctttagccggtgatagagggttcggaattaatccaccggtaattaaagacgttgccaaagaaatcaaggatattttcgaaatgggtgttcaaattggcattgtcgttggcggtggaaatatgtggcgaggcgaagctggtgccgagatgggaatggaacgtgcccaagccgattacatcggtatgttaggaacgacgatgaacggtcttgcacttcaagataatttggaatcacttgatgtcccaacacgtgtacaaacttcaattgagatgcgtcagattgctgaaccttatattcgtcgaaaagctgttcgtcatttggaaaaaggccgggttgttatcttcgcgggtggaactgggaatccatatttttcaacagacacaactgcggctctacgggcagcggaaattggcgcagatgcaattttgatggccaaaaatggtgtcgatggcatttatactgctgatccgcgaacacacaaagatgctaagaagtatgagactctcacatatatggacattttagaaaaagggcttaaggtaatggactcaacagcgagttcgttatctatggataatcatattccgctggttgtctttaatttaaataagccgggaaacattcggaaagttgtatctggagatagtattggaacaactgtgaaggagaaatagaaatggcagacacgcaaacagttttaaatgaagcaaaaactaaaatgaaaaaggcacaggaagtgctggagcatgagttgggaagtattcgtgccggccgcgctaatgcaagcctattaagtggtgtaacggtggattattatggtgcgccaacacccttaaaccagattgcttcaatttcaattcctgaagccagagttatcctaattacgccatatgataaatcttctttggacaatatcgaaaaggggatatatgaagctgatttgggacttagtcctgcaaatgatggaacggctattcgtttggcaattccagcgttaaccgaagaacgtcgaaaggaagttgctaagcaagtaaaggcaactggtgaaaagagtaaagttgctgttcggaatgttcgtcgcgaagcaatggatactttcaaacgcggtaataaaagtgaagaaatcacggatgatgagctacaccgccttgaagatcaagttcaaaagttaactgataattcaattaaaagtgttgataaaatcgttgctgataaagaaaacgaagtcatgaatggctagaaagtgggttcaataatggcagataacaataacaataataatgatgaggtttctgtagtacctggtacaccggagtttgataagatgttattcaagctcaataaaccagtcactgaagataatttaggtgatttagattataacgggagtcgtttacagcctgttcaagatgacttgtatgcaatgccggcatttgtgacagatgattttaatttattctttattgtgtcacagttggtagaagaagattgggtgatcgctttctcaaatgcaaccattgagaaaggccatgaaatcactgatttatcagaaccgatgacaacaggtaaaggtctcaatgaactaggtcaaaagagcccatcagatgctaatcaattgttgaagtactttaatactttagcagaggcaaatcgcggtgaatggcgaatggttgaacgtccggatagtgcagaagactaacaattaagtgcattttaggatgagtttttcttctcatcctttattttttcctgaattgtttagaggagagttcaatgtttaataataaaaagaacgcaaaatcatctattcacttggactccgatagaattcccaagcatatcgcaatcattatggatggtaatgggcgttgggcaaaaaaaagacatttgccacgaatcgcaggccatagacagggaatggagaccgttaaaaccgttacaatggctgcaagtaaattaggtgtaaaggttttgactttatatgcattttcaactgagaattggaaacggccaaaggatgaagttagttttttgatgggactgccagttaaattttttaataattttgttcctgaattaatagaaaataatgttaaagtttcagtaatgggtcttattgatcagttacctgagaacacacaaaaagcggttcgggatgcaatttctcaaaccagtaaatgtactggtatgatcttaaattttgctctaaactatggcagtagacttgatatccggttggcagtgcaaaatattgcaagcgaaatcaaaaatgatgcgatttctatttctgatattgatgatgatttgatttcccgccatttgatgactggatttttaggcgattacgctgatcctgacctattaattcgaacaagtggtgaagaacgcatttcaaatttcttgctctggcagattgcttacagtgaattggtttttaccgatgcactttggccagattttgatggtcagacgctgcggcagatgatttttgaataccagcatcgaaatcggcgatttggcggtttgaaaaatgaataacagggggcaaatttaagtgaaacaacgtgtaataactgcggttgtcgcgctgattatctttattccgataattattttgggtggcttatggattgacatcgccgctttggttttgggaattgtcgcagtttcagaaatcttagttatgaaaaaaaggattttggtatctggtgagtcgattatcgcgtatttaggtgttagtgcactgatattaccggacagttggacgggctttttacccaataactttaaccagacatttatctttttcctttttgttttaatgttattattagtgactgtcctaagcagaaacttgttcacttttgacgatgcaggtgtcattgtgcttgggatgctgtatattggaatgggttttcattatttcattgcagccagagcagagtcattaccagtgttattgtacgcactgtttattgtgtgggtaactgatagtggtgcttatatttttggacgactgtttggtaagcataagttggcacctcgaattagtcctaacaagacttgggaagggtcaatctgtggctcaattgcagcgacaattttatgctcaacttttattttcttctatccaattcctggttattcaatgattgaaatgattatgattacgattttcctttcaattgccgggcaatttggagacttaattgaatcagcgctcaaaagatactatgacgttaaagattcaggcaagattcttccagggcatggtggaatcttagatagattcgatagtttgttacttgtattaccaatgctgcatttagttggtattatttaatttttgattaggaggaaagtgccgcttgataactacaattatagttttcatcattgtctttggtattttggttatctttcacgagttcggtcactatattatggccaagcgttcaggaatattagttcgtgaattttctgttggaatggggccaaaagttttctttcatcgaagtggcagtacgactttcacattaaggctattacctcttggtggatatgttcgaatggcgggtgaagttgatgatggtgaggaagaattaaaacccggaacacctgttacattacaattaaatgatcaaggcgttgtaactcgaattaatacgagcaacaagcattcgctgtttcagggaatccctttaaccgttacaggaactgacttagcgcatgatttatatataaaaggatatgaaaacggcgacgaatctgacgttaaaaaatatcccgttgatcatgatgctatcattattgaaagtgatggtactgaactacagattgcaccggaggatgttcaattccaagctgccccgcttggcaaacgaatgttaactaattttgccggggtttttaataactttatcctggctattcttgtatatacaatcttgggatttgttcaaggtggcgttcagtcgaataccaataaaattaacgtgatgccttcggactctgttgcgcgtcaagccggcgttaaatccggtgaccgaattctatctatcaatgggcataagacagcggattgggaccaattggccgttcaaattcaatcgaatccgggcaagaaggtaaccgcggaaatttccagagatggtcaaaataagagtattcaaatgacacctaaatccaatacacaaggcggcaaaaagattggaatgattggtatcacccagtcacttgatactagttttaaagcaaaggtcttatctggattcacacaaacctggacaatgacaaagacgttattgggcgctttgtggtcaatggtaagtggtcacttcagtctaaatgatcttggaggccctgtggccatatttgcgactacttcgcaagctgcatcgctagggatttcaggtgttcttaatttcttggcttggttatcgttaaaccttgcgattattaacttaattccaatccccggtcttgatggcggtaaattagtgctcaatattattgaagcaattagaaggaagccggtttctcaaagaacagaaacagtcgttacgttgattggttttgcatttttgatgatactaatgattttagttacttggaatgatattgaacgttatttcctgcactaaagcgtaagaaattggtcttatgggccaaatacacagaaggatgacataaaggagaaattattggattatgaagcagtctaaaattttagttccgacgttaaaggaaacgcccaagggtgctgaagcccttagtcataaaatgttagttcgagccggatatatcaagcaaatttctgcaggtatgtatgcttatttgccacttgcatatcgcgttctgacaaaaattgaaactattgttcgacaagaaatggaaaagacctctgctcatgaaatgttgatgccggatgttcttcctgctgaattatggaaagaatcgggacgttatgagacatacggaccagaactattcaaattcaagaatcgacatgatactgattttattttgggacccactcacgaagaaacctttactgaactgattcgggattcaattaaatcatataaacaattaccattggtcctttaccaaattcaaaacaaataccgtgatgaggatcgcccacgatacgggctgttaagaagccgagaattcattatgaaagatgcgtactcatttgcggctaatgaagcggatcttgatgatgcttatcgtgccatggaaaaagcttatcgcactatttttgatagaattggacttaagtatcgtgtgattatcggtgatggtggtgctatggggggatctgattccaaagagttttccgctatggctgcagttggtgaagatacaattgtctattcagatgaaagtgattactttgcaaatctggaaatggcaaaatcgaaggccactgatgagccatcaacagaagcagaggccgatctaaaaaaagtcgcaacacctaatgttaagtcaattgatgaagtagctgactttcttggtgtttctactaagaaaacaattaaatcgatgctttatattgctgatgagaaacctgtcttggttttagttcgtggtgattacgatgttaatgatgtaaagttaaaaaattacttaaaagcagatttccttgaccttgcaactgatgaacaagccgtcaaatttttaaaggctgattttggatctttgggtccagttggagttagcgatgacgttcgcattttagctgatacacgggttggcaatatgaaaaatgctgtcgttggtgccgatgaggatggttaccactatgttaatgccaacttgaatcgagattttcgcattgatgctgttgatgattttgttgttgttaaggaaggcgaactgtcaccggacggtaagggcaaactaaaattcacacgcggcattgaaattggtcatatttttaaacttggtacaaggtattctaaaagcctaaatgccaatgttttagatgaaaatggccgatcaattcctgttatcatgggttcttacggaattggtatcagtcgattactttcagcaatttccgagcaaaatgcggatgaaaatggtttggtttggccagttgcggttgcaccatatactgttcatgtcattccaatcaacgttaaaaaagaagttcaaatgaatttggcaaatcagattgaagaacagctaaccgaaaatggcatagaagtccttgttgatgaccgtaaggaacgaccaggtgtaaagtttgcagactctgatctattgggtattccattaagaattacggttggaaaaaaagccgatgaaggaattgttgaaatcaagattcgaaaaaacggtgaaacagtcgaaagtaaagttgaagaactgagcgatactgttaaaatcctgttaaagaatctaaattagttttatactggtaaagtatttttgtaggatttaagatgattggttttagagaaggtgagatcgaaagttgtttttgttctcagcttctttttgcactaaatgaggagggtgctctttgagtttggatcaaaatgctttatttgaaaagttgttggagcagcttcaatgggaagaggcgaaaagctcgcctttctttcagggcgcaaaaattgaccgtttagaggttcatgaacaaagtcttcggtggcaatttgatgtttctgttccccgaattttgccttttgaggtatttaacgattttaacgcccgtttacagtcttcttttcaagagattgcgaaagtatcactgaatattacaccggctaacgatcacttcaacgaacaattgttacgacaatattggcaatggatagttgttaatagtggtgtaacatctcccttaattcaggaactttgtgaggaccgagctccttcaattgttgattcaagagtcgaatttatggccgaaaatgaaattgtcaagaatttcatgactaatacggcacttggaccaattgaagaaatgtatcaaaaagccggctttcccaatttcacaattcacacaattgttgacgaaacgtcttctcaaaagaatattgaagcacttaagaaaaaaaatgaagttcaaaatgcggaattagtcaaaaaagccaatgctgcgattaaagaaaatgccaaaaaacgagcaaaccacccaggagccacctcaggctctgccatcataggtaagaaaataagtggcgatgcgccaattatgaagatggaagatatcattgaggaagagcgttcggcggttgtttcgggatatgtttttaacaaagaagtcagatccttaagatcaggtcgacagttgctaatgttaaagatcactgactatacatcatcaattcaagttaaaaagttttctaatcgtggtgaagaagccttatttgatgaaatcaatgaaggcgattgggtgaaagtccgtgggagtatacaagaagataattattctcatgagctaaccttaaatgcctatgatattaatcctgttaaaaaaattagtcgaaaagatacggctcctgaaggagaaaaaagagttgaattacatttgcacacatcgatgagtcaaatggatgcaactaataatattgctgattatgcaaagcaggcaaaggcatggggtcatccggcactggcaatcacagatcatgcagccgttcaaggtttccctgatgcgtttcatgccggtcaaaagaatgatcttaaaatgctatacggtgtcgaaattaatttggtagatgatggcgtacctatcacttataatgataaacatattcctttaaaagatgcgacttacgtggtatttgatactgagacgaccggtctttcagctatttatgatcgagtgattgaattatcagccgtcaaaatgaaaaatagcaacgttatcgatcaatttgaagagtttatcgatccgggattccatctttcagaacagacaacaaatttaacctcgatcacggatgaaatggttcatggttcaaaatccgaagaagaagtattcaagctgtttagagacttttgtgaagatgcaatcgttgttggtcataatgtaacgtttgatattgggtttatgaacaccggctatgttcgtcatgggatgccagaaataaagaatccaattattgatacattgacactggcacgtttcctatatcccaatatgcggggatatcggttaaatacattagccaagaaatttgatgtgaatcttgagcatcaccatcgagcaatttatgatgctgagacaaccggacatttgaactatttatttttaaaagatgcagaagatcggtatggcattgtctatcatgatgagttaaatgatcacatgactgaaaatgatgcttacaagcatgcccgtccctcgcatgcggtcattatcgctaaaaatcaagttggtttgaaaaacatgttcaaaattgtctccctttctaacgttgattatttctttagggttcccagagtaccacgtacacaattagagaagtttcgcgaaggtattattgttgggtccgcttgctcttcaggcgaggttttcaccgcaatgatgcaaaaaggaatggatgaagcccgaaaaaaggcggggttttatgattacttggaagttcaacctaaacgggcgtatgcaccgctaattgaaagccatctcatttccgatgaggcaaatcttgaagaaattttaactaatattgttaaattaggtgatgagttaaagaagccagtcgttgcaacaggcgatgttcattatcttaatccgcaagattacatttatcgtaaaattttgatcaactctcaaggtggtgccaacccgcttaaccgtcaagaattaccagatctacactttttaactacaaatgaaatgttggatgattttgcgttcttaggtgcagaaaaggctaaggaaattgttgtcacaaataccaatcggattgccgatgatatagatgatgttcatcccctaaaggatcgtctctatacgccaaaaatggaaggctcagaagatgaaattaaagagcgaaccatgacgacagcacaccaatggtatggagatcccttgcctaagattgttgacgaccggttgacgacagagcttaaaagtattattgggaatggattctcagttatttatttgattgctcaacgattggttgcgaaaagtaacaaagacggttacttggttggatctcgtggatcagttgggtctagtctggtagcaacattaactggaatcaccgaagttaacccgttgccaccacactatcgatgtcctaattgccaacacacagagttctttacgaagggtgaatatagctcaggatatgacctgccaagaaaaaaatgccccgaatgtggtactcagatgatcggggacggtcataatattccattcgaaactttcttgggatttactggaaataaggttcctgatattgatttgaacttttctggcgattatcaaccaattgcccataactatacgaaggttttatttggtgaaaaaaatgtatttcgtgccggaacaattggaacggtcgcagataaaacagcatatggttatgtgaaagcctatgaacgtgataaaggtacaacttatagacaagcagaggaagacagactagcaaagggtgctacaggtgttaaacgaactaccgggcaacatcctgccggcatcattgttgttcctgctgatatggatatctatgattttacgccaattcaatatcctgctgatgatcagactgctgcttggaagacaacccattttgatttccattctattcatgataatattttaaaaattgatattcttgggcatgatgatccgactatgattcggatgcttcaagatctatcgggaattaatccaaaatcaattccaatggatgatccaggtgtgatgtcgatcttttcaagtccaaagattttaggcgtttctgaagaacaaattcaatcaaaaaccggtacattgggtgtgccggaatttggaacccgatttgttcgaggaatgcttgaacaaactcacccaagcaattattccgaacttcttcaaatatccggtctgtctcatggaaccgatgtttggcttggaaatgctgatgagttaattaagaatggtacagccactattgcaaacgtgattggatgccgtgacaacattatgacggatttaattcaatggggattagattctgaattgtcgtttcaaattatggaaagtgttcgtcatggacgtggtatacctgatgattggcaagaagaaatgcgtaaagcgaagatcccagagtggtatattgattcttgcttaaaaattaagtacatgttcccaagagcccacgcagcggcatatatcttgatggcattgaggattgcttactttaaggtttactttccattaatttactatgctgcctatttctcggttcgtgccgatgattttgatattgtttcaatgtgtcgtggtaaagatgctgttaagaatgccatgaaacagattaacgataaaggcatggaagcttcaaccaaggaaaagaatttgttaacagttcttgaactggctaatgaaatgttggaacgcggttatgtctttaaaatggtagatctaaagaaatcagctgccaatcagtggttgattgatggcaataacctcattgcaccatttaattctgtgccagggttgggacttaacgttgctaaacaaatcgtagctgctcgggaagacaaaccgttcatttcaaaagaggatttatcaaaacgcggtaaggtttcaaaaacgttgattgattttatgaccgaaaaccatgttttggatggattaccagatgaaaatcaattgagtttatttgacatgatgtaaacgaatcaacttattatcggttgtctaagtcatgtaggacgattatcgagtatgggttgcaattcaacagtattggtcacgataaaccatttgtataaacaaagaacgtatgttatactgtatttactaaataacttgtaaggagtgagcagaaatgctcgctctttttaatggataattttaggaggcctattttttgagcaatgtcgttgaaacggtcaaacaagttgtgaagccgattttagataaacatactttttatttatttgatgttgaatttgttaaagaaaataaaagttggtatttacgtgtgtatattgataaaaaaggtggcatcacaattgatgactgcgttttggtaagtgacgaactgagtgaaaaactcgatgaaatggatccagaccccattccgcagcaatattttttggaagtttcttctccgggcgctgaacgtcccttaagaaatgatgaagagcttcagcaagcagtgggagaatatattcatatttccttgtaccaaaatttgaatggacagaaagcttttgaaggatttcttcgttctgtaacttcagatgaacttgttttgcaaaatgacaagtggggcaagaatgataccataaacattccaagaaacctgattgccaaatcacgacttgcaatccaattttaggtaaaggagacttaataatgagtaaagaacttttaggagctttgtcagctcttgaagaagagaagggaatcaaaaaagaggtcgttatcgaggccatgcaggcggctttggtttctgcatataagcgaaactatggtcaagcacaaaacgttgaagtttcttttgatggaaccaaaggcgaaatgcatgtgtattctgttaaaaccgttgttgaaaccgtgactgatgatcagatgcaggtttcattggatgatgctttacagattaataaagggtacgaaataggggatgacattaaattcgaagtgacccctaaaaactttggacgaattgctgctcaaacagcaaagcaagtgattatgcaacgggttcgcgaagctgaacgtgaaaatatttttgatgaatattcaaaatatgaagacgatttagtgacagggactgttgagcgtcaggatactcgttttgtctatattaatttggataaagtcgaagctgttatgggccctcgtgatcagatgcctaatgaggtttatcgccctcaagaacgtataaaagtttatgttacaagggttgaaaacgcaaccaagggaccccaagtttttgtcagccgaacagatccagggatgcttaaacggctctttgaacaagaagttcctgagatttatgatggaacagttgagattgtgtcgattgctcgtgaggcgggggatcgtgcaaaagttgctgttcgatctaataattcggatattgatcctgtcggaactgctgttggtcctaaaggccagcgagttcagacaattgttaacgaactgcatggtgaaaatatggatattgttgagtgggacgaggatgatgcacgatacattgctaatgcattaaatcctgccgaagttatcgacgttatttttgacgatgataacgatcgtgcctgcaccgtgattgtccctgattatcagttgtcactggccattggcaaacgtggtcaaaatgctcgtttagctgcaaaattgactggttttaagattgatatcaaatctgaaacggaagctaaagagttccttgctgaaagaaagcaaaaagcacagcaggtggaaaacgaagatgaaggtacaacagatgaatcagaaactgctgaaccggaccaagagacttctgacgacactctcggcgagtctgttgacactgacagtcaagaagttcaaactgaatccgatgaggatgttgaagcagatgctcaagatgatcaatcagataatgttgaaaaacaaagtgagcatatagatgatgccgattcttctgatcatacagaagatacttcatcggatgagaacccatcttcaaatcaagattaactcttaggaggcgatcattatgaaaaaaagaaaaatcccaatgcgtaaagatatcgtcactggcgaaatggctcccaaaaaggagttggtgagaatcgttcgtgactccgagggcaacgtttcaatagatgaaacaggaaaaaagtcaggccggggtgcttatatctctattaatgtagatattgccaaaaaggctaaagaagagcatgtgttcgaaaaagtattttcaactcaaattgacggtgacttttacgatgatctgatcgcgtatgttgatcataagcaggctcgaaaagagttgtttgagaatggaaaataatcaagcaatccttaattttctcggaattgccaagcgagcaaacaagattgtatccggtgagaatacgcttttatctgaaataagaaacggaaaggtccatttcttatttattgcatcggataccggaccgtctacaagcaagaaatttcttgataagtcaaattactatcacgtatctgtcaatacaatgtacactaaagaggtattaagtaacgctatcggaatgaaaagaaccattatcggaattaaagaccagggaatttcaaaaaaaatgattgaattaacaaataggataaagggagagtgattatatggggaaaaagcgaatttatgaattagccaaagaactcaacatctccagtaaaaaaattatcgatgaggccagcaaacgtggtgttgctgtgaaaaaccatatgtcaacagttgatgcaaatcaagaaaaacaaattcgacaattattcaaaaaaaatggtacttcagatagaacacaaaacagtcaaagcagccattcatcggtaagtaatggtcgtcatacaactcaatccgatcgccatagccataatgcccagcagggtcaacgttcggaacgttcaaatcaaactaatcattctcagggtgaaagtcggagccaacgtgccaataatcattcagagaataaaaatagttcttctcaaggaaaacgagagacaacccataatagtgctggtaccaatcgtcaaagcagtcaaaataatcatagtaacaatcgtagtcgcactcaacgaaataatgattctggtacgcgctccaataatacacagtctagaactaataatactgcacacactagttcagcgactaatacaagcaacagtaatagcaccagtcgtcagagtcgcccaagtaccaataatgcaaatcatcgcaatactggcagtggccggtttggcggtagcttaaatcgccgtaataatagtggtggttcgagaaaagctaataaaaaacgcaataagaagcagcgtaagcaacaaaaccaacgacttcgtcaagtcgagcatcacggggctccagaacgaaaagcacgtccgttaccaacggttcttgagtacgaagatggtatgaatgcacaagatcttggtaaaattatgcatcgtgagccggctgaaattgttaagaagttgttcatgttaggtgttatggttaaccagaaccagtctttggataaagatacaattgaaattctggctgctgattatgggattgaagccaaagaaaagattcatgaggatttatccaaccttgatgaaatctttgaaaaagaaatgaagaatgcaaagcatttagtttcacgtccaccagttgtcacaatcatggggcacgttgatcatggtaagacaactttgctggatcatttgcgtcattctcatattactgccggtgaagctggtggcattacccaggcaattggtgcttatcaagtccgtcatggcgataacatcattacattccttgatacacctggtcatgcggccttcactgaaatgagagctcgtggtgctaatatcactgatatcacagttttagtggttgcagctgatgacggtgtcatgccccaaacaatcgaggcgattaaccatgcccgtgcagccgaaacaccgattattgtcgcaattaataaaattgataaacccgatgctaatcctgaacatgtaacggaacagttgagtaaatacaatttaatccccgaagactggggtggcgacaccatttttgttgatatttcggctaaatttggtaagaatatcgacgaattgctcgacatgatcattcttgaatcggaaatgcttgaattaaaagcagatcctgatcaacctgctgttggttccgttattgaagcccgtcttgatcaaggacagggacctgtcgcaacgttacttgttcaacaaggaacgttgaaagtcggggatcctattgttgttggcaacacatttggacgagtgagaacaatgactaacgaacgtggtcgagatcttaaaaaagtgacaccatcaatgccggtatcaattaccggattgaacgatgttcctgaagcaggagatcgattcgttgtcttttcagatgaaaaaactgcacgttctgttggtgaagaacgagctgaagaagcacagattcaagaacgtcgaaagaccaaccgggttacgcttgataacttgtttgattcccttgaagaaggtgaaatgaaggaagttgatatcgtcatcaaggctgatgttcaaggatctgttgaagctttggcaaacagtcttaagaaaattgaggtaaagggtgttaaagtcaacatcatccattctggtgttggtgccatcaacgaaagcgatgttgctttagctgaagcaagtaacgcgattattattggatttaacgttcgtccaacacctcaagccaagtcacaagcagatagtgatcatgttgatattcgtctccatcaagttatttacaatgcaattgatgaagttgaatcagccatgaagggtatgcttgcaccaacttataaggaagaagttacaggtgaagtagaagttcgtgagatttacaaagcttccaaagttggtactattgccggtggtatggttgttgacggtgttgttaacaaagacagtaaagttcgtttaatccgtgacggtgtcgttgtttatactggagaattaaatagtttgaaacgttttaaagatgatgttaaccaggttaaacaaggattcgaactcggtcttacaattaaagattataatgacatcaaggttggcgatgttattgaagcctatattatgaaagaagttccagttaagtagtttaactaaatgattttttggcaataaaagttgttattttatattaaatgtttggaggtgtatttatatggctcattatcgtgttggtcgtttagagcaggaaatccagcgtgaggtaaatgatattttactaaaacgagttcgggacccaagagttcagggcgtcacattgacgggtgttgaggtaactggtgatttacagcaagccaccatttattacagcattctttctgatgacaaggctgatgaggaaaccactgcaaagggacttgaaaaggctaccggattgattcgtggtgaacttggctcgcgtttaagcatttataaaacaccggaaatcaagtttgaattggatacttctgttcagtatggtgacaaaatcgatcgtctcattaataaattaaagcgtgaagattaataaatttgatttttgacaaagactgcttcagctactaatggctgggcagtttttttgtgatatacttttagtaactgaattttttaggagaagccgatggatggagtaattgcattatacaaagaacgtggtatgacgagtcatgattgtattagtcgactacggaaaattttacacacaaaaaaaattgggcatactggcacacttgatcctaatgttgacggtgttttgcctatatgtattggacaagcaactaaaattagtgaactgttaatgggatccggtaaggtttatcgtggttcaatcacgctgggaatggcttatgatacagaagacctggatggacatttaattgctaccaaggcaatcgaaagaccattatcttctgaacaaatcgatggtttgttacaaaaattaacgggtcatattatgcaggtgccaccaatgtattcagccgttaaaatcaacggtcataaactttatgaatatgctcgaagaggcgaagttattcatcgagagccacgtccaatttttattcaatctttcaaacagacaaaagtatcaagttttgatgaaaaaaaccagactcaaacaatcttttttgaggttgcctgttcaaaaggaacgtatgtcagaacattagctgtcgattttggaaaactgataaacacaccatctgtgatgtcatcacttacccgaatcaaaagcggtggttttgatatttcgcagtgtgtcacgttggaacaagttgacaaagccgcaggcagtgatacactgtctgacattattgagccattatcaaccgctctttccgattatcctgcttatcagcttgatgacagtcgttggaaaataatatcaaatggcggttttttggatcaaagtattttacctgaccgcgaacctattgttagattggtttatcagggagaaacaaaagcactctatcaattcgatgaacccaaaagagtttatcgaccttttaagatgttcttgaaaaataattaacgaggagaaactgcaagatggatattactaagcttcattatcctctcgatgatgattgccaatttaaggataaaacagtgattgctatgggattttttgatggttttcataaaggtcaccaagctgttttacagcgggcaaaagaagaagctcaaaagcatggtaccaaattggttgtattaacgtatgatcatcatccggcacttgtttataaaaaaatgtcgtcacatgaaaaacgatatattacactgctggactataagcttaagctgtttaaagaatttggcgttgacgaggtattactggttaactattcttatcaatttcaaagccaatcacctcaagagttcattcagcactttttaagccgttttaaccccatagctgtggttgcaggatttgaccatacttatggcggcgaaccagcagataacatggtgaacttgccaaagtacgtcaatggcgcatttaaagttatcacagtgccggcactcaagcaaaacaatcaaaaagtgagttctactcaaattcgcaataatttggataatgggcatattgaaaaggttaatcaattgttgggtcgtcccttccagaccgaaggtgtgattgttcacggtgaggagcgcggtcggttattgggctatccaactgctaatgttgagcattcggagtatcaatggcttccaacgattggcatttatattgtcactgttgaaattggcaggaaaaagtatctggggatggcatcgataggtaagaatgtgacattttctgataatggtccaatgactgttgaaattaatttgatcgactttcatcaaaatatttacggtgaagtcgttagagtcaattggctgtcacatgggcggggagaaattaaatttaaaaccgctgacgatttagttgagcaacttgatagagatgagcaggatactcgccattatctatcggaacatccagatatcttaaattagcactattagcactcaaacgaatttattgctaaaaatcgttgataatcccttgacttataacacatggtttgttaaattataaatgtgccttagcactcgaatactatgagtgctaaaaagaggtgatgttagtgctgacggataggcaaaaagatattcttaaaataatcattcgagattatacgaggacgggaatgccagttggttccaaggcattagcttcagaatttccgacccatgttagctccgcaacggttagaaatgatatggctgcacttgaatcaaagggcttaatcacaaaaacacatttttcatctggaagggttccatccatgcaaggttatcgttattatgttgacaatcttgttcaaccggatccgctggatgatagtgcagaagatttaatcaaaagttcttttaacattgagtttaaccgaattgacgaaatcattcaggaatctgcaaaggtgttatccgatttaacaagttatatggcagtcactttcaatcctgaaccaggaaataatttaaaattgggtggctttcgacttgttaaactggatgatcgacaggtaatggcaattatcgttactaatactggtcatgtggttgataagattttccgattaacgaatgtttcttcggaacagctggaaaccattgttaacattatcaattcagagttagttggcaaacctatttctcaggttgccgataaattaagaattgatattccaatgttaatgacgaagtatattcagacaccccagggatttttgaagatatttggtgaaatgcttagtgaagctggtcgagacaaggttcatgtcgacggtaaacttaacttattaaagtttgcggaacgtcaaaacattgacaggttgaagcctctatacaatcttttggacaccgaagatactgttcaaaaaattattaatcctgattcccacgatgttcaagttcgaattggaagcgagctaagaaacgatttgttaaaagattatagtattatcactgggacctatgatttaaatgagtatggacacggtgttatcgctgttattggaccaaccaggatgccttactcaaagattattggaatcgttggtgcattaagagaagaactaaccaaaaagcttttagggtactatgatgataactaattttaaggaggcgattgtttggcagataaaaaggatgattcattaaaatcaaatgagccagcagacgatttggcttctaagaatgatcatgggcacgaaaaaaaagttcaagatgcaaaggcagcaaaaaaatccgatttttctaaaactgaaaagcatgattcagcagacgaagttgtcaagttaaagcagactgtagttaatttgcaaaaaaaacttgatgatatggaaaaccggtatttaagggccgaagctgatataaaaaacattcaaactcatgctaagaaggaacaggctgatttgattaagtatgatggtcagcaactggcacatgatattttgccgatcgttgataaccttcaacgcgcacttgcagttgaagcaaccgacgagaatggtaaacaattaaaaaagggcgtttcaatggtattcgagcatttaactaaggcactgtctgataatggtgttgaggaaattgatgcattgaacaaaccgttcgatcccaaacttcaacaagcgattcaaacgacgactgctgatgagaagcatccggccgataccgtggcgcaggttctgcaaagtggttaccgattaaaagatcgggttcttcgaccagcaatggttgtcgtcgcaaaataaatctttaaagaaaaagaggattatttatggcaagtaataaaattatcggtattgatttaggaacaacaaactctgccgttgctgtattggaaggcaacgaacctaagattattccaaacccggaaggttcacgtacaacaccatctgtcgtggcatttaaagatggcaaaccttctgttggtgaagttgcaaaacgtcaagaaattacaaatccaaatactgttcactccattaagagtcatatgggtgaaccgggctatacagttgatgttgatggcaagaagtatacgccacaacaaatttcagcaatgattcttcaatatattaaagattttgctgaggattacattggtgataaagttgaaaatgctgttattactgttccagcttatttcaacgatgctcagcgtcaagcaactaaagatgctggtaaaattgcaggtttaactgttaagcgaatcattaacgaacctactgctgcagctttggcatatggtcttgataagcaagataaagatgaaaaagtgcttgtttacgatttgggtggtggtacttttgatgtttccatccttgaattgggcgatggtgtctttcaagttctttccacaaatggtgatacccatcttggtggagatgactttgatcaacgcgtaatggattggttaattgacggatttaagaaagaaaacggtgttgacctttcaaaggataagatggctcttcaacgtttaaaggatgctgctgaaaaggccaaaaaagatctttccggtgtcactgaatctgaaatcagcttgccatttatttcagctggtgagaacggacctttgcatttgcaaacaactttgaccagagctaaattcaatgaattaacttctgacttggttgcaaaaacaaagacaccgtttgacaatgctttaaaagatgccggtttgcaagtttcagacattgatcaagttattttaaatggtggatcaactcgaatccctgctgttcaagaagcagttaagtcatggacaggtaaggattccaatcattcaatcaaccctgatgaagcagttgctttaggtgctgctgtccaaggcggtgtcattactggtgatgttaaagacgttgttttacttgacgttacgccattgtcacttggtattgaaaccatgggtggtgtcttcaccaagttaattgatcgtaataccactattccaacttccaagtcacaagttttctcaactgctgctgataatcaaccagccgttgacattcacgtattgcagggtgaacgtccaatggcagcagatgataaaacacttggtcaatttcaattaactgatattccagctgctccaagaggtgttcctcaaattgaagtcacatttgatatcgataaaaacggtattgttaatgtatctgccaaggataagggcacaggcaagcaacagaagattaccattaaagattcctcaggactttccgatgacgaaattaaaaagatgatgaatgaagccaaggaaaatgaggaagctgataagaagcgtaaggaaacagttgacttgaataatgaagttgaccaattgatcttccagactgataagacgcttaaagaagttaagggcaaggtctcagatgatgaaatcaaaaaggctgaagatgctcgtgacgcactgaaaaaagcaaaggaagacaacaatgttgatgatatgaaagctaagaaagatgatttgaataagatcgttcaagacttggcagtaaaattgtatcaacaacaagctcctaaagatggtcaaggccaatcaactgatggtcaacaacagggtaataccggatcatctaatggtgattcatctgacaaaggtaacgatgatggaacagtcaatggtgacttccatgaagttcacaatgacgatgataaaaagtaatctttagaatcgtattagaacaaaagtcaaggccagctggctttggctttttgttaaaatatggtattctatcaaagtatagatttgattgaagatgggagtttctaatggcaaataaagattattatgatatcctcggggtttcgaaagatgccagtgacgatgagatcaaacatgcctaccgtaaattatcaaaaaaatggcatccagatattaacaaagctccggatgcagaagcaaaatttaaagaaattaatgaagcatatgagacactaagtgatccacaaaaacgtgccaattatgatcagtacggttctgctgacggagccgctggtggttttggcggtggagccggagcaggcggctttggtaattttgattcaagcggttttggctttgatgatatttttagccaattttttggtaatcgtcaacaaagtgccgatccttctgcgccaagacaaggacgtgatcttcaataccaaatgactatggaatttgaagatgctatttttggtaagacaacgcgaattaaatacaatcgtgaagcacaatgtcacacttgtggtggtaccggtgcaaaaccaggcacatctcctgtgacatgttctcgttgtggtggtcgaggctttattgtaaccgagactaacacacctcttggaaggatgcagtctcgacaaacttgtccggtttgtcatggtactggtaaagaaattaaggaaaaatgtccaacttgtggtggtagtggccatgttgatgaacgccatgaaattgaagttaaggttccagctggaattgatgatggccaacaaatgaggttacaaggacaaggggaagccgggacaaacggcggaccttacggtgacctatacattgttttccgagtcaaaccaagcaaaattttcactcgagacgggtcaacgatttacgtcgatcaacagattagctttgcccgggctgcacttggcggtaagatcaaggttaaaactgttcatggtgatgttgagctcaaagttcctgcaggtactcaaaccgggactacattccgtctaaagggaaaaggtgcgccaagattgcgtgggaatggaacaggtgacgaacgtgtgactgttacagttacgacacctaaatccttaaacaaagagcagaagattgcgatggaagcattcgcaaaagccagtggtgaaaacattggtggtaagggtgcaagtaatttttttgacaaagtaaaggacgcttttgataagaaataatgatggacataactgattatttcattaagcgtttattaatcaaataatatgtgaagggactgttggtaaacatgcaaactttgccgcagtcctttctttgtgattatcataaatattggcagaaagcttaaatttgttgcgacattccttctttttcactaaactagaggggataagatattttttagacaatgaaagtgagaaaacaacatggatttgaaaaaaatgaaggaacatcaaaaatatattcgcaatttttccatcgttgctcacatcgaccatgggaagtcgacacttgctgatcgaattcttgagatgaccgatacagttgcaaaaagggatatgaaaaatcaattgttggacaacatggacctggaacgtgaacgtggaattacgattaagctgaatgcggttgaattgacctatcatgctaaggatggccatgattacgaatttcatttaatcgataccccgggacacgttgatttttcatatgaagtatctcgaagtttggcagcttgtgaaggagctgtattagtagtcgatgcggcacaaggagtcgaggcacaaactttggctaacgtttatttagcaattgatgatgatctggagattgtccccgttatcaataaaattgatttaccatccgcagaaccggaaaaggtccgtaaagaaattgagaatgtcattggcatcgatgcatctgatgctgttcttgcaagtgcaaaaaaaggaattggaattgaagatcttttggaacagattgtgcataagattcccgctccaagtggcgatgttaacggtccactgaaagctttggtttttgattctgtttatgacgattatcgtggcgttgttttgagtgtccgattatttgaggggacagtgcagccaggcgataaaattaaaatgatgaatagcggtagtgaatatgaagtgaccgaagttggtgttaattctcccaatcccgttaaacgagactatttgatgtccggtgatgttggttatattacggcaagcattaaggatattacaacgactcgtgttggtgatacggtgacgaatgcgaatgacccagcagaaaaagaattaccgggatatcgtgaaatgcatccaatggtttatgctggactttatccaactgataatgcaaagttcgacgatttgagagaagcacttgagaagttaaaacttaatgatgctgcgcttgaatttgaacctgaagtatcgcaagctttgggctttggcttccgttgtggtttcttgggtctgcttcacatggatgtggtgcaggagcggttggaacgtgaatttaatcttgatctcattaccaccgcaccatcggttacctatgaagcaaagttaacggatgatactgttaaagaggttgaaaacccatcagaaatgcctgatagctcatcaataaaacagatctcagagccttacgtaaaagcgactattatggttccaaatgattacgtaggtgccgttatggagctatgtcagcatcgtcgaggcattttcgataccatggagtatcttgacgattatagggtcaacgtggtttatcacatgccgctttctgaaatcatttttgatttctttgacaaacttaaatccggcacacatggttatgcatctttagactatgaagttgaagattaccgtgcaagtgacctggtaaaaattgatattcttttgaatggtgagaaagttgatgcattaagttttatttcacatcgacaatttgcggcaacccgtgccagggatatcgtcggcaggttgaagaatatcatcccgcgacaaaactttgaaattccggttcaagcagctattggtgccaagattattgccaggaccaatatcaaagcttatcgaaaggatgtcacagctaagctctatggtggtgacagaaccagacgaatgaagttacttgaaaaacagaaagccggtaagaagagaatgaaggctgtgggaaaagttgatatcccgcaggaagcattcatggcggttcttcaaaccgatgaggaagaaaagggcgataaataagggctttggttcataaaacgcataccaaagtgtatcgaattatttggcaggcctttattgcactcttcgtttaacagatattagaattgagattcaattgcgaaagttcaccttgtattgtgtgggggtgaacttttttggataagccatatccgggctttacaatgagcattttttaacacactaccaaaagggacgacgctgatttttgtgtatatttaaattggtagcggctattcttcgtttgaaaacagacgcttttagctcctcaaaataaaagatcatgatttaagtcttcattacaagacataaaatcatgatcaacatttaaatgaaacaggaaacttaaaactgatcagaataatgaatgggtctaaaaggtgagttttggatcttgttttgccaatcgatcataaattttttgaagttttctgatctctgccgcatcgtctaaaatatcatcaaatagttgttcaataacggctgtcattgcacgattatcatcgactatctgatcctttcgatcttcggtttcttgagcttcatacaactcttggagtaaatttgttaatcgatgacgaaaatacgaaagtttcggatcattatcattctttttcagcaagtgtgcgaggcgataatcgaaataccgttccaacttttcggcagttcctaatgaaaggttattgatggaccggctatgatttcttaatcgcagaataattgaagaattcacgccagtcagttgttcaatcttatatgcactcgcgttgctgtctagaacagccttaattttttctgataagttcattttttgccccctcggatgagttaattaaggatagcgccttattaaatttaccccttcagaacgtttaatgagataatgttttttaaattttaatctttctttaattttagtatatgctaattttcaataacctgtcaaagaattagatttcaattttctgaccggtcttttcaccctttagatgagtcccactgattgattaaaaatcagttaatgtcaaaataatgaaaggccatctcacaaataggacgtccaatattgaaatttttaaataggtgcttgaaaaatgaacacttaactattaaactatattaactaaaagtaggtattggatcagccaattcgaagttcagtgatcattttggtatcaatgatcgccttaccatctttattttggtgggtttgaacacggtcaagctggttttgattaataataaattgatcgaaactggatttagaggggacttctaaaactgaacggtcatgtgattgttcaaaacttaattgatctaaaactaagttgtcagggatcgctgaaaaaatattaccgatggcacgtaaagcgacctcaccggttttcaaaagttgtggtttaagaaaatctctgtgaaataattgcgacccttcgaaaatggtttcgctggcatgactttccagtactgcacgataccgaatttcaatggtatcgggacggattttgttaataaaacgtactttaaacagttccatttctttttcaactcctttatatttcatgataggtaaaagaaatgtttaaagcaagttcgaaaatcataataaatatagttgcgttttcacagatattctattaatatatatattaattcgttttccgttcgataaattgttttgtcatcttatgattcaatgttcagaactgagcaattgatttaatgatcaaaggatacaaaacttaaatttagaattgataatcaaattaataaggcatctagtaggtgattatctacgtgctttacagtttaggaggtgttaattattcttagtcgaacaaagcagtatttacgaaaaaatggttatttctataagaaagagtacatgcgtccgttactgacgccggataatatctatatttttcgatttggccgcgaccgactggataatcggctaattattcgatacagtcataagtggactggtagacagcgaataaatgagattgatttgcgtctccataagcaaaaacatccccggatattttacagtgagtcagaattgcttcattatttggaagaacatttattgaggcatgaagccaaagtacaggctcgagaagccaaaaaatcaaaagaagtgacggatggagcatccaaatagggtgcttttttcgtatcattaataacttaaggatggcaggagactatttatgcaatggactgaagtttcgataatcacaacaagtgaagcggttgaggccgtttcaaatattttaatgacttatggcgcaacaggggtttcaattgaggatgcaaaagattttgaaaagctatctaccggtatgtatggtcaccatggcggctatattgatttagaagatgttccacacctttccaaaggagcgattgtgtctgcttattatccggaaagcagacacatcgatcagcacgctgcggaaatttcatctaaggtacaggggctcactgaatttggtcttaaatcggcacctggtgagcttaaaataagcccggtagtagatgaaaattggaaaactgcttgggaaaaatactatcatccatttgccgtgacaagatatttaacggttgtacccagttgggatgactacaaaccaaagaattcattagaacaactcatccgccttgacccagggatggcatttggaacggggacgcacccgaccacccaattgtctttgcaggctttggaaatggttcttcgtggtggcgaatcaataattgatgttggaacaggttcgggtgtgctaagtattgctgccaaattaatgggggcaaaaaaaattactgcttatgacgttgatgatgtggcggttgagtccgctaagaaaaatatgcgtcttaatcctcaagcaactgatattccggttgccgttaatgatttattgaagggaattcatacccaggttgacttagtagttgccaatatccttgcagaaattattgtccctttggtgcctcaagcgtatgaaaatctgaagccgggcggtcattttttaatgtcaggaattatcaaagataaatatggtttgattataaatacgctgaatcaatttcattttaaagtggctcagtcgatgaaaatgggggactggtatgctgtcattgctgaaaaaacagtcgaagaggataaataatgcagcattattttattaatgagaatctaacaaacaatcaaagggtgatacttcccctagaaattgggcatcatcttagtaaagtgcttcgcgctgaagtaggggataaggttcagttggtttcagtcacccatcttgtttatcttgcagaaatcgggtcaattgatgggcgacaggtaacagcgacgattcaaaaagaacttcacatgaatgttgaactacccgtggaagtcacaatcgtcagcggcttgtcaaaaaagaataagcctgagttaattgtccagaaagcaacggagcttggtgctgatcatatcatatttttgccaatggcccgttcaattgttaagtgggatcaaaaaagtgaaaaaaagctcaaacggcttaatgaggttgcattaagtgcagctgaacaatcacatcgaaatcttgtcccgacggttagctacctacacagtctttatgagctgactaaacgccccttcgatgttaaacttgtggcgtatgaggaagccgccaaagatggggaagagtctaatttggctcaggctctgaaagacattcgtcctgatacatcaattgtggcagtctttggtccagaaggcggtatttcttccgaggagatttcactactaactgaccaagcatacatttcagctggtttggggccgagaattttacgaactgaaacagcaccaatgtactttttgtcgtccgtatcggtcatgacggagctcctcaaaagctgatttcggttaaaaacaatgatagaataatgactattagaaacgattatttttaaatggccttaaacgcttgtgaccggataacaaccgacatagttgcttaacgttcatttttcaataacagagaagagttgataaaatgactactaaaatttggactgctaatgacgttattaaaaaggtatccgagtatatgaacgatgatcatgtcaaaatggtcaaacgagcttatgagtttgccaaaattgcacacaaagaccaaatgcgtcaatccggagaaccgtatattactcatccgattcaggtagccggaatcttagcagacctgcacatggacccagaaacggtctcatcggggttcttacacgacgtagtagaagacaccggcgccgagctgagtgatgttcaggagttgtttggtaacgacgtcgcactgattgtcgatggggttaccaagctttcaaaaattaaatataaatcaagtgaagaacggcttgctgaaaatcatcgcaaattgcttctggccatgtgcaaagatattcgagttatgattgttaaattggctgatcggctacacaatatgagaactttaaaatcgttacggccggataagcaacggcggattgccaaagagacgttggaaatttatgcaccgattgctgatcgtttaggtatcggaaccattaaatgggaacttgaagatatttcacttcgctatcttaatccacaacaatattatcgaattgttcatttaatgaattctcgacgggatcaacgggtggactatattcaaaaggcgataaatgaagtgaaatcggctatttcagatttggatattaaaagtgaaatctacggtcggcccaagcacatttattccgtatacaagaaaatggttgataagcataagcaattcagtcaaatctatgatttattggccattcgggtcattgttcaatccattaaagactgctatgccgttttaggtgctattcatacagaatggaaaccgatgccgggtcgatttaaagactatattgcaatgccgaaagcaaacatgtatcagtctttgcatacaaccgttatcggacctgaaggaaaaccacttgaagttcagattcgaaccgaagaaatgcatcgggtggctgaatttggtattgctgctcactgggcttacaaagaaggcattacgaacggtgtcaagggctcccaagataataacaagttgaactggtttaagcagattatcgaattgcaggaagatacagatgatgctgccgattttatggatagtgttaaaggcgaactatttggcgatcacgtttatgtctttacgccaaagggggatgtttttgaacttcctaaaggtgccggtcccttagatatggcttatatgattcacactgaggtcggtaatcatacgacaggggcaaaggtaaacggcaaaatcgttcctctggatcatcaggttaaaaatggcgatattgttgatattattacgtctacaagctcatcaggccccagtcgcgattgggttaaaatggttcacacaagacgagcccgaaataaaatcaaacaatatttccgattagaagatcgtgaaaaaaatattgaaaatggtcgaaatatcattacacgaaagttgcgtgaagaaggttttgacgctcacaaaatattaacacctgatcgacttaaccaggcagctgttaatatgcattatcaacgagatgaggaccttttagccgcaatcggttttggagatgttcagcctacaggtgttgtaaaccgacttacacaagatgttcgagctaagttgaaacgtgaacgtcaggatcaggctgagaaagaggttcttgaagaacatcaaacgatttcggaaagtacagaatcaaccaagcaacacaagaaagctcgaaaatcatcgaatggcattgtcattgaaggtgttgacaatctgctggttcgactaagtcattgctgcacaccggttccgggagacaaaattgtcggttatattacaaagggacggggcgtttccgttcatagagtagattgcccaaatattgccaaagctgaacaggatggacaacgattaattcaagtatcctgggccaatgaaccgggagatcgaacgatctattctgccattctttcagttcagggatataaccgggccgggttactcacaaatattttaaatgctgttaataatgtgactaaaacggtttcctcagtcaacggacaggtagataataataaaatggctacaatttcactgtcagtcggtattcgtaacttggaacaattggaacgacttatttctacactaaaaaatattccggatgtttatctggtaaaacgaaaattcagataaggagcctatacattgaaagttgtgctacagcgcgttaaacaagcttcggtctcaattaatggcgaagtccatggtcgaattggcaagggctatatgctccttgtgggtgtcagcgatgatgatgacgatgagcaaattgcctatttggttcacaaaattagtcatttacgtatttttgaagacgcagatgacaaacttaacttagatattcatgctgttgatggggctattttgtcaatttcccaatttacgttgtatgcagataccaagaaaggaaatcgtcccagctttaccaaggctggccaacccgaacatgcagaaagggtctatgaggcatttaacgaccaattacggcaagctggtttagaggttcaaactggcatatttggcgcggacatgctggttgatcttcaaaatgatggtccagtgacaattatttttgatacagatcaccgttagacctgaaaaatagttataatgattttatagaaaataaagactgaagcttctgattgcttcagtcttttttgaggggcgaattaaatgattaatcaacttttctgggattttgatggaacattgtttgacacttatccaatgatggtagctgcttttaagcgggctttgttagaaatggatatcgatgaagttgaaattgatcaacgtagcatctatgtcactatgagacaacatgatgtcgggaccgttattcgtaaactttctgcattttatggcattgatgaaaatactttacggcaactcaataaaaaatatcaaattgaaatggttaaaaccgcaaaaccattcaagggcgttcgtgaagtcctggaatttgttaaacaactatctggacatcattatttgttaacacaccgggataatcaagcaaaggcgctgctaaaagaatttgatctattgcagtattttactgattttgtgacgtcggatcagaagtttccgcgtaaaccaaaacctgactctattaactggttaattgataaaaatcatgtagacaggaaatccgccattatgattggcgaccgtaagttggatgtacaagcagggaataacgccaatattgcctcgtgtctatttgacccggatggccttattgttgaaacggggaatccggatattaaaattacagaagttaaggaattaattccctggttgtccaagcgttaacaggtgctggattaaagaaatagagccgcaaaacttagcgattttgcggctctattttataatttgacttaattaatatttttctaaaatttgatctaccatcggaccataggtttcaccaaataaatttaaatgagccaataaataattaagctgataccaaggaattcggctattcaaacctgtttcaagcggataaacagaattatatccgtcataaaattctttataaaagccgccaaaaaccgttgtcattgcaatatcgagttcccggtcaccatagaaaacatctggatcaattagcattggcttaccggaagcttcgaacataaaatttccagcccataaatcaccgtggagtaaacttggtaaaactttgtgattttcataatattgcttaaattgattacagagtgattgaaaatgcttttcacgccattcgttccagcgaccgttctgatctgccagtttagcaagcggtttaaggcgctgattaatataaaatgttgaccaatctgattgccatgtgttgatttttggcagctttccagctgtaaagtcatgatccaatccaaatttttcagtatgctgctgatgaactttggcaaccatttgtcccaattcgtattggcttccctgaccaatatccacccaattttgaattaaataaccatcgccattgatctcaccactggcgattacctttggcgtattggcgacttctccaagtaaatgcaagccctcaacttcgtggtcaaaaaagacttttccacggttaggttgaactttcataaagtaatggtttgaagcggtttgcaacgaataagaatcattaatatcaccgccggagacagaatggattctttcaactttttcaattggaagttgagttaaccaattattatcaattgccatatactgatcctccttaattatgagtcttaaaataagtctgcaggccagatacaacgtcatctgcgtatttttcctggtaagaagggctttgaatctttttaaagtccctatcagtattaatataacccccttcgatcaaaattgcagggacagcattatctcgaatgacgagataattgccgaattcggtcccacgatttgtaaggggaagattagccattttttggttaacggactgtgcgagcaattttgaatcaccggaatggtaataatagcaggtaaaccccgatgcagtatttatttcgtctgatgaatcaaaatgaaaactaatgaacgcattggcagaagaagaagctgccaactgtggtcgttgatataaggaaacagtcttgtcagtatctcgtgtcataacgactttggcacctttggaacgcaactttttagcgacgagctttgcaaaaatcaatgtgtaggttttttcctcctgaccggttgtcgaaagcgcaccagaatcactgccaccgtgtccaggatccagaacaatcgttgcctcggaaagtctggtaacatcttttatatggccattggtgactaaccaggaagcaacccaaccaattgttttgtgtttataaatgaccttaatccaattatttttgcgactgataacttgaagctgagcaccttgtttaaccgttgcctttaccgaatatgtcacagatgggccggttcgaatgtttaattgattaactttgacggtgactgaattcgaatatagtgcaataaataaaataataaaggttgccataatggtcaaaatggcaataatccagctggtattttcagagatttttctcatattcagttcttcctattttttcaaataactttattataaattaaagtaggtacttgggctaatgaatattggttaagtcatttttaaatttgatttaaccttgacattttggcattcctccactaatgttataaacagttaaataatcaaccgattaaaaagattagtagttgaaccggttcaaccacagagaacgtttgaacgctgaaagaacgtgaccggctcattgaagtgacactttttacgaaaacggtaatagctaatgctattcgcgcgagcgttatcctagagtgatttataaggtggtaccgtgcaatgcacccttgtcttcggacaggggtcttttttttcggaatttaattgggaggaaacattaaatgagatatcaacgacctaaaggaacagctgatattttgcctgaagaggccagaaaatggacctatgttgaggaaaccgcccggatgctttttaatgattatcgttatcaagaaatccggacaccaatgtttgaaaactttgacgttttttccaggacttcaggtgatacatccgatgttgtgacaaaggaaatgtatgatttcaaagataaaggtgatcgtcatatcagcttgcgtccagaaggtactgcaggtgtggtacgagcgtttgttgaaaataaactttatggtcctgaacaccaacgtcccgtaaaggtcttttatatgggctcgatgtttcgatacgagcgtccacagtctggccgtcaacgcgaatttcatcaaatcggtgttgaagctttcggaagtgatgaacccgaattagatgttgaagtcatcgcaatgggaatggatttactgcatcactttggtctaaaagatattcgtttggaaatcaacagccttggagatgcagcgtccagagatgcttatagacaggcgttgattgattatttggatccgcattttgatgagttgagcaaggattctcaggttcgtttgcacaagaatccacttcgagtgcttgatagtaaagacaaacaggatcaagagattgttaaggatgcaccttccatcttggactatctaaacgacgattccaagaaacattttgagcgtgttaagaaactgcttgatacacttcatattccatacgttattgaccctgatatggttcgtgggctggattactacacacacactatttttgagatcatggttgattccaaagccttgggagaaggatacacaactatttgtgccggtggccggtacaatggccttgttgagcagctgggcggccctgaaatgccgggaattggatttgggttaggaatggaacgcctcatgcttctgatggatgcccagggtgttaaatttcctgtactggatcaattagatgcttatgttgttggcatcggcgaacaaaccagtattgaaactctcaagattgtgcaagcgttaagggcaaacgggtttgcagctgatcgtgattatttgaatcgaaagccaaaggcacagttcaaatctgcagataaacttaatgcacaatacaccattaccattggtgaaagcgaacttgagtcacatacggccaatgttaagtcaatggcttctgggaaagaaattaatgttccgatagataaaattattaatgattttgatgaaattattacttccaactttaatgactaaggagatcttttgaaaatgaagagaacaacatatgctggtttggttgatgacaaactgatcggcaaagaagtcgtcctaaaaggatgggttcaaaaacgtcgtgacctgggtggtctgatttttattgaattacgtgatcgcgaaggaattgttcagttggtctttagcgaggaatttggcaaggatgctttggcggttgctgacaaacttcgaggtgagtacgttgtagaagccaagggaacggttgttgccagagctcccaaggaaattaatcctaaaatgaagaccggtaaaattgaagtcgatattaccgatgccaaaattttggcagtttccaaaacaccaccattttatattgaagatggtatcaatgtctctgaagatttaaagctcaaatatcgttatttggatcttcgtcgtccagaaatgcaatataatattctattgagaaaccggattatccaatccatccacagcttctttgacggggaagggtttattgatattgaaacaccaactttaactaaatcgacaccagaaggcgcacgtgattacctggttccttcaagagtctatccgggttcattttatgccttgccacaatcaccacaacaatttaagcagatgctgatgggggccgggtttgataagtattatcaaattgcccgttgttatcgggatgaagatttgcgtggagaccgtcaacctgaatttacacaaattgacatggaaatgtcctttgcagatcaggaagaaattatggatgtgactgaaggattcattgccaaagtcatgaaagatgcgatgggtaaagatgttaagttaccattcaaacgcatggactgggatgaatcaatggcaagattcggaactgatcaacctgatgttaggtttggtatggaattaaaagatctttcggatatcatgaaagatgttgattttaaagtcttttccggagccgttgaaaatggtggccaggttaaagcgattgccgttcctggcggagcagacaaatattccagaaaagatttggatcagtttgccagctatgtagaacgttttggtgcgaagggccttgcttggcttaaagtaaccgatgatagttttaacggcccaattgcaaaattctttaaagacgctgaccttcgtcaaaagattttggataaggctgaggctaagcccggtgacctgttgctgtttgccgccgataatagtcggattgtagcagatacgcttgcttatcttcgggttgaaattgccaaggagcaaaacatgattgatgaatccaaattcgcattcttatggattgttaactggccactcttccattgggatgttgacttgaagcgttatgtggcagcccatcatccatttaccatgccaaatgaggaagatgtccattatctattgaacgatgatgaagatccacataaggcgtatgcacaaagttatgacatcattcttaacggtcttgaacttggtggtggctctattcgtatccatacacgtaaattgcaggaaagaatgtttaaggcgcttggcttcacaaaggaaagtgccgaagcacaatttggttacttcctaacagccttggattatggttttccacctcatggcggacttgcaattggtcttgaccgatttgttcgtctgttggctgatcgcgaaaacatccgggatgtcattgccttccctaagaactcaaaggctgttgaaccattaacaagtgcaccgtctccagttgcaaacaaacaattggacgatctgggcatctttgttgaaaatcaagataaacaaaaatagttttttaataaaatctgaataaaagattgaagcaggacctcagataagacatactgatcttatctaacgtcctgtttttcatttagaaaagaagtagccgttttgtcggcttgcacttagcgttacaattaacttgtgttgcgattattaactatgaaaggattttattatggatgacgtttcaaagctaatgcgtcggcatacgtatgtcacgaaaacatctacgtcgtttatttatggcatcttggtatcgattgctgttaactttttttggaccccaggtcatatttattcttcaggaattaccggactagcccaattactaaatacaattagctcacgggcccttccgttcactgtttcaaccggtctgggcttatttttattaaacattccacttttccttgtagcttggcgtggaataggtcgagaatttacaatttttacaattatcacagtatttttatcaagttttatgattcagttacttaaaccagtgccactcactcatgatccaattatatgtgctatttttggtggggcggtcaacggatttggaacgggaacggcccttaagaatggtatttcaactggtggtcttgatattttggggttggttattcgggataagaccggaaaatcgattgggtccatcaatattgcctttaatgctttgattgttgtagcagccggttttgcttatggctggccttatgctttatattcggtaattggattgatcgtgaatgcaaaggttatggacatgacttataccaagcaacagcggatgcaggtgatgattattacgaatcgtcccaatacagtgattgatagtgttcaaaatcatcttagaaggggcattacaattgttcataatgccgagggcgcttatcaacatgatgccaagactattttattcacagtcatttccagatatgaaatgggagaactggaagaagcacttttagaatcggaccctaacgcatttgccagcatttcggattctgttaaaattcttggcagattttatgaaccaaagccctagtttttttctaaatctaaagattttttaagaagataattctacaaaaagtttatgttataatactcgagtgtgtttattaaaaactgaaaaacggtgaagaaattgaaagtagtttatctatggttgattcgctttctgtcaatattaaacatttggaaaccaagcaataaagtgatttacttaatgagctttgataataatttggattttattaagcagttagctcaaaaaacaccgaatcgtttccgtctaattgttttatatcgtccagaaaccgaagcggccgcaaccgagcttgctgcattcggaattgaaacccatgaatttaatgatggtatcaagtttgtttttgattttgtcccactcttgatgggtgccagagtaattttttgcgataattactacgctttcttgggtggcttagttcatcctaagaaaatgaagatcatccaaatttggcatgcaaatggtgccattaaaaagttcggatgggaagatccaacaacagaagaacgcagtaagtcggataaaaaacggtttcaagatgtttatgatcattttgatgagtatattgttgcttctgaagcgatgggaaatgtctttcaacatagttaccatgagtcggttgaaaaaatgcagcttctgggttatcccagatcagatcaatatttggataagcaatggcaggttagcgccagagaaagaatctaccgtgctgctccggaactcagggagcatcgagtaattttatatgcgccaacttaccgtcctgataaaagttttaagttaccggttggacttggcgcggctttgtctgcggatcaaaacgcgattgttgtagttaagttgcatccggtgttaagaaaccgagagaatgcaatgagacagatcggtaatccaagaatcaaattttatcatgaattggctactagtgaattgttagcagttgctgatacattagtgactgactattcatccgtggcgttcgattttagcttactgccaaatgcaaaatcactgattttcttcatgtttgatttggaacgttaccgcttggatcctggtgttcaagatgattttcttgattggttgccgactaaacctgttacaacagttgacgagttaaaacgggagataagggcaagaaaaccaacaagttttgaacaattcaataagcattggaacacctataatgatgggcaagcaactcatcggtgtcttgatcgttatctgaacttattaaagtaggtaaacatgattttgcaattaattaaacttgaaataactgaacattcagttgcttcattgtaaggagcgtattgacttgaaagaggtttacacgttaatcaaggaacagtttcaaaacattgggattatttttcggatttctcaatatgaagataaagctgaatatcaaagccattatttaggcttagtttgggaatatttatacccgcttattcaaattggtatttattggttggttttcggaattggcttgaagcatggcagtaccacccatggtgttgattatttgccttggatggttatcgggattacgccttggtttttcatgaatcgggcaagtttagatgcatcaaagagtatttatcaacgtgtaggtatggtttctaagatgaaatttccggttagtatcttacctacaattaaaattgtcagtaacttaagttccttctggacaatgttagtgttttctatcctggttagttttctttatggtgttcatccttctatttattggatccagtggatctactatttcatttgtatgattgcgtggatgattgcgtttggtattttcaactccacaatttcattattggttcgtgattggcgtattatgcttcaatctttgatgagaatgttattttacatgtcaggcgttctatttaattttgaaaccacatcgtttccagcaccattcgtccacatcctccaactgaatccgtttttctacgttgtctccggcttccgtgattcaatgcttggaacaatgtggttttggcaggaaccaactttaaatatcgttttttggggaatcgtcttgttctttttcctagttggatctcacttgcactataaattcagatcaagatttgttgatttaatttagtttgggaagggtgagctttgtgaaaagtaacttgattgcttttatcaaattaatagctcgctatatactcatcgtgataaacgatgggtttatttgtatgcgagtaaaaaagcgcttagtgttgttcgagagttttaatggtaaagacgttagtgacaatccacttgctatatacaaaaaagtaattgaagataatccggatatgaaaaatagttgttatttcagtgttaaaccgtctgcttttcgtagactgtcacaggaatatccgaaaattcgattattgaaaagatttacacctctttgggtatggtatagtgcccgagcgtcgttttgggtaatgaactccagaatgccacaatggtggaaaaagaataagggaacaacatatattcagacgtggcacgggacaccattaaaacgacttggcgttgatatcagtcatgttgaaattcctggtaatacaacacaacagtatcatcaacaatttattgatgaagcggatcgttgggattatttaattgcccccaatgcttattcaaaaactatttttcaatcagcttttggttttcatcatcattttttggatattggatacccaagaaacgacatcttgtatcatgaaaataatctaaaatcgattgatttgctcaaaaaacaattattaggaacatctccggagcatgtcataatgtacgcacctacatggcgagatgacgactatcaaaagcagggcgtctataaatttgagttaccatttagtttaaaaaaattttttgaagttgtggattcaaacaccatgttgattattcgtccccattatttagtaaaagatcacattaatatttcgggatttgaagaccgagtcaaaatttgtgcagaacaagacattaaccaattatatttaataaccgatttgctgattacagattattcatcggttatgttcgattttgccaatttaaagcggtccatgttattctttccgtatgatcttgatcattatcgtgatgagctacgcggtttctattttgaatatcaaccacaaaatttaccggggccaatggtcactgacgcaactcgtttttacagtgagctggcattgtttaatacaaccagacgtttcactggctacgaaaaaaacttggaagatttcaatacaaaattttgtgcttgggaaaacggcacggcttcacaaaaagtgagtgaaattattttgaagggaatgtcgaaagattgagtaatcaaacatttttaattgggtcacatgtcagtatgaatggcaaagatatgttcttgggatccgcaaaggaagctgccggatttggtgaaaatgtatttatggtttatacaggggcccctcaaaatacggtccgaaaacctattgaaaagctaaatggaccggctggaaaagcgtacatggctgaacataatttgaaagaagttgttgtccatgcaccgtacattattaatcttggaaatacgttaaaaccacaaaacttcgctttcggcgtgcaatttcttcaacaggaaattgcacgtgccgaagcgattggggccaaacaaattgttttacatccgggcgcacatgtcggtgagggtcctcaaaaggcgatcgaccaaatcgctaaaggcctaaatgaggtgattacagataatcaaagcgctcaaattgccttggaaacgatggccggtaagggaacggaagttggtattacttttgagcaactggcggaaattataagtaaggtttcgaataacaagaaactatctgtcacttttgacacctgccatactaatgatgctggatacgatgttaaaaatgattttgacggcgtattgaatgaatttgaccacattgttggtcttgatcgattaaaagtcattcatttaaacgattcaaaaaatgaacgtggcagtcacaaagaccgtcaccaaattatcggattgggaacaatcgggtttaaggctctgaattatattgctcatcatgatcaactggcatcggttcccaaaattatggaaacaccgattctaaaagatccagaaaataaacgtattaaatataatccgcatggctatgaggtcagtatgttaagaaagcaagtgtttaatcccaacatcatcgaagatatgaaagcgggaaaacctttttaatgtgagattagatttgattctaaataaagatggttggcaatcaaaagccacgccttatcaaatcccgaaaagggttctgtaaaatcaataaagtttacgttgattttacagaacccttttcatttttaagacttttgaattttcaaaagtcggacctattatgctaagcggtctttgatagtcactaatcttcaaatgttgttgtatctaaatttaagctttccaaaataatagttgcggtttcctcaatagatttgttggcaacattgatgaccaggcagccaatctttttatataattttttagcgaaatccagttcgattttgatgtttttagtatctgagtaaggtgtgtccgcacttaatccataagagatcattcgctgtttccgaattctgcttaatttttcgggtgtatttagcaggccgaagatccggtctttcttcacatgatttaattcatccggaatgtgtagatcggggccaatcggtagatttgcgacacgctggttttgattggctagatatagtgaaagcggtgttttagatgttcgtgaaacgcctagtaacacaatgtcggcttccaaaagccctttggcgtttttcccatcatcgttttcaactgcaaattcgattgcagaaatacgttcaaaataattctcgtttaaatcatgaattaagcctggaacgtgtgcaggttcctctccggttgcctctgatagcaacttcattggcgtttggatacaatcaaaatcatagatcccatgttctttacagaaagtaacaaccatttggctcaactcgatgctgaccagtgtgtggaagatcatggctttttttgttaaagctaaattcaaaataccctttaaaattgattcggtttgaataaaaggaaaccgcctgatttctgctttgatatttggaaattgtgaagcggcggtttgcgctaaagtttgagcagtagcaccacttgagtcagaaataataaagatattttgcgttttcatatagatttctcccatcaatttttttcgactctaaaagaaactccaaataaattttaacatgaagcattgtttttaacttaaatcattgacgatatttcgattaatatgtataatttaatgcgaaccgttttagtacaaagtaaatgtgtgcttttaaacagttacatttaagctcggagggagggaatttcatatggcaaagacagtcgttcgtaaaaacgagtctcttgatgatgctcttcgacgctttaaacgtacagtttctaaaagcggtacactgcaagaatatcgtaaacgggaattttatgaaaaaccaagtgtaaaacgtaaattaaagtccgaagcagcacgtaagcggaacaataaaaagaaacgtcgtttttaatatgacatcacttttgaagatcggagctaatgtttcattagtctctggtcttttttatgttaaaatttagacatacattgaaaagaggtttaacagatgagtgtttatgatcagttgaattcagatttaaaagatgccatgaaggcacgagacaaagttagattgggtgtgattcgaggattgaagtctcaaatcatgaatgccgaagttgataacggtaatcaaaaattgactgatgagcaaatcagttcagttgtgatgaaagaaatcaaacagcaaaaagaatcactcgaagaatttcaaaaggctaatcgtgatgatttggtcaaagatcagagcgctaaacttaaaattgccgaagagtacgcaccaaaacagctatcagaagacgaggttgaagcaattgtgaatcaaacaattgaacagttacacgctgaatctatggctgacttcggtaaggttatgggtgctattatgccaaaggtcaaaggaaaagccgatggcagcatcattaacaaacttgtcaaaaaacagcttcaaagttaaaaaatcattgattattaaattagcgccaagaattggttcaacaacattccaatcgctttggttaacctttattttgtgatagtatctgattaatattaatattaaaaaggagctaattaattggctgaaactcaacagattacaaaagaacttgtcgtgtctgatcctaatcagctgttacaactcgttggaactcaaaacgagtttataacgattctcgaagagggtatgggtgtttcgattaatgtgttcggcaactcactacgtgtcagcggtgatgaacagtcggtcggcacaacattaaacattttggataatatccttacattggtccaaaagggaatcaatatcaacagcagtgattttatcagtgcgattaatatgtctcaaaacgggacgttagaatattttcaggatttatacaatcaagtcttgattaaggacgccaaaggtaaggccgtccgggtcaaaacatttggtcagcggcagtacattcaggctatttcgcatcatgacgttgtttttggtgtcggccccgccggtaccggtaaaacgtacttggcggttgtcatggcaattgctgcacttaaaaaagggacggttgataaaattgtattgacaagaccggcggttgaagccggcgagagccttggctttctgcctggagaccttaaagaaaaggttgatccatatttgcgtccgatttatgatgccctacatgcgatcttaggcgctgagcacactgaacggttaatggatagaggcgtgatcgagatagcgcctctggcctacatgagaggccgtacacttgataattcatttgtgatcctggatgaagcacaaaacacaacgaatatgcagatgaaaatgttcttaacccgtttgggctttgggtcaaagatgattgttaatggtgatatttcacaaattgatttacctaaacatgcggccagtgggctggtccgggctcaggcaattctaaagggaatcgatcaaattgaatttgtgacattcagtgcaaaggatgttgttcgtcatcctgtagttgctaaaatcattacggcttacgaaaaaaacggtcaataattattgaatgaggattattagtcatggatttagaaatttacgataaaactgaaaagggcatctctgaaaaagatgaaaaaatgattcgggatgttttaaattttgccggctcatatattcatttagcagataatactgagatgtcggtcacacttgtcaacaatgatgagattcacaagattaatcgtgagtaccggggtgttgatcgggcaacagatgttatcagctttgcaattgaggatgaggccgaagatgatgactttccaatcgtgatggatgaagatatgcaggaatcaatccctgaaaatattggtgacatcttcgtatcggtcgataaagttgcagaacaagcggactatttaggtcattcatttcaaagagaactcgggttcttggttgtgcacggtttccttcatttgaacggttacgatcacatggagaaagcggatgcagacatcatgtttccgttgcaaaaagagattttaaatgcctatggtcttaaaagataagcgtcagatagaaaagaataagcacttttttcagtccgttggtcatgcactggaaggcattaaaaaactgattttggaggaacgtaatttccgctttgatttaattatcacggtggttgtcctttgtatcggtcttttaatgaggattgcaatctatgattggttgtggctgtttgctgcatttttctcagttatcggatcggaagtcttgaattcaatcgtggaaaacgttgttgacttaatcgttggtcatcattttgacctaatggcaaaacgtgctaaggatattgcagctggaggcgttcttttgtccgctgttttcgcaatgatcatcggagcactgatcttcattccaaagttcgtcgaattattaaaataagtgaggtagaaaatggataatccaaattatcgttccggctttgtggccattgttggtcgaccaaacgtcggtaagtcaacttttttaaatcgagtagtcgggcaaaaaatcgcaattatgagtgataaagctcaaacgactcgaaataagattcagggtgtctatacaactgatgaggcacaggttgtattcatcgatacaccgggtattcataaacctcaaaacaagcttggggattttatgatggattctgcactatcggctttaaaagaagttgatgcagttctctttatggttaatgcgactgaacggcgcggtgccggtgataattttattatcgacagattaaaagatgttcataaacctatttacttattgattaataaaattgatgagataacacctgatgatgttatggcaattattgaacaatataaaaacgccttatcttttaaagaggtcttcccaatttcagccttacaaggcaacaatgttcctgagttgttaacgtcactcattaaggaattgccaaacgggccccagtattatccaaaggatcaggttaccgatcatccggaacgttttgtcatttcagaattgattcgagaaaaagtacttcaaatgacacgtcaggaaattccacattcaacggcggtctatattgagagtataaaaaaacaggatgaggtattacacattcaggcaacaattattgttgaacgtgacggtcaaaaggggattgttatcggtaagggtggttctatgctaaaaaaaattggcaccctggctcgaaaagatattgaaaacatgatgggtaacaaagtttatttggaattatgggttaaagttgaagcgcattggcgtgataaagcaaatctactaaattcctatggttataaaaagggcaactattaagattaagcatgattagttgataatgggctgcgtttttttaataaacattgaagatctgtcatcttcagctaagatcttttttcaagagaggtgaatttcttggtcaaagcaaaacctgctgagtttcacggtattttactttatacaaaagcctatcgggaacgagatttacttatcaaatttttgacaagagaattcgggaaaaagatgtttttggttcacggtgccaaacgaccaaagtttcgaatgcgggctgcaattttaccgtttacctatggcgcttactttggtgatcttaaagatgacggcctgagttacattaacaattataaaagaattgaccattttcaaggcattaccgccgatattaccaagaacgcctacgcaacttacattatgtctttgattgatctggcttttcaggatagcattgccattccaaaatggtacgatcaattaatgatcggcttaagtttaattgatgatggtttcgacgaagaaatcattactaatatttttgaaattcaattattatcggcttttggtgttgaacctgattgggttgattgcgccatttgtcatcggcgagacctaccttttgattattctgaagcatatggcggcttgctttgccagaaccattttgataaggatccatacaggttacaccttgatcagagaacgatttattttctcaggttattctcaattgttgatttaaccaagcttaaaacgattcaaatgagtgataaaacaaagaaatcgcttcgaaaggtgattgaccaaatttatacgaattcagttggtgtcgtgccgaaaagcaaacgatttattgaccaactcggtaaattcaaaatttgagtcgatccatcgttgacattctagaatatgtcaactaagattattttgagttaaatattttcggtgatgagaaaagaaattaggcattcatttttttcaacgaggctgggatagtgtaagccggctagaaattgatgactaaaaggcactttttgagccgaatgaattaagtgctggtgttaaaccagaagtagggtggaaccgcgagaccatcgtccctatgtttaagtggcaaattgtaaccgtcactgaacatagggactttttgcgtgaaaaattaggaggaatttaaatgactgaaaagttatcggttcaagaaatcattctgcggctgcagcagtattgggcagcgcagggttgtatgctgatgcaggcttatgacactgagaagggtgccggaacaatgagtccctatactttcttacgggcaattggcccagaaccttggaatgcggcttacgtggagccttccagaagaccggcagacggtcgttatggagaaaatccgaatcgtctctatcaacatcatcaatttcaagtaattatgaaaccttctcctgagaatattcaggatttatatcttaatagtttaaaagaactgggtattgatcctttggaacatgatatccggtttgttgaagacaattgggaaaacccatcaatgggttgtgccggtgttggttgggaagtttggcttgatggtatggaaattacccaatttacctacttccaaatcgtgggtggcctggaaatgaacccggttgcttctgaaatcacctatggtttggaacgattgtcgtcttacattcaaaatgtgaattcggtttttgatcttgaatggtccgatgatgtcctgtatggtgatatttttaaagaacccgagtacgaacattcaaagtacagttttgaagaaagcgatcaggaaatgttgctgaacttgttcaatgattatgaacgggaagctaaacgccttttgaaactggatttggttcatcccgcatacgactatattttgaaatgcagccatacatttaacctgttggatgcacgtggtgcggtttcagtaactgagcgggcaggatatctctcaagaattcgaaacttggcacgcggcgttgctaaagagtttgtggccgcacgaaaacgtcttggattcccattgatcaaggacgaaaagaaacgtcaggagctgcttaaggatgatgaaggggaggaaaaataatggctaataatttcttacttgaaatcgggctcgaagaaattccggctcatgttgtcacgcccagtatcaatcaactaaaaaaacgggccagtgattatttaaaagaccaacgaatcacattcgatcaaatcaaaacatttagtacgcctcgaaggttaacattgtacattaccggcttagccgacaagcaacccgatattgataagtccgttaagggacccgctaagaagattgctcaagatacggatggcaactggacaaaggctgctatcggattttccagaggacagggtgccaccactgacgatattacttttaaagaagttaagggaaccgactatgtgtttgttgaaaagcacatcgccggcaagtccgttgatgaagttctaaccggaatgaaagatgtcatcacggctatgaccttcccaaccatgatgaagtgggccaactattcatttgaatacgttcggccaattaaatggttggttgcgttattaaatgacaaagtaattcccttcagtattcttgatgtttcaactgatcgggtaacatccggccatcgttttttgggcaaagacgtcgaattggccaatgctgatgaatacgaggaaaagttaacccagcaattcgtcattgcagacgctaagaaacgaaaagaattaattgttaaacaaattcataaaatagccgaagataatgattggcaaatcaaccttgatcccgatttactggaagaggttaataatctggttgaatggccaacagcctttgctggtaaatttaacgataaatacctgaagatccccgatgaagttttgattacgtcgatgaaagaccatcaacgatttttctacgttactaatggggatggcaccttgttgccacacttcatttccgttcgaaacggaaatgattatgatattcaaaatgtgattgccggaaatgaaaaggtcttaactgccagacttgaagatgccatgttcttttacgaagaagatcaaaagaagaccattgctgaagatgttgaacggcttaagaaagttagtttccacgataaaatttctactatgtttgaaaagatgcaacgagttcaggtcatttctaattaccttggtaaacagtttggtttttcagataaggaactcgaggatgaacaacgggctgctgaaatttataagtttgatttggttaccggaatggttggagaatttgccgaactacaaggtgtgatgggtgagaaatatgccttgttaaatggtgaagcacctgcagtagccaaagcaatttcagaacactatatgcctatttcggcaaacggtgcacttccagcatcaaatgttggcgcacttttggctgtttcagataagcttgatagtattttaactttctttgcagccggcatgatcccaagcggttcaaatgacccatacgcattacgccgtcaggctacggggattgttagaattgttgctgataaaaactggaattttgatttaattgatacattgaaggcaattattaacttgcaagacaaaaagcaggttgcacccaagcttgaccaagctggtcaaattactgcagtcagtgattttattaaagatcgaattaagcagtatcttgatgatctcggtattcgatatgatatctcggacgccgttacttcgggttcgcaaactgatatcttgtttaacatttcaagtggtcaagttcttcaggagcaaaaggatgatgatgcctttaagtcaattatcgaatccctgacccgagttcttcgaatctctaagaaaggacacttcaaggacaacgatcttgttgttgatggttcgttgttcgaaaacgaatccgaaaaggtactgaatcaaaaggttgcttctgccgctgagggttattatgaaatttcggctaaagaagactttgatcggctttccggattgaaggacgcaattaatgcatactttgatgcgacaatggtaatggataaagacgaaaaactaagggataatcatttacggcagttaacgcttttgtcacacttgattttgcatttgggtgatctggataaactggttgttaagggttagttttgcttagaatgttcaagtgcatttgtttgtacaaactttttaactatgctagtataaactatgtatcgccagcagatgagtcgcactattttggtgcgactttttgcaggtattaacgccggttttagagatgggaggcggataactattgaagatcccagaagacgtgattgaacaggttagatcccaggttaatattgttgacgtggtatcacaatatgttcaacttaaacagtcagggaagaacctttttggtctttgcccgtttcatgaagagcgaacaccgtctttttccgtttctgaagacaagcaaatatttcattgttttagttgtggtcggggtggaaatgttttcaaattcatgatggaaattgaaaacctgtcttttcccgaagcggtcaaaaaagtagctgaaatggaacatttggatgttgattccaaatattttacggatgctgcaccggctagtcgggaaacttccgagcaaaaacagctgattgaattgcacgaacaggccgtcaagctgtatcaccacattttgattaataccaagatggggaaatctgctcttgattatttacatcatcggggcgtcaacgatgagacaattgatctttatcaacttggttatgcacctcagcagcgattgttaaaaccattttttgatgagcgtcaggccgattaccagttgttaagaaagtccggacttttttccgagactcaggatgggaagttacgtgatcggtttgttgatcgcgtgatgtatcccattcgtaacgcaactggtcaaaccgttgctttttcagggcggctgttggctaaagattcagatatgccaaagtatttaaacagtccggaaacagaattgttcaataaacgaaaaatactgttcaatctggatttggctcggccaaacattcgcagtaaacaacccgctttgttgtttgaagggtttatggatgttatttctgcataccagggcggtatcaagtctggcattgcttcaatgggtaccagtctaaccgagcaacagatatatgatattcaacgtattacacgtgaagtgattgtctgttatgatggagatgctccgggacaaaaagcaatcaaacgcgcaattgatgcgtttaagcaaactgatcatcaattggatctgaaagtcgtttcaattcctgatgggatggatccggatgagttcattcgaaaccggggtgctgataaatttcaaaccttattacaacatgctcaatcacccgttgattttgatttgaattaccttaaacaggaagctaatcttaaaaccgaggaaggacaagcagcctatatttcagaagcattgaaattgattagtacaattagttccggcatttcccgggacttgtatcttaaccgtttggctgactctttttcaattgacaaacaggttttaaaacagcagctccaaccgcttattcgaaaaactgttactaagcgagccaatcatcagattccggctggtcagcctgttaatcaatctcctcaaaaaagggataaagtaacggttgcgcaaatgcagcttcttaacaggatgctgcataatcatgatgtatgggtaaaggtcagtggtatttcgggattctcatttgttgatgaacagtaccagatgttgtatttattggcggaaggatacttttccaagtttgaccagtataatgtcgcaacatttagtaatttaattactgaggattcattgcaaagcctattgattgatattgacatgatgaatttaccagaggagccgtctccaatggaaattgacaatgatttggatgttattatgaatcgggcgccggtagaaacaaaaattaaaaagaaacaagcagaactgagacaagcatcaaaaattggggatgttgataagcaacgccaattgatggttgacttattaaaacttgagcagcaaaagagaactaaggaacaagtataacttcgggaggcattttgatggctaacaaaaaaacaaataatgcaaaggttgttaaaaaagcgactactaagacaaaggccgctgcagctaagaaaacacaaaagccttataagaaggtatttgatcagattgtaaaggacaataaaccgatcggtcacatcacctacgatgaactccagaagaaaatcgaagaaccattttctttggataaaaaagaaatggaagagttactcgaaaacatcgaagattccggaattagtgttgtcgatgataacggtgatccagatccaagagccattgatgcagcaaaaaaagtaacaaaaaaagaactctctgatgtttctgctccaacaggtgtcaaaattaacgatcctgttaggatgtatttaaaggaaatcggaagagtatcacttttaagtgctgatgaagaaatcaatcttgccaaacgaattgaatccggcgatgaagaagccaagcaggaacttgcagaagccaacttacgattggttgtttcaattgccaagcgttacgtcggtcgtggtatgcaatttcttgatttaattcaggaaggtaatatgggcttgatgaaggcggttgaaaaatttgattaccgtaaaggattcaaattctcaacttatgcgacatggtggattcgtcaagcgattacccgtgcgattgccgatcaggcacgaaccattcgaattcctgtccacatggtcgaaacgatcaacaaattgattcgaattcaacgtcaattactccaagatcttgggcgtgagccgcttcccgaagaaattggtgctgaaatggatatgccaactgaaaaggttcgagaaatcttaaagattgctcaggaaccggtttctcttgaaacaccaatcggagaagaggacgattctcatctaggtgattttattgaagatcaagatgcaacgtcacctgcagatcacgcagcttatgaattattgaaagaacaacttgagagtgttctggatacgttgactgatcgtgaggaaaatgttctgcgcttacgttttggtttggatgatggtcgtaccaggactttggaagaggttggaaaggtatttggcgttacgcgtgagcggattcgtcaaattgaagccaaggctttaagaaagcttcggcacccatctcgtagtaaacaattaaaagattttttggaataaaatcctaatttctcaaacagtcggtataaaaatcaattttgattttgtaccggctgtttttttgtagatgaataaattataataaaggtattaacgaattaaggagaaatacatgaacggcacgcatctttccaaacgtttagaaacaattagtgagcatgtcgaaccaggtagccggttggctgatattggatcagaccatgcttatctaccgattcatcttgccaagaataaaacaattaattatggcgttgtcggagaagtggccaaagggccgctttcaaatgcgatcaatgaaatttccaaagagggcttgctggacatcctgcaccccaggttggcagatggattagccgctattgaagccgatgatcaaattaacgccattacaattgccggaatgggtggtattttaatcagccaaattttggaaaatggtcaggacaagttaacgggtcaagagaaactgattcttcaaccgaatgtaggtgaaaacattgttcgaacctggttaatgaatcatcagtattttattaagaccgagcaaatcttagaagaagaccatcatatttacgaaattatcaccgcagtcaaatcggcgcaaccagtgggttattcagctaagcaactcaagtttggcccttacttattaatcgagaaatcaccaatctttatttcaaaatggcaggaagaacgtcaacaactgcaacgggttatttcaaatatgaaacgggcagttcatgaagacaagcccaagatgaaaaaaatcgagcaacagattcaagaaattgatgaggtgattgatagtgaaaggtagagagttagttcaaaagtttgaagcatttgcgcccaaaaagcttgcaatgccaaaagatccgatcgggttacaaattggttccctagaccaggatgtccataaggttatgacaacgctggatgtccggccggaagttgtagatgaggcaattgaaaatgacgttgattttatttttgcacatcatccggttatgtttcacccagctagaaatttagattattcagatcctcaaaatgcaatgtatgcgaaaattattgcccacgggatcactgtttatgctgctcacaccaacttagatactgctgatggcggcatgaatgattggttggcagatgaactgagcctgacaaatgtaaggggactggttccaggatatgcagaatccgtattccgattaacggttacagttcccaaggtatacgctacggcagtcagaatgtctttggttgatgctggggcggaaattaatgacggtcaatataccggatacacttatgaaatggatggaacagtatactatgtaccgcaaccaggggcagatccaacaatcggcatggctggtgaaccaacagaattagaggattccagattggaatttgaagttcctgaaaagaatttgaacagagtcttaaaaacattacacgatgttcacccacttcaacaaccgctttacaatattattcgcttagaggacaaaaagcaccaatatacaatgggtcgggttggcgagttacctgagccgatgcgacttgaatcattcgccaaacggtgtaaatctgtttttcatatttctggccttcgagtgattgcaaacgacttgtatcggacaattaaaactgtagcggtactgggtggcgacggtggtaagttttataagactgcacaaaaagcaggggcagatgcttacattacgggagatgtttattaccatacgggacatgacatgctggcttcggatatgccggttattgatcccggacatcatattgaaagtatctgtatccctaaattagcaaaaatggttaacaagtggtctcaagaaaacaattggggtctttcggtgatcgaatctcaaatcaatacagacccgtttactttcctgtaaagacatgactacatgaggagaattaaaaatggcaaaatatccagaattgatttcaaattttttgaagtttgtgaagattaatagtcgctcaaaccccaaatccagaaccattccgtcttcgaaacgtgaaacagcattcttgaatatgttaaaggacctattatcagatatgggcctaaccgatgtacacaccaacgaacaaagtgcatatgtctttgcgacattgccttcaaatcttgataaaaaagttcctacagtcggttttatttcacatattgatacggcagattttaattccgaaaacattgatccgcaaattattgagaactatgatggtcaatcgattatcccgcttgataaggacggagaatttaaactggatcccaaggtttttccaagtttgaaaaagtacaagggtgatacattaattacaactgacggttcaacgctattaggtgctgatgacaaagccggagttgcggaaatcatttcgtcaatcgcttatttgcagtcgaaccctgaaattaaacacggcacaattaaagttgcttttggtccggatgaggaaatcggaaccggggcagatcattttgatgtgaatgatttcggcgctgattttgcttatacggttgatggcggcccattgggtgacctaaactacgaaacctttaacgctgccgaagcaactgtttcaatcaaggggaccgatgttcatccggccgaagctaagggtgtcatggttaatgcaattcaagtaggaatggactttcacgcagcattaccggaatatgatcgtcccgaaaagaccgttgaacgacagggattctatcatatctatgattttcaaggaagcgttgatcataccaacatggcttatatcattcgagaccatgatcgggaccgttttgaggctcgtaaaaggttatttgaaggcattgctgatcagatgaacaaagaattcagtgaaaagcgaattagcgttgagataaaagatcagtattacaatatgggtgaaattatttccaaagatccgacggttatcgaagtcgctgaacaggctatgaaaaatgttgatgttaaaccacacattttccctgttcgtggtggtaccgacggctcaaagatttcctatatgggattaccaactccaaatatctttgccggcggtgaaaatatgcatggtcgttttgaatatgtttctgagcagacgatggaaaaagcgacggatgttattattgaaatcgctaaattgtatgctcaaaaataattggtcaaaaaaggtcaaattattgttaaccagttataaaatttgataacatacttgtaggcggtttgaaatgaaacctttttctttctaaccgcctttaatggatggaactaaattaagataaaaaataataaggtgatcatttaaatgaatccagataatttaacagaagcagttacgcaagcaatttctcaagctcaacaaattgccgttactcgaaaacaacaaaatattacggttgcccacctgtttaagttcttggtccaacccggtgaattggctcgtcaaatatactcagaactgggactgaacctaaaagatttagataaggaactcgataccgaaattgaccagattgcaacggttgagggcagtaatatcagttatggacaatctttatcgtcaaatttgtatgagttattacaagatgccgaacaggttaaaaatgagtttggtgactcatatattgcggttgacaccctgacaattgctgttatgcagcttcacggtgataattttaccgactatttaatcaaacaagatataaccgaacaaaaagttagaaacgttgtcgagaagatccgtggtggcgagaaagtaacctccaaaaaccaggaagataattatcaatctcttgaaaaatacgggaccgacttggttaaggctgctcgagataataagttgggaccgattattggtcgggatgaagaaattctcgatgtgattcgaattctgtcaagaaagaccaagaataatccagtactgattggggcaccgggtgttggaaaaaccgccgttgtcgaaggattggcactccgaattgcctccaatgatgtgccggaaaaccttaaaaacaagacgattttccagttggacatggggtccctgattgcgggtgcaaagtaccgtggtgaatttgaagaacgacttcaagctgttttaaaggaagttaaaaaagctgagggtcaaatcatcatgttcattgatgaaattcataacatcgtcggggcaggtaaagccgaaggatcgatggatgccggcaatattctaaaacccatgttggcccgaggggaactccatttaatcggtgcgacaacgattgatgaataccgaaagtacatggaaaaagataaggccctggagcgtcgtttccaacgggtaatggttcatgaaccatcagttgaagatacgattacgattttgcgtggcctgtccgagggcctggaaatccaccatggcgttcgaatccacgataatgccctggtagccgctgctaaactttccgatcgatatattactgatcgaaatttaccggataaggcaattgatcttgtagatgaagcatctgctgaaattcgggttgaaatgaattccagcccgacagcgcttgatcaatctaatcgtcaacttatgcgccttgaagtcgaagaggctgctttaaagcaggaaaccgatgaagcttccaagaaacgcctaaaggaagttcaggaagaacttgccaacattaaggaaaaagtcaatggtttaaatgcacgctggaagcaggaaaaagacgccattcaaaagattggtgataaaaagaaacagcttgatcaggcaagaaatgacctgaaacaggctgaaaacgattacgatcttaataaagctgctgttcttcaacacggtacaattccacaattggaagctgacctgaaaaaactggaagaaaatgatcaacatgccgactggttggtaagtgaatcggttacggctgacgaaattgcaaaagtggtcagtcgggaaaccggtattcctgtgacaaaattggtcgagggcgaacgccaaaagctccttcatttagctgacaatctgcacaaacgggtgattggtcaaaatgaagccgtaactgccgtttccgatgccgtcattcgttcacgagccggtttacaggatcccagtcgaccgcttggctcattcctatttctggggccaaccggagtgggtaaaactgaactcgctaaagccctggcggaagatttatttgattctgaaaatcatatggttcgaattgatatgtccgagtatatggaaaaagaatcggtttcacgattagtgggtgcagctcccggttatgttggctacgaagaaggcggtcagttaaccgaagcagttcgtcgtaatccttacaccattgtgctatttgatgaaattgaaaaggctcacccggatgtctttaatattttgctccaggtgttggatgatggccgtctgactgatagtcaaggacgaaccattgattttaaaaacaccattttaattatgacgtccaatttggggtcggacattctattggaaggaaccgacgagaatggtattatttctgataatgccaagaaacaggtcgatcaactactcaaagcatcatttaaacctgaatttttaaatagaattgacgatgttatcatgtttaagccgttgtctcgaactgatattgaaaaaatcgttcaaaaattaattgatcagctttctgtgcgaacaaaggcgcaggatattaagctttcaatttcagatcaggctaaacaatggattgctaagaatgggtatgaaccgcaatatggcgcacgtcctcttcagcgttatgtaaccaacgttgttgaaacccctcttgcaaagatgatcgttggtggtcaggttaaaccacatagcatcgttcatatcaatttggaaaacgatgccctgtcttttgtacctgagcaggtaactgccacgcaagtgtaaggtgggatatctttgtcaaaagaatatcggattccaacgaataatcatacagaacttgcggttaccgttttttctacgactcatccggtaggtattgttcaagttattcatggtgctttggaacatcaatcacgttattttgattttgcggcttatttaaatcagcagggttttattgtcctaacttcagataatcgtggccatggcagatctgtatccaaggatgatcctttgggcatcatgttcagctggcagcaattagttaacgatcaggtttgtttaagtcactttattaagcggcaatatcctgggctaccgctgtttttgttcggtcactcgtttggatcgattctcggccgattatatcttcaaaaacatgatcaactattaaatggtctgattttgactgggactgccaattacatcccaatggtaagtatcggacttcttttgggaaccgtttatacgcgcttacatcttgaaaatcgttattccaagttattatcaaggctttctggattgacacctggtgatcattcttggctaagttacaatcttgaaaatgttcaacgggtatccaatgacccggatatgataaatcaatatcctgtattaagtttaatgacgctgtggcagggcgactacgagcttaagcaggttactcatttccattgccaaaggcccggattaccgatcatttctattacgggggatcacgataaatttagtggtggcagtcatggattaacagacacaattaagacattacacaaaattggttattcaaatgtaaaaaataaagtcatgccccatatgaagcatgaagttttacaagaagttgatcaccaaaaagtatatgaacaaattgatgcctttttatacgaacacatttaatcaagcgggatgacttatttttgactttaatttgaaatcagtcgtcgtaaaaaaagtgaggctgggcaacgtttacgtttgtcccagtctcactttttattaattatcgagaattatttggaaaatgatcctttgctgataaggtaaataccgtttgttgcacaaaagccaacaatggcggccgtgataccaatttgcatagggttgtatggtaaaacctcaagttgattggcaatgtaaccgatgatttcaccaaagatcaatgcccaaaaaatgacgacaagatttgaagcaataagtttcatagtcttaggcctcctgacaatcaatggtattttagcatatttcctaagaaaaatcactgtgaatttacatttagaatttagtaatgagacctaattgtttggtataatttggtagaaagaagggaattcaattgacgtacgtaccattacaagtcattagctcatatagtttacttcaaagtccgattcggatctctgaattggtcacagaagccaaaaagcgtggatataaagcacttgcgatgacagatattaatgtcatgtatggcgctgttgagttctatgatacatgcatcgacgccggtattcagccaattattggactgacgctgaatcttcccggcgtaatgctgtctgaaaacaattattcgattcttttattggccaaaaaccaaacggggtatcaaaaccttttaaaaatatcaacgttaaaaaactctggtgaaaccgatgtaacgattgatcaactcaatggccgactggatggactatatgtcattttgccgccgttggcggaaattaacgatttactgcttcagggaaaatcagcagatatttccgatttgatttctaagttaatggatcttggccttacaaagcaagatcttaagtttggcgtggactaccattcttctgatgctttaatcgatatgctcagcaaagtagcggctgacaatcaagtccagttgattgcggatgcgccggttcaatacttgaatgccgaagattattttccaatgcaggttttaaaagccattgctgctggtactaagatttccaatgttgccgaacttagccaacaggttggtccttattttctccggccccaagatcaaatggaaaaagaataccaacgactccatttaaatgcggctcttcaagccatcgatgaggttgtttccaattgtcatgtcgaaattaaaaaaaagcagccgaaactgccacaattcgaaacccccaacgatatggaacctggtcaatatttacggcagttatgtgaaaagggactttctaagcgactggaagcggctcatatttccgatgatgcaccttatcgccatcggcttgacagagaattatcagtgattcattcaatgggatttgatgattactttttaattgtttgggatgttattaattttgctcatcaagccaggattataaccggaccgggtcggggatcggctgccgggtcacttgttgcctatacgttatttattaccgacgttgatcccattaagtacgagctgctctttgaacgctttttaaatcccgagagagttcaaatgcccgatattgatttggacattccagatgacaaacgtgatgacgtcattcaatatgttcaccaaaagtacggtcatcaacgggttgcacaaatcattactttcggcaccttggctgccaaacaggcaaccagagatgttggccgtgtttttggactcaacccaaatcaacaggatgtgtggagcaaagctattcccagtgcttttcacgtaacattggccgatgcctatcataactctcaacagttaaaaaacctggttgccgacagcgacttgaataaatcactttttaaaacagctcaagtgttggaaggcttgccgagacactattcaacacacgcagccggattggtgctaagtgataatttattggttgatcttgttccccttcaggatggaaatgacgggcttttaatgacgcaatattccaaagactatgttgaatctgtcggtttgctaaaaattgattttctgggacttcgcaatttaacaattttggctgatgcactggcagaaattaaacaggcaacggggcagaaaatcaacatttctcaaattccgttagatgacaagaaaacgttgaaactgtttgcgaacggcgatacaacaggcgttttccaattcgaatcatccggcatcagaagtgttttacgcagactacatccagaacagttcgaagatgtcgcgttggttaatgcgctttaccgaccgggtccaatggaaaacattgacgaagttgtcaaacgaaaatcacatcaggaagctttaacctatccggatcagtcactcgaagacattttaaaatcaacgtatggcgtcatcgtttatcaagagcaggtcatgctggtcgcttcaaaaatggctggattttcactcggacaagccgatattttacgacgtgcaatgagcaaaaagaagttaaaagtgatggatcgaatgaagagcctatttttaacgggcgccgaaaaaaaggggcatcccaaacaagtggccgagaaagtatttgattatattgaaaaattcgccaattatggattcaataaatcccatgcggttgcttacagcaaaatggcctatgaacttgcttatcttaaagtctatttcccaggcgagtttcacgttgctttattaaattctgttcaaaatagttcggtcaaaatgaaagagtatttatcagatgccaaatcaatgggagttaaagtagtggcgccggatatcaacaaaagccgagctgatttttcataccaggatcagcaaattgtttttgggttggcttcgattaaaggggttcgccacgacatggtacaggatattttaaatgatcgtgaccaaaacggccgctataaatcctttcctaatttgcttgctcggctttcagacaagtaccgcaagccggacttgattaatgcgttgatttattcaggtgcgcttgacggtttttcatacaaccgttctgaattaatctcagcagcccctgaattcatcagctcaattcagctaagtggcgattccatgagtttattcaaggcactggaacccaccgtgccgagaaagcccgagatgcctttgatgcaacgccttgaaaaggaaaatgattatttgggtgcatacctgtccggacaccctgttgagcgttttacagcccttagaaaacgactgaatgcaaaactgaccaatcagttagtcgtcggaatgaaccaggtcgtcttaattttatatataaccaaagttaaaattatcagaaccaagaccggcaagcaaatggccttttttgatggcagcgatgaagttggcgagatgtcggtaacggttttcccgaatttatttattaaaattcaatcttggcttcataaagacatggtggttgccattcgcggcaaagtcgaaaaaaacaacaccattcaaatggttgcagagacgattcagcctgccgataatctttctcggaaatctgcaggggttaaaaagcagcctcattggtacttgcgaattgatccatcccatgataaaaatcaaatttttcacaaactaaccgaattgtccgttcagtatcggggctcggtatccctcgttgttcatgaaagtgcttcagagaaaacatggattcttgggaataattttaatttacaacaaggtgatcaaattaaagataaattaatcacaatttttggtcaaaataatgttgtttataagtaattttttgattgaatatttacttttcgtaaaggcttacattgtcgttagaaccgtcttttaggcttttgtgggtagttaacaaagtcgttattgtccaaaatattcgacgacataactcgaaaaaagtgataaaatacggtttggaatctaaaagggaaccccaatatttaattggtctatatcctgttaaaaattgtggtgtccaaaaaaccgaaggagagattttacttatgaagaaaactaagatcgtaagtacattgggaccagccagtaccgatgttgataccatcgttaaattaattgaagctggggctaatgttttccgatttaacttttcacatggtgaccatccagaacacttggatcgtttaaacaaggttcacgaagctgaaaagaagacaggtaaaactgtcggaatcatgctcgatactaaaggtgccgaaattcgtactactgttcaaaaagatggcaaaatcgaatatcacaccggcgatgttttccgtatttcaatggatgacagccttgagggtgttaaagacaagattgccgtaacatacacgggcctctatgatgatgtccatgaaggtggtcatgttctttttgatgatggtttattggacactgttgttactaaaaaagatgacgctaataaggaattagttgtaactgttcaaaacgatggtgttcttggttcacgtaagggtgttaacgcacctggcgtttcaatcaaccttccaggaattactgaaaaagattcagacgatattcgtttcggtttggatcatgatattgacttcatttctgcttcattcgttcgtaaagcacaagatgttttggatatccgtgccttacttgaagaaaagcacatggaacatgttcaaatcttcccaaagatcgaatcacaagaaggtatcaacaactttgatgatattattaaagttgctgatggcttaatggttgctcgtggtgacatgggtgttgaaattcctgccgaaaacgttccgttggttcaaaagactttgatcaagaagtgcaaccaactaggcaagccagttattacggctacccaaatgcttgattcaatgcaggaaaacccacgtcctacacgtgcagaagcttcagatgttgccaatgccgtttttgatggtactgatgcaacaatgctttcaggtgaaagtgctaacggtgaatatcctgtacaatcagttcaaacaatggcgcgcattgatgttaaagctgaaaatgcttttagcgaatttggtacaccacgtccaacatttgatgccagtgatgtcactgaatcaattggtgattcagttgctcgtgttgcaaaagaattgggcattcatacaattgttgctgcaacccgttcaggttacactgctcgtatgatttccaaatatcatccagatgcagacatcttagcattaacctttgacgaacgtacccgtcgtggtttgatggttaactggggtgttcacccaatcttggttgacgaagttaagagcagtgacgagatttttgaacttgctgctaaaaaggcgctcgaaactggtttagccaaggaaggcgatttaattatcgttactgccggtgttccagttggtgaaagcggcacaaccaatttgatgagaattcaattgatcggttcaaagcttgttcaaggccaaggtgttggtgacaagactgttattggtaaagccgttgttgcaaaagatgcagctgatgccaagagcaaagtaaccgaaggcagcatcttgattgcaaagtcaactgacaaagattatcttccagcaattgaaaaggcaagtgccgttgttgttgaaagtggcggcttgacttcacacgctgctgtagttggtatctcaatgggtatccctgttatcgtgggtgccgctggtgcaactactaagatttcagatggtgaattaattacagttgattctcatcgtggtgtcatttatcacggtgcttcaagctcactataaacagacggcttgaatgtaattaaataacgtataatgggagactggacagaagcgattttgcccagtctctttttacgcaccttattatgcagattgatggatcttctacttagtaaccgcatttcttcttcagtcgaattttattgttaaagcgtgtagaatgagtaaagagattcaagaacggagattaacatggataaaaatttaatggcccaagtgctaaagggcatactaaccgatgaaaatgatcgctattattttgttcagattgagggcgaaacttttcaattagacaaagctgaaattaagaaaccgtttaagattggcgctgaatttaccggctttacgtatgagaatgagcaacatagaatgcaaattacacggcaaatccctaagattagaagggatcattatgcattcgggacggttgtaaaggggaaatttggactaggtgtttttgttaacattggattacctaataaagacgttgtcgtctcggttgatgatcttccaactgttagcaaactatggccccgcgaaggtgacaagctgctcatatcgctcacagttgacaataaggcccgtatctggggacatctggctgatgaagagatctttgaaacgattgcaaggccggtgaaagaacgccttcaaaacaaaaatattaaagcccgggcatatcgattaaaactgtcaggaaccagactgttaacggatgattatcacttggcctttcttcacccaagtgaacgattggaagaaccaagactgggagaagaagtagaagccagagttattggtaccctgagggatgattcaattaatatttcaactcgcccaagagcctatcaagaaatcggtgaggatgctgaaatgattctggcagctctggatcataccgaatcgaaacaacttgcctttagtgataaaagtgctcctgaagatattaaagattattttggcatcagtaaaggcgctttcaaacgggcgcttggtcatttactaaaggaaaacttgatctctcaagaggatggccatattacattaaagaaacaggaagattaaaatggacaatcaacttgctgattatttacactttcttcgagttgaacgcgggctttctgaaaatacaattaaaagttatcaacaagacctatccgaagccattcatttttttcaaaaaacaaccaaggatatttcaaaagtcgatcaatttttgatattaaattatttggaaaatttacagcaagaaaaaaagtctcgaaacacagttatcagaaccgtttcaagtttacgaaacttttttcgctacttagcccaatttggcgttgtcccagatgatccaatgttgaaagtggattctcccaagcagtctaaaacgctgccggatgtattatcggttagcgaagtcaataaactattgtcgatgccgaatgtatcaaagcctcttggtgtccgggaccgtgcaatgcttgagacactttatgcgaccgggttaagagtcagcgaacttgttaacctacggctggttgaccttcatcttccaatgaaactgattcagacggtcggaaagggtgatcgtgaacggattattccgattggtgacgttgccattgattggattacgaaatatttaaagacaacacgaattgatcttttaagaaaaagaaccaatacggattttgtctttttaaatgctcatggcagacgtttaacccgtcaggcaatttggcaaatgattaaaaaatatgttaaattagcaggaatcaaacggcatgttactccgcatacgctccgacattcatttgccacccatttattggaaaacggggcggacttgaggattgttcaagaattgttgggtcacgcagatatttctacgactcaaatatatactcatatttcgcacaaacatttgaccgaagtttatcaaaaattccatcctcgagcttagtcagtgaggtgatataatgttatatcaatatcgaaaagattatcaaaaaattacgatgggactgttttctttagtttccgatctgcaaaacatggatttggtttctcaagagatgacttggtatgccgataaaagcgaccgaatgatctatttatggaaggatcgtcacaataactggtccggcttggttggaatcgaagtcgaaaatgatcagttgctgattcatcgattaattttggcaccaccaagccgaaaccaagagaattatagtcgcctgttggatgagcttcagtccctatacccaaaggaaaaaatcatcggcggttttgaaaccaaggaaatctgtgccaaatgggagcaatcaaaggatcatgaacgtatctgataaagaaccagaattacatttaaatgattttgatgggccattggaagtcctgcttcacttaatccaagagtccaaaatggacatttatgacattccaattgcagagataaccaagcagtacatggattatatttatgatgcacagcagctcaatttggatatagttggtgatttttttgttatggctgccaaattgatggtcattaaatcaaagatgttgttaccaacagttgttgatgaagccactgatgaggtggaagaagatccacgtgaagatctggttaatcaactgattaattacaaacggtataaactaatcgcaggtaaactaaaggattacgaaaataaacgtcgtcaaagttttacccgttcggaactggccgtttcagcttcgaaagaaacattaacggtgccttcaccttttgacaaaggcgatattatggccagttacgtggacgctttaaaacactttcgttataaccaaccattgtcaacaactgttcatgagtggcaatttacaattgaaagccaaacagcgttagttcgccagctattggattgtcgaactgaacagatttcttttaatcatgttattcaacattccaccaagcctgaagaaattgtcaccgattttttagcgattttagaaatggctaagtataacgaagttcgtctcaaacagaaaaatcgccatgaaacaattgaaattagaaaggggcctgcatatggcagtaagtaatttagcaaagattgaagcacttttatatgcttccggagatgagggcattaatctccgccaaattgctttacgaacaggtcttgagttgtcggcgtgtcgtcagttagtggaaaaaatcgctcaaaattttaataaaaataaggattgcggattaaaactgttggttgcaaacgatgtttaccggcttggaacgaaaaatgaactggcagaactggttcgagactacgtcaatgatgcaaagccccgtgttctttcccaggccgctttggaaactgttgcaatcgtcatgtataatcagcccattacgcgaattgaagttgatgacattcggggcgtaaacagttctgcaattttgcaccgactcttaaatcagggattgctaaagattaccggtatcaaacaggaagttggcaatcccaaacaatatggcgtcaccaacttttgcttagactattttgggttaaaaacattaaatgacctgccagccttaccaaaagatgaagtgttggatgataatacaagtgactcattgttgacaaggtttaatgagcaaatcgatcagggaaaacaggagactaaaaatgagtgaacgcttacaaaaagttatggcccatgctggagttgcttcaagacgaaaagctgaaaaattaattgttgaaggccatgttaaagttaatggaaaagtagtcagggagctgggaacaaaagtcacggaatccgacgaggtcgaagtagacgaagttccaatatcaaaagaagttcccgtttattaccttctgtacaaaccgagaggggttattactgctgtaacggatgataaacatcgaaaaacagtgattgacctcctaagtgaagtcaccgaacgtatttatccggtcggccgattggattatgatacgtcaggcttactgttattaacaaatgatggtgatctcgataatcatttaacacatccaaagtacgaggttgataaaacctatgttgcaaaagttaaagggaccatcaccaacgatgatatgaagaagcttcgaaccggtattcatattgacggtcgaaaaactgccagtgccaaggcaacggttattcgaaataataataacagtacaattgtgtcgttgacgattcacgaaggtcgaaaccatcaagtcaaaaagatgtttttggcattagggcatcccgttgagaagcttagtagacaaagttatggcttcttaaacttggatggactacagccgggggattatcgacgattaaagcctcatgaagttgaagaacttaaaaaaatgtctcaagatagaaaacgttgacatttaaataaaatttgatatatttaagttagttaaataaattggtttatcttcagggcagggtgaaattcccgaccggcggttatagtccgcgacacgtgagttatcacgctgatctggtgaaattccagtaccgacagtaaagtctggtatgtagaagattaaatttttcactacgcataaagtcctggcagtttttgtcgggactttttttgaagattaaccattggaagagaggttcttttcaatggaacatagtagtaataagcaattgttgacgacccgtttggtggaaatgtcggtgttagccggctgctcctatgtattgatgttcatttcatttccgattattccaattgtcccttacatgaagattgattttgcggacatgccgattttaattggaactgtcctatttgggccggttagcggtataactatcgcgggtcttaagtcgttattatattggctgacaacttctggtggatcacttatcggcctgattggtgttggctcatcatttttatcgtcagtcacgttaattctcgcattttatttgggaaatcgattctttggttcaatgaaaaattctcttagaattattttggtcattgctttgatgatgattagtttaacagttatcatgtcgctttctaactggattgcggtcattccgctttatatgagtatggtagggatgaaaataggcatgccgttgtcatctctcattttgttcggcgtagtaccctttaatttaattaaaggaattgttgttggtggtttattctatgccattaaagacaaggtccttccacgacttaaattaaaataggtttaaaacaaataatttaattaaaccacgtatataaataatgcaacttattgtagaatagtaatggctgcattctcgaaaactgagaggttgggaattgtcccgacctttttttgatattttgataggtgactagtatggacttagcgacaattttaattctttttagttcttcatcccagtggcgacgctcaaaggccattaaaaatattttgattggcaggcggactgtttccaacttgtactgggcactccaatatgggctgctaaaagattttggttctcttcacggcgctttaccagataatattgaccaggcagtggctaaacttaaacaagctgagcttgtaaaagctgattcggagttacagatccttctcactgaaaagggaaacgattatcaatcaaaattattggcttcactgcctgagttaactttatttgcatggtcagcccgctatgatgtctttagattttctaaaagattaaacctcgctattcagattgtgtcggaatatagttattcaaataatcattactatccacaaactatcggtttgttggacagtcagttgatcaaaaaatggtttattcaaaacaaagcagatcacttaccggtatatctatattcaatgcttaatcattttttggaaaaactgtctcgagatgagtttgccgaaatctttactcagaacttgtctggacatcatctttccggacaaactgatgctcaaattggtcaaactcaaggtaagtctcccacggtcatctctttaacaaaattactgctatacacgcagcttcttaccgaattgttaagtaaacccaattctaaattgcagcctttgacccagggactcgccaggccagtcatttcaaacagtgctgcagaaacttttaccatgttttgccattatccaggtttaacaattgcaaaaattgctcaaaagcggcatattaagttgacaactgcttatgagcatcttctggaggcagctatcgttttacctcaaagtgatatcccgtttcaacgcttattgaacccgaagcttgaacaaaagttatctgcaattcaacccaatgacttgggggagtggtcatttcgggtagccagtgaacaagtggataagttggacttcttcaactttcgattatttcagattaaacaacttaaacagactgattgagaaatgtataggtgaaaatatgcttaatttacaggatgaactaactaaatattttagctttaagcggtttcgtcccggtcaggaaaaaattttgacgatgttgctaaagggcaaaaacgtcctggcaattttacctactggcggtggaaaaacacttttatatcaactgtatgctgctataacacatcaacggattatcattgtatcgccacttatttcactcatgcaggatcaagtcagtcgtttacaatttctgggttctaaacgcgtcattgccctgacttcggcaatcgattttaaagaacgtcaatttattatgaatcaccttgagcaatatcaatttatttatgcttctccggaaatgctggccaatccacaaatcatggaaaaattcaaacaactatccgttgggctgctggttattgacgaagcccactgtatttctgaatggggccccgactttcgcccggattatctgaaattaaatcaggttagaaagtcactcaaaatgccattaaccttgatgatgactgccaccgctacaaccaaaaccaggcaagatatccttgagcgcatggagatggatcaggatcgggttaatcaaattgttctttccgttaatcgtaaaaacatttttttgagcgctcgagtttgtaaaaatcaacgtgaaaaagatgatcttttagtcaaattggttagtaaacttcacggcgcaggtattatctatttttccagccgtgcaacagctgaaacagttgcagcgttactgaatcatgacacaagtaaaagggtagaggcttatcatggcggaatggagggacaatacaggtttcgaattcaacagcaatttatgaacaacgagattgatattgtgtgcgctaccagcgcatttggaatgggaattgataaaaatgacgttcgttatgtgattcattatcatttaccaggtaatattcaaaattatatgcaggaaatcggtcgtgccggaagggatggaaaaccatctttagctattctattatatgaaccaaacgatcgttatcttcaggcaaacttaattgataatacgtatcccgaagataatttgatcagttatttataccaacatccacaagtaatgaaaaaaaacgatgcgtttcgtgtcgttaaatattattatgagaaccatttttcgaccgaccaggctatttcctttctgaatcgttcaaaagaacaaagactgaccggtctacaacagatgtatcaatatatttttacacctggatgtcgacgaaaagttttattaaaccactttgatgaacaattagtcgatgacgatcatgaaaatcagttttgttgtgactttcattttaatttttggactaaatgggaaattttcaatgaccgctacctgaaatcgagtgattttagacagcagaatgctgtgaaagactggcatgaagtccttaaaagcttatttttatcaaaaaattaaggaaagctgacaatgtttgatgataaaatgaacttgtctattctgtaagtaaggaggggtctaaatgaatacaaacggggatcataagcgttctgatgaagatcaaccctggaatcaaaccttttcggaagatcgtgatgaacatggcaacttatcacgtgtaaagcttcgtcagcaaagtcacaatcacaatatgattacaattgttttagtcacgttgatcattgtcattgctttagtctcattggtatatggtttgaccaaacagagtgcaatggggagcggttccaatcatcatgcgacagttgcaatgtcgcagcccagttcaaaaaaaaaatcctcaacctctgaatccagtgtaaagaagaaggcagcttcccagaaacctgttaaagaaaagaagacctcaagtgtctcgtcttcggtttcttcaaactcaagaagtcgagcatccagttattcgactaatcagtctgcttcaagctataaggataatccatcaacgtcgactactgcatcggacagttctcgggcgtcatccgattctcaaagtcagcaaccaaatacgactaaccaaacgtcaacttccagtggccacgaatacgccactgttcaggccggtcagggaatatacagagttgctgtgaataatggattaacaatgtcacagttaatgcgcatgaatgggttatcgtctacttcacaaattcatccaggtcaaaagttgaaggttaaataagtctgccaaggcttatttttcttgtcataatattaatactggacttattagttaaatttattaaaattaaatgcgggtatcggtcatgttaaccgaaaaccgttttaactaaattcaagacaagttaggaatgtaatgatgcataaaaatggattacaagtagcaattgatggaccagcttctgctggtaaaagtacggttgccaaactcgtggcaaaacaatttaattatatttattgtgataccggcgcaatgtatcgagcagtcactttaaaaacaatccgcagtgggatttctttggacaatgaaaaggagatctcagctattgttcggaattcaaaaattacgtttgcgccggatgaaaacggacaaaaggttttcatcgacggcgatgaaattacacaggacattcgttcagaaaatgttacaaattccgtttctgctgttgcagcaatcgctgatgtccgaaagcaactcagtgctcagcaacaagaaatcgccaaagatggcggtattgtgatggatggcagagacatcggaactgctgttttacctcgggccgaggtgaaaattttcttgatagccagtgtggaagaacgtgccaaaagacggtacaaagaaaacatccaaaagggaattaatacgccacttgaagaactacagttagaaatcgaagcgagagactacaaagattctcatcgcaagatttctccgcttacaaaggctgatgatgcgacagagattgatacaacagcactttcaattgaaaaagtggtttcagaaattgcaaaagtgattaatttgaaattgaatcttaactaattggtcaattaactggtaatatgagtgaatttaagataaaattatgattagagttgtttcaaggaggaattgtttgatgagtgaaaatgcaaataatgataaaaacgatctattgaacgctttaaatagcgttagtgaagttaacgtaggtgacgttgtcaccggtgaagtccttgcgaaggatgatgagcaacaattgatcgttgggattgacgatacaggtgttgaaggtgttgttcctcaacgtgaattgtcatcttcccaaaattttgatgatatcaagcaaggcgataagcttcagttggtagttacatcaagaatcggtagcgataaagagggcggcagctttctactttcatcacgtcgtttagaagcacgtaaggtttgggatgagttggctgaaaagtcaaagaacggtgaaacaattactgccacagtttctcaagcagttaaaggtggattggtcgttgatgctggcgttcgtggatttattcctgcatcaatgatctcagaccattatgttgaagatctcaaccaattcaagaatcaagaacttgaattaaagattattgaaattgatccagttgcaaaccgtttaattctgtcacacaaagcaattcttcaggctcaaaaagctgaagaacgtgaaaagttaatggatactcttcacgaaggtgacattgttgaaggtaaagttgctcgtttaaccaattttggcgcatttgttgatttaggtggcatggacgggttagttcatgtttctcaaatcgcttatgaacgagttgagaagccttcagatgttcttaaagttggccaagaagttaaggttaaagtattgtcagttgactttgatcgtaaccgtatttcactttccatcaaacaaactcttccagaaccttgggacggaatcgaagaaaaagcacctgccggcagcgttcttgaaggaaccgttaagcgtttagttgattttggtgccttcgttgaagtatttcctggtgttgagggccttgtccacatttcacagattgctcatgaacacattgctacaccgggtgatgttctaaaagttggtgaaaagattaaggttaaggttctcgatgttgatcctgatcgaaagcgtttagcactttcaatcaaggctttgactgataagccaaaggaatcttcttcatcatcgaagagttcaaacagacgaccatcaacaaatgtcgataataattctagaaacaatgcgcctgatgaagaaaccggctttacgtttggtgatatcattggtaacgaattgaaaaagaattctgacgacgataacaataactaaaaaaacagtttttactgttttgtgagggaggtcgagacaacgcgtcatcgtttgtctctgacctctttctttatgctttaaatgaaaaataaaggaggctttcataatggctatgccaacggttgcgtttattggacgcccaaatgttggaaaatcaaccatttttaatcgaattgccggagaccggatttcgattgttgaagatacaccgggcgtgactcgagatcgaatctatactcacgcagaatggttagcaaatgaatttgccatgattgatactggtggtattcaaattagcgatgcaccttttaacactcaaattaaaaatcaagccgagattgcaattgaagaagctgacgtgattgtatttattgtcagtgccaaagaaggcttaaccagtgatgatgagcaggtagctaaaattctttatcgaagtgacaaaccagttgttttagcagttaataaagcagataatccagatgctcgtgaagatatttacgatttttacgcacttggttttggtgacccaatgccgatttcaggtgtccatggaactgggattggtgatttgcttgacaaaattgttgaaaaattcccaaaagaaaccgggaacgtgcccaacgacgatattcgcttcagtattattggtcggccaaacgttggaaaatcttctctggtaaatgctattctcggtgaaaatagagtgattgtttccgatgttgccggtacaacccgtgatgcaatcgatacacggtttgaggcagacaacatcaagtttacaatggttgatacagccggaatccgtaaacgaggcaaggtatacgagaataccgaacgctacagtgtcatgcgggcaatgaaagctattgaccaaagtgacgttattttgtttgttatcaatgctgaagaaggcattcgtgaacaggataaaaaagttgccggttatgctcatgaagctggaaaggcaattattactgttgttaataagtgggatatgctaaagaaaacaaaccatacacagcaggatttcgaaactttaattcgaaatgagttccagtatatggcttattcaccaatcatcttcgtatctgctaaaacaaaacaaagaattgagcagttaccggctcttatcaaacgggtttatgacaatcatgaaaaacgtgtccaatcctctgctcttaacgatgtgattatggatgcggtcgctgttcatccaacaccaacggttaatggcaaaaggctgcgtatttattatgcaactcaggttgtctctggaccaccaacctttgttgtcttcgtcaacaatccggatttaatgcatttttcttatgtccgattcctggaaaatcaaattcgtgataattttgattttagcggaacgccgattcggattattaaaagaagccgaaaataagcttctcactgatttcttactttgtgaagctttcaaaagcattgatttcaaaggcatccgaacaattttatccatctcaatcacaaactgccaattgcttggagatttccgaattaaaaggttggaaaaaggggccaaagttcgcgaataacaaaggttttgttaaaatatcacgacttgatttcttaaaaaaagagtcaaaattgttaaaactcggcgatttcaataggaaattggataaaaacattgcaatgacggcattcttctgctatatttgaaaaagaaatgatgcttcaactgcgtcgttttagcaattctgattccaacgaatcaagtttgtgatgttttacatacctatctttgagggaggtgaatacactcatggcaaacaaagcagaattagtaactaacgtcgccacagaaactggcttgactaagaaagatgctacagcagctgtggatgcagtatttgattcaatccaagctagcttggcaaaaggcgaaaaggttcaattgatcggcttcggtaacttcgaagtacgtcaacgtgcagctcgtaagggtcgcaacccacaaacaggtcaagaaattcaaattcctgcaagcaaggtaccagcttttaaacctggtaaggcgcttaaggatgctgttaaatagtattcatctgttaagtcagaacggcaattgtcggactggcttttttgttactatttgttatcaatggaggaattttatgagttattcacaaactgcattagatcagctcgaacgaggtcaacttgacgagtttgagcaatcttttaaaaaagcattaacaaacgattctgacgacatattatattcgttggccgaggaactgtattcgttgggattttccaattattccaagacaatttatgaacaactactaaccaaatttcctggtgatgattcaattaaaatcaatttagcagaattagccattgatgtggataacgatgatttagcacttaactatctctctcagatttcagagcaatcggccgaatacgttcgctctttgatggtttcagccgatttataccagactcaaggtctctttgacgtgagtgagcaaaagctcttagaagcccagagaatcgaacctgatgagcctgttatttcgtttgcactcgcggaattttactttaatacccgaaattatcgtaaggcaattaatctatatcttgatttaattaaatcaggaacacttgaactatctgcagtaaatttggttgaacggttgggtgtgtcctatgctgagatcggtaagtttgaacaggcgcttggttacttggaacaaattaaaccggttcatatgaatagcgacgtcaaattcgaacttgcatttacgtactttaatttgaaagactatcaaaaagccgttaaagcctttacagatttacgagattccgatccacaatatagttctctgtatccttacctggctgattcatatgttgaattaaaacaaacagatcatgcacttaaaaccattcaagaaggcatttccatcgaccaatttaatgaaaaaatttggcaaaaggccggtcagattgcaacgatggctggagaggatgaactggcactaagataccttaaaaaaggccatgagatcgcgcctgaggacatggaaatccttagtctgctatctgactggtatattatccatgaacaatacaaggacaatctgaagcttttagagccattggaagaggaccatgtctttgatgcacatttggcctataatctggcccaatcgtatcaagatgtgggtgaatttaaaaaagccgccaataattacgaactggcaagtcacgaattaaatgataatcctgagttcttaaaacatgctgcgttgttttatcgtgaaaacggtcatgtaaaagaagaacgtcgctatcttaaacattatttggtgctggtgcctaacgatatggaaatggcctcgatgtatgaagaagatgaaaacgaagattattaaaccttacttcaacaaatagtctctttaatttccgcgtaccgtttctaatttagaatatgatcagatgttgcttggtgacacataagctttgatttagtcatcataaaaaatgtgagacaaggggcagaaagttgccctttgtttcacatttttgtcggttatcatcatgatcacagaaaaagggggccggggcaaaattacttttgtctcagccctcaagttatacatagctattataatattttgaattttttaggccgcttgtaagtaaatccctcgccaattgcttcgttaacctccataaccgatataaaagcttccttgtcaatggattcaacaagctttttaagcgtatgaagttcgcttggtgacacaacacagtaaacgatatcttttccttttcgtgagtaaccgccttcagcctttaaaaaggttgtcccacgattcaactgttccataatggcttcggaaatggtcgcagactggttactgataattaagattccccgagcagcataagcaccttgttgtgtaaaattaacaatcattgaaaaaatccatacataaatcaatgtataagccatttggcgaatatccagataaatcaatgatgataaaagaaccaagacgtcaattgccagcagtgttttccccatctgaacacccttgaaccgttcaaataggcgtgcaacaatatctacgccaccggtcgtgccaccaaaacggtatacaatcccacagccaaaaccgccaaatagaccagctccaagggcggcaagcagtaaatcgtgttggatattaatttcaataggaactcgctgccagatccaaagaaatattgacaacattgcggtaccgtataatgtgtaaaacatgtcttttttacctaaatagcgatagccgattgcgaataaaggaatattgaccagaatagtggaataggctggatccatatggaaaagagccctcaaaatcaaagtaataccggttacgccaccatctgcaagatgattataaatattaaaaaatacaattccaaacgaataaatagctgagccaagtgcaatgacaaccaaatcaacgaccgaaatatccagttggaatttcttctttttttgtgccatattttccctccaatatgatttttgtgtccttcagtttgatttaaaaagtcgaacataataacaaacacttatcatagcaaggtatctgtataaaaggcaatctttttgacaaacttttttcatgttcaaatttctgttagaattgtttggtaaataaatacaagatggatggcgatattgtgcaaataaaaaacatgccaagtgaatttaagaaagcactgccaatcctgcgaaaaatcgaagcagcagggtatgaagcatattttgtgggtggttctgtaagggatacaatattacagcggccaattcatgatgttgatattgcaacaagtgcttatccaagtgaagtaaaggggcttttcaaaagaacggccgataccggaattgaacatggaaccgtgatgattttggatcatgggacaggatatgaagtaacaactttcagaacggaatccggttaccaggattatcgtcgtccggataaggttacttttgtcagatcactaaaagaagatttaaaacgacgggattttacaattaatgcattagcattaagcgagaatggtaaaataaccgacttgtttggtggcttgaatgatatgagcaaaaaaattattcgagcagtaggtgatccagaagaacgttttaatgaagatgcgctgcgaatgatgcgtgcagtccgttttgccagtcaattagattttaaaatcgaagagcaaacattaaccggcatttatgatcacagtgagttactgaaaaagattgcagtggaacgaattcattcggaatttgtcaaaatgatgctgggtgttgacgctaaaaatggtttgaacttaatgataaaaagccagttatatcaatttgtgccagatttttccgaacatttgacagtgcttcaaaagattgtcgctactcattttgatttggataacgaagttcaggtttgggcgttgtttacatcaatgtttcagttcaatcgtgatcaggtgatctcttttttaaaaagatggaagacggccaataaaataattaatgatgttatacttacaactgaattgatttttcagattaagtctcagaaagttggcaatctcgaattatataaagctggaaagcaaaatgttaaaaatgctgttacaattatttccaactatacagattttgattcagcaaaattgattaaggcctatgatcaattgccgattacgactaaaaagcaactcaacgttaccggtggtgacttaattaaacgggggattttaaatccgggtccaaagttgggagaaacgttgggggcattggaaaaagcagtcgtacttggtaaaataaacaatcaggattcagaactaattgctgcggcaatggcattaaataaggaatgattagtgaatggaaacaatgcgagtagaagggctgacaaaaacatatggtgaaaaaacactgtttgacagccttgattttttaattaacgagcaagaccggattggcttgattggcacaaacggaacagggaaaacatcgttgctaaatgctatttcaggccacgatcatgattcaaccggagacattattacctctaaatcctatacaatcggttatttgacccagaatcccgagttggatgatcgtttatcaatcatggatgctgttttctccggatcccaaaaggtttaccaaactatccgaaattatgaatctgccttggataaatattcaaagcatccggaagatcaggatgccttgaagcggtttacgaaggccgaagccaagatgaacgaagacgatgcctggaatgcacaaaatgatgttgaaacaattttaagtcaattaaaaattaccgactatcagcaaaaagtcgctgaactttcagggggtcagcgccgcagagtgggcttggcacaagtgcttatccagtcacctgatctgttgttacttgatgaaccaaccaaccatctggattttgattcaattgaatggctggaaaagtatttagccggttacaagggtgcactgattgttgttacccatgaccgctactttctcgatcgggttgcaaataaaatctgggaactttcttttggcaagctctatcaatacgaaggaaattaccaagattatgttgaacaaaaggcaactcgtgtgcagggcgctattgaatcgcaacacaaaacgcaacaattatataaatctgaactggcctggatgaaaacaggagccaaagcgcgctcaaccaagcagcaggcccggattaaccgatttaacgatttaaagaaaaacgttaatacgcttcaagttgatcaggatgttgatatttctctgggtcaaacccgacttggcaaggaagttattaacattaaagatgctgacctggctatcgataaccaaactatcttaaagaactttaatttgttggttcaaccaaatgaacgaatcgggatcagcggggaaaacggtgccggtaaaacgacacttttaaacgtgattgcaggacgaaaaaaattggattcgggtattattaaaattggtgaaacggttaaactagcttattatacacaactgaccgaaccaattccggatgataaacgaatgatcacctatctaagcgaagttggtcaacaagtgaccgataaaaacggtcagaaaataagtgtggccgaacttttggaacaatttctttttccaagatttatgcacggtacgctgattcgtaaattgtccggtggtgaaaaacggcgcttgtatttattgaagttactgatgcaacaacctaatgttttgttgctagatgagccgacaaatgatttagatattgccaccttaacggttttggaagattatatttctaaatttcaaggaaccgttatcaccgtttcccatgatcgctacttcttggataaagttgcggatcgcttattaatctttaagggaaacggtgtaattgaagaacaccggggccggtttacggattatctaaaggctgaggaagctcagtctgtaaaacaaacaactgaaaaaaatcgcgccaaaaagaaatcatcccctcaggcaactgagcagcaggaacaagcaagtcagtcaaaaaagaaaaaactcacttatgcagaagaaatcgaatattcccatctcgaagatgatattgataaattagaatctcaaaagtcttccgttgatgagcaaatgcaacaaagtggtgatgactacgataagttggctgatttacaacagaaaaaagacgatctggattcacaaattgacaaaaaaatgaaacgttgggaatatttaagcgattacgctgaatcataatctgaggaggacatcatgatgttggaagatgcttatttaaacttagaaaaatatgttcttgaaaacggccataagaagcctgaccgaacccataccgggacaattagtacatttggataccaaatgcggttcgacctttcaaagggatttccgttactaacaaccaaaaaagtcccttttgggttaattaaaagcgaattattgtggtttttgcgtggcgatacaaatatcaaatttttgttgcagcataagaatcatatttgggatgaatgggcttttgaaaaatatgttaagtccaatgattatactggcccggacatgactaacttttcccatcgtgcacaggaagatcctgattttaataacctttatcaggaacaaaagaagcgcttttgtcaattggtgctcgacgatgatacctttgctcaaaaatatggagacctgggattggtatacggcagtcaatggcgggcttggaaaacgtcgaccggtgaaacaatcgatcaaatccaaaacgtgatcgatatgattaaaacccatccagactccagacgcctcattgtgtctgcctggaatccggaagatgtgccgactatggcattgccaccctgtcacacaatgtttcaattctacgttaacgatggcaaactcagttgtcagttgtatcagcgttccggtgatattttccttggagtaccatttaatattgccagctatgcccttttaacatctttaattgcccgtgaatgtcatttacaacccggtgagtttgttcatacgcttggtgacgcacacatctatttgaatcatgttgaacaggtaaaggagcaattgagtcgaaagccccacgatgcacctcaactgtggttgaatccagaaaagaaacacttaagtgattttaatatgaccgatatcaaagtaaaaaactatgacccttatccatcaatcaaagccccggttgccgtttaagactgtagtgggctaatcattttaaaagtcggaggaaagcaatgatctcttatatttgggcggaagatgaaaacggcttaataggtgcgtcaggtaatttaccgtggcatttacctgatgacatggcattctttaaaaaaacgacgatgggtcacccaattatttccggcgcccgtacttttcgaagttataatcggccgctaccggggaggcaaaatattgtcctttcccgtcatggggactttccagatggggtattggttatttcgtcagtagaacagctctgtgaattagttgacaagaatccgaaggaaaattattttgtcacaggaggggcgaacctatttggccagttactggataaggccgatcgactttacagaacaaagattcatcatcaatttacaggtgacacctatatgcccgaaatcaagtatgcccagtttaatcaactgacatcaattgacggcatcgttgatgaaaggaaccgctacccacacacatttgaagtatttgagcggattcgatagtagtcatttctgcaaaggctatgtttgttttggagaaactttgatataattgtagctggttaatttcaaaattttagataattatttgaagaaacgagtggcgctaatggcaaacgtgaagattgtaacagattcgtccgcgcagcttacagacgatgaaataagtaaatatggcattaccgttgttccattaactgtgatgattgataatacagtttatgtggaacgcgatacaattaataatgaaacttttgttcccaagatgttggccgcaaaggatttacctaaaaccagtcagccaccagttggcaaatttgttgaaactttcaataaacttggcgaagatggcagtcaaatcttatgtcttaatatgctcgaggcaattagcggcactatccatgctgctgaacaagcagcaacaattagtacaagcgatgtaacggttgtcgatagccaaagtacggacagggggttggccttccaagtccttgaagcagccgaactggcccaacaaggtgccgacatgcaaactattcttaataagattgcaaaagtccgcgaaaacaccagactgtatttgtgtgtgatgacattggacaatattgttaagggtggtcgtcttcatcctgttgcgggagcaattaccaattttttgaacattaagttagggcttcaggtgaccggcggcaaactgaaaatcgtttccaagggtcggggagataaatctctccgtaagttcttcggacgaattttggaagatatgaagaatacacctgcactaaagaaaattggtatttcctatgtaactgaaaccaatgtgctcaaagagaccatgactaaacttaaagaagagtttccagatgttcctcttttatatcgggtaacttcaccgatcatctcgacacatacgggtgaaggtgcttttgcattgatctattatagtgatcctgattaaaacagatttggtagtgctgaagggctgggacaaaactgatattgttttgtcaacaaccctttttgtgttagtgtgtgtaaagtgtagaaaggtagtcaagcaggtgattgattgaaacatcaaaagaaacggtcaaaaagtaaactgattatttggagtatcctaattttaattttcgttacagtaggtggtttttgggcggttggtcattttgactccaaacagccgactaaacccaaaacagtccggctcacagcgattggtgattcgctaacatatggtgtgggtgatccttccggtaagggtggttatacaaacttaattcgaaaaaaagtgaaccgaagccagcacaatgttgttatgacgacctcaaactttggcatttcaggtgaaacaaccgatcaaattaatcatcgggtcatcacatcgaaaaaattgcaggccagtattaaacaggctgatgtcattacagttactaccggtggaaacgatatgttgcactttttaaagggtaacattggtatccaaaacgataaattactgtctcaacagctcaaaaaatattcgttggtttatcaaaagcgggtgacgagattgctggagagtatacgtcatttaaacaagcacgttcagttgtttgtcttcggaatttataatccggtttacgtttacttcccacaggtatcgtttattagtcggtctattcaggtcaataatcagatcactaaacgggtcgttttgggtcaatccaacgttcattttattccaatcgacaaaaagctttcagatggccagtatcaaactgcccagtccaggacaaaattaagaaaacaggcaaccgtatttaatcatagtgatatggctgccggagagctggaaaaaatgttgggtggtcaatcaaccgaatcaaataaatatctttctgacgaagatcattttcatcctaataaactcggctacgggattatgactaatttactgtataaagaaatgcgccaatatcttaattggcttaaggagtgattaacatcaacaatcaacgaaccggtcatcaaccaaagagaagaaacccttggaaaatggcctttttcactatcattggattaattgtcattggcttttgcggcttttttattgccattcacttatcctctaatgaaaccatttcaaccaaacaaccaacaacgtctgatgaacggtcggtttcagtttcgttgaataaagcccagttaaataatttgtctcagtattatttaaataaagttcaaactcaaaataatgggcaagccaaatatcatttcgaagttgctaatcaagggattgtttacggttcaattaaattattgggatcagacgtcgactactccatgttttttacaccaaaagttttggctaatgggaatgtggaattacatgccacgaaaatgtcactgggaaaattcccagtaccaatcagttttgttctccttaatgttaaacatgcctataaattgcccaaatgggtcaaactgattcctgataagaaaatgatcaagcttgatatcgttcatatgaatggcaaccgtggtttgaattatcgtgctcgacagatcaacttaaacggacaaggaaaattcgcttttgacatcattttgccaaaggaagctcaaggtgactaatatgctaaaaactttttatcaatttttaatgaccaagcgtaatccaggcagcagtgaaccaattgcggaatttgcaaacaacgcattttatgatcaatcctttccaaagcagttgactgattttgatgccttatcaaaatatctcgaagaaaatgctgattacctgccaagtatggaaattttcgatgacgtttggaaacaatacgaggaagatatgtaaaggaagtgacaatatggctgttacaatccagtggtttcccggacatatggcaaaagccattcgacaattcgaagaaaatatcggcttggttgatattgttttcgaaattatcgatgctcgaattccatatgcgtcacaaaacccggaagttgccagaattaccggtgaaaaaccgcatcttttcattttaaccaaaaaagatttagcggatccgcgattaacgcaacgctggctggattcctttaaatcaaaaggacaaccggcaattgcagtagatgcaaaaacaaaatttaatattggaaatgtgctatcagtcatttcaccgctattaagtgaaaagttggctcgagaggaacaaaggggcatgaaaaaacgtccaattcgtgcaattagcgtaggcgttcctaacgttggaaaatctactgtacttaatcgcttggttaataggcgcgccgctcaagtcggtaatcgcccgggcgttaccaaaggccaacaatggttgaaggctggaaaagaacttgagctgctagatactcccggaattctctggcctaaattcgaaagccaggaaatagcaaacaaattagcactgacaggcgctattaaagacagcgtctttgccagtgatgacatcgccttatttgggttaaatcattttcgggaaacaaatccgggccaattaaaagaacgctaccgactttcagacagcgactttgatttatctgatgtcgatttattacttgccattaccgaaaaaatcggcatgcgtgatgattatgaacgggcatccaatcgcatcatccaagatatccgaggcaataaacttggacgatttactctggataatccggaggaagttaatcaaaatgacgaaacaaaccattaatcagattaaagaaaagctggcattgatcaatgatttggatgacactgtatttaaaacgctttcagatgatccacgaaagggcgttcaacatttgcttcagacggccactgctcggatcaaaaaaaggcaattggaaaaagctgaatttcaaagtcgttttaaatacgaacggtctttctggcaccgtggtgttaactatgttgccggtgtggacgaagtaggacgtggtcccttagctggtcccgttgtagcctgtgcaactattctgcctcgagattttgatttgattcaggtcaatgactccaagcagttaacacccgaaataagggcacgactggcgccccaaattaagcgggaagcaatcagcattggtcttggactagttgataacaaagggatcgataggttaaatatttatgaagcgacacgggttgcgatgaaacaggccgttaataatctaactcaacaaccggacgagattattgtagatgccatgcaaattgctgttccgattcatcaaacccggttgattaaaggggatgccaaaagcatcagtgtttcagctgccagtatcgttgcaaaagtctatcgggataccttaatggaccaatatgcacaacagtatccggaatatgactttaaacataatgcaggatatggaacagctaaacatttatccgccttaaaaaaatacggtgcgaccccaattcatcgaaaaacatttgcgcccgttaaaaatttcttgtagataagtcttctttttttgcgtaagtattcttaaaagggatggaatatgatgtttttaagagactttttattaagaattcacttgtgtaatggaattggaattgtcggtaaatcaaaaatttatgattggattcaatcacagaaatcagctcgttttgacgtaccatctgttgactcattaattaaaattgccaatattcgtgggaaaaatgtcacacgcttttcatcaacctacatacaattaatgaaccattcggatagggttgatcaacttgttgattctgaaaaatggctgtgcatctgtgatgaacactacccttatcaattaaaagaagcttatacaccgcccctggtgatgttttatagaggggacttaaaccttctaagtgagcagatgcttggcattgtaggcgcaagagacgcgacacactattccatggagattttgaaacagttactcccgggaccgcttttaaacaaattggtcattgtttctggattggcgaagggtgtcgatacttgggcacaccagtgcgccatcgccaatcatggtcgaacaattgccgtgatcggtacaggactaaacatcgcttatccaagtatgaatcaacagctgcagcaacaaattgcagaggaacaattgcttcttagcgaatacccaaatggcagtcgtggttataagaatcattttccggagcgaaacagaattatcgcgggattggttgagagtgttctcgttaccgaagcgaaacaccattccggaagtttaatcaccgcaaatttagcactccaaaataatcgaaatgtcttagcagttccaggccggatcaatcattatttatccgcgggtaccaacgaattaattgctgcaggggccaaaccaattttacagtcaaatgatgttttggaagaatatattagttgacacaagaaaacacttgcaatatgatgtggtagatttgaactcagaaataataacaaaaaagtctactataatttatccggaaagaaaggagaaaaaatggctacttcaacaaaatcaaaacctaaagcaaagccaaaagtaaaagctagggcaaaacgacgtttaccaaaaaagaatttggtgattgttgagtccccagctaaagcccgtaccattgaaaaatatttgggccattcttataaagtcgttgccagtaagggacacgttcgtgacttaccaaagagtaaaatgggcgttgacattgagaacgattatgaaccacattatatttcaattcgtggaaagggcgacactattaaagaattgcggtcagctgccaagaaagcaaaaaaagtttatctggcggccgatccggatcgtgagggtgaatcgattgcgtggcatttgtcacatattcttgatcttgacccaaacgatgataatcgtgtggtctttcatgaaattaccaaagatgccgttaaagaatcgttcaaacatccgagaaatattgatatggacttggttgacgcccaacaagcccgtcgaattttggatcgactagttggatattcaatttcaccacttctctggcaaaaagtgaagaaaggtctgagtgctggacgggttcagtcaattgcactttggctgattattaaacgagaaaaagaaattgaaaactttaaacctcaagaatactggtcaattgattctgaatttaaaaagggacgcagtaaattcaaagccagtttctacggaataaaaggaaaaaagaaggacctaccgaacaacgatgcggttcaggacattttaaaacaacttgatccaaaagccgacttcgatatcacaaaagtcgttcgtcgtgagcgtaaacgtcaaccacagccaccatttacaaccagtacattgcaacaggaagccaacagaaaactaaattatcggactcgaaagacaatgatggcagcgcaacaattatatgagggcattaacattggtaaggaaggcagtcagggactgattacctatatgcgaaccgattcaactcgtatcgcaacgattgccaaacatgaagcatcaactttcctgcatgaaaagtacggagcagaatatgcggctaccaaaccaattaaaggaaagcttccggaaggtgcccaggatgcccacgaagcgatccgaccaacgtccgtttttcgaacacctcaaagccttaagcaatatcttacaagagatcagttcagactttatcaactcatttggtcaagatttgttgccagccaaatgacgccagcattgatggatacgatggcagtcacaattgaacaaaataatgtgacatataaagctaatggatccaaaatgaaatttgacggattcttgaaaatctatggtgatggaaaagaaaaggataatcttcttccagacttggaaaccggcgataaagtcaagctgatttctaataaaccggaccaacattttacacaaccaccagcccgcttcagtgaagcaacgttaatcaaagcgttggaagaaaacggtgtgggtcggccatcaacgtattcaccaacgttggaaaccattcaacgtcgatattacgttaaactggttggccgccgttttgagccaactgaactcggagaaattgttaacaagattattgttgaatacttcccggatattgttaacattgactttacagctaatttagaagataaattagatgacgtcgaagagggcaaagaaaattggattcgtcttgttgacacattttacaaaccattttccagcgaggttgaatctgcaactgaaaatatggaaaaggttcagataaaggacgaacctgccggctttaattgtgacatttgtggtgcaccaatggtcattaagatggggcgttatggtaagttttatgcttgctcacgctttccggactgccgcaacacaaaagcgatcgttaaaaagattggggtcacctgtccaaaatgtcatattggtgaagtcattgagcgtaaatcaaagaagaatagaatcttctatggttgctcacgtttcccagactgtgactttgtttcatgggacaaaccaattggcaggaactgtccaaaagatggtcatttcttagtcgaaaagaaagttaaaggcggcacccaagttgtctgcccaaatggcgactatgaagaacccgcacaaaaatagtgaatagtgagtaaaaggaagttgaggcgatgtaaattgcccagcttccttttgtttacccgtatatttttgattgcgccaaaaacatggatgcctcatacttgtcaatatgttgtaaaatcaagttaagataaagttaggaggaaaattatggatcatacaactcatagtacctgcacgactattttggtgggtaagaatgccagttacgatggctcaaccattattgccagaaatgaagacgcgggcgtcgcagtcaatcctaaaaagttcgttgtcgttcaacctgaagatcagccaagaaattatcaatcaaagctcagcaaattttcgattaagctaccggataatccggtgcgctatacatctgtaccggatgctactccggaaaaagggatttggggtgaagccggcgtaaatgcacataatgttgcaatgagtgcgaccgaaacgattacaacaaatccgagaattttaggggcggacccactcgttaaaaatgggttgggtgaagaagacttgttaaccattactctgccttatatcaaatctgcaaaagcaggtgtagaacgtgtcggtagtctcttggagaagtacggtacttacgaatccaacgggattatcttttcagacgtaaatgacatttggtatatggaaacagcaggtggccatcattgggtcgctcaacggattccggatgacagttatgtgattgcgccaaatcaaaccggtattcaagaaattgattttgacgatccggatcattttatgtatgcaagtgacttaaaaaactttgtggaacaacatcatttaaatctctcggataattttaatttccgaaaaatctttggatcagatacccaacttgatcaccattacaacacgccccgagcctggtacggccaacgatactttaaccctgaaacggtaaaagacaaatccccaatgagtcatgatctatcatttatatgccatgcaaatcgaaaaatcacgattgaaaatatcaaattcgttttaagctcacattaccaagatacgccatatgatccctttacgcctggaaacgattctcaaaagatgccgttccgaccaatcggctttaatcgaaatcaggaattatctgttattcaattgcggccatatgtaccatcagactattcagcaattcaatggctggcatttgcggctaacccgtcaaatacattggtcccgttcttcacaaacgtgcaagatacgccggattgctatcgagacacaacaaaaatagtggacagccaaaatgcctactgggtgaatcggctgatttcattaattgccgcggaccattatcatgcagtgatggatgatatcgaagcttaccaagatcaattaatgggttatggtcataagcgaattacccatattgataacaaagttgagggactatcaggttccaaactgactgcttctcttcaggccgcaaatgaaaagacggccgatcatgttgttaaagcaaccagaaaattgcttacaacaatgctgacaaagaccagtaatggtgtcgctggttcgtttgatcgaaaacattattaatcaacaaaaaaacacgagttacccgagaaattgtcgggcactcgtgtttttattaagaagctgtccaagatctatgatttttgatatacttctatgtaaaaagcgagtttaagctatgaaaaattatcccagcaatattactcggcaacaatttgaattaattcgaccagctttagaa

SEQ ID NO: 438 - DNA, 98844 bp, Unknown
  Metagenome-assembled genome
tttgaccattatcgaactaggattcaaatggaattatttgcttaattcaattaatgcaaaagaaaaagcaaatcctttcggatttgctatataagctgatatcaacctcagttgacaaagagcctatttttaatgaataggcatttagttgacgggctcattttttaaataaaaaaataacacatcccacgcctacgacaagtttgggatgtgttatctataaaaaatggagtaaatctactgagtgggtagattcacaattagcattataaagcaatcggttggacgacgcaatcatcatcactggttactagtggcttgctgattttgtttaacgattttgaaatttggctttcgcgtataatggcggaaccctttatagaaataaagatttttcttatcaggcgcttttactttgtaggataggcgttggccgtcaaattgaacggaggcaccctttggtgagtattgaataccggttatgagataaatgtgatgatgaagcgccttatatttaatatgttttaatccgtatcccggtaatttatagtagccgaggttattatcggactgtttaaacagctcgcctgaactcattgttttggtataggtgataaatgccttttgctctccagatccgttgtagtaccagtttcctctgataacttttggggtaccggtatgccaagtagctgcgtcggcattggcacttttcgttaatgcaaaaataaataagcagataatcataaagggcaaaattaattttcgaactttcattaaataacctccggtaataaaaaatcccattatggtttttgggatagtgattgtttagttgcattataatcatattcaagattgtattaaaaaacttcagtaaaacaattgtaccattttttttaattataggaaacttcatcaaaatgactattaaacgcgccttaaatttagtcttttaatgatttggcatggcgaagcctgtcaaaaattaattgatcattaaggagtagatggatgctgtaagcatcggaaatagtaaacaggctatctagttactatcatacgaagatcattggtctagcttagggtctgtcttaaaacaagctttttagccaaagttccggtataatctggttaaaaaacaagaaatgaggaatcaccgcatgactaagcctccattaaccactaatcgacacgccatctctgatgaaaagtggcagcaaattgaaaagctctttcccgcctataccactggtcgaccacccaagttaagtaatcgagcggctttaaatgccgtgctctggcaactcaaggtcggctcaccctggcgagacttgcctaccgagtttggttcttggaaaaccgtttatagccggttccgaaagtggacggatagtggtctcttcgaacagatcttcaaaatcatttgtgaggacgacgatcccgacatggagaatgtcagcttggactcgacgaccattcgggtccatcaaaagggcactggggctcaaaaaaatcccgctgcacactagaaaatcaagcgatcggccgcagtgccgggggcctcacgaccaaaattcatgtcgtcgttgatggcctggggaacccgctcaaaatgatcctcacgggtggtcaagttcacgacagtcaagttgcgcaacccttaatcagtcagttaaaaattgccggcgtcaatgtgattgcggataaagcctatggcagtgaggcttttcgccaatacttggaagctgaggaaggcacctataccattccgcccaagagtaacgctaaagagaaatggccggtggactactacgtgtatcgtgaacggcacttaattgaaaacttcttcaatcaactgaagaacttctggcgaattgcgacccgctatgacaagttagctcacgtttatttagaacgcgtttacttggcggcgattctgattcgcctgaaataaagttttcagacggaccctagttaaccgagtagatttgcaagatgactttatgcttttatgatatcatttaattataaggtaatggtttaataatttattaaagcaatgatgggagagatagccatgctttcatggagtatgttatgggccttgttaccacttgtggtaggctttttgtttagacgtggtcatttacttttcttaatagctggaaataatgcagcaagaaaaccctatagcaaagaatccttattagccggaaggtatgtcggcttatttatgtatgcgggcgccattttgatcatcttagtattcattcctaacataccggatggcttttattatgtatttgcagtattatttattgctttattgatcagcatcatcatttatttaaacaaacgtattaacaaaatgcaaaagtaatgatttccagagcataatcaaaaagatgttacttaaaaagtcccgtaaaatagtgtataaagcactgatttgacgggatttttatttcaaaaataagctagtttagagattctattattgtccaaccctcaaaaaattaaacaaatgaataaaggaagggcgggtgttattgattcttattaaatctaatcctgtctttttcggaaggtatctgactataaacagttttccaagtatcattttgatagatttgatacttttcgaaaaaacacgggattccgttagcattttttaaatcactgctgtccatgacttgaaagtgtaggtgaggggatgtggaatttcctgaatgaccaactttgcctaaaaaagaaccctttggtattttttcatttaatgaaacagcaatagagtctgtttgtaagtgaacaaaagccatgtatacattttctgagcactttataataataaaattgccagcaattatactaaaatcatctgtctcttcattaaaagtaagggatttctttatgccgataatggactctcgtaaccaatgaacatgttttctttcaggaataccatcaattttcgcaacaatctcaccatcacatggtgcataaatatcccttccataacagtaacatttcttaaggggcacccctaagattaaaaatctgaaagtacttgcatcataaaacttattcatattgttttgatcaacctgcaaaaaatcaaaagcatattttaagcccatgcgattagtaccatggctcggaatacgtttagcaggagtggtgggagcgacccattcgccccttaatggaaactcaatagtaacagcatttttcttcataatttaccccacctttaaaaaatactgagatagttattttggaatcgaaatcaatagaataattgttatattaattttaacatgattataggctaagataaaaggttgatccccaacttcttatctagtgacctcagttaaagagattatcttcaaatcattctttgctaatctattttagcaacagaatatcacgtaaaataagacttgatattttttatgattcaagtctgattatgtatattgatttttttagtcgctgtattttctgatagttggtttaatcatttattgtagattcgttgcttgttatagaagctggtctaatagcttagaagacaatggctagcttacttttaattttgaaataactttattgattttaaaaagttaatttatccgctgtgatcactcgaaagttatttgcattgatagtaattctaatgttagatgtataatcgtatatgtaataattttttcccttatggtctaatttatcagcctctaacacggttttctttactagattttcgatatcgttattcgaataatttatacctagttttttattaatccttttgtatacaaggtcggtatagcaaaccctttgtaatatgttctttttcgatgtcaataatactgtcctctcaattttggtaataacaacgttaaattagtagccggatttttaacctttttggggtgtatattctatctaaaaaggtattcctaaataaggagtgtagatcaattcacgactattgtataaattctatcttaaaaagatataagtggttagcagtggttgtatgtaacttgctgtgagtcagcattaagaagaattaaaatttcgtgatttcagtattttcaatattaaaagtatcggatcttttagtatgggtttggtgtgacttttgagctaattagtgtccctgtaattttaaaatatacataaaaaataaatttagaagtacaataattagatatgccgtgcctatcttaattccaaataaattgtaaaatgaaatacttccaactccataaacgaagatttctaacataaataaatttgttaaaaccagttaaggcatgaaatgacttgggcgcaccataacgtgcccacaacgtcataactcttatacttatcacgaaaaatattatcttggaagtgagtgccttttttaagcacatttgattaaactgcttatttaaaaagatgtagcccaattagcgactagcacatagattttgtaataaaaagatatatggctaccagtggttattaaaatggttaccattagctacgtgtaaatcgttttgaattaatattaaaaaataaaaggcctgctatttcagtgctttcagcattaaaaataacagaccttttagtattatagattgggtatactgggctcgaaccagtaaattacggattcagagtccgctgccttaccaatttggcgaatacccaatgaacaaatatcacagttaataatattatcgattttttactgatttgtcaaccgattttttgatttttaacttctctgttgacaaattaactagatttagatacactattatttgtgagtttgagagcattgcccgctggtcaaactggtttaagacgtcgccctctcaaggcggagttacgggttcgagccccgtgcgggtgataaattgaaataatcaatgaatctaagaggtcgccaaatgctgcttatcagtattggtgatctctttctttttgggacccactaggttggtcattgcattgcccgccgtttaactaaatatgcttttaaattaagcaatgtaaaaaacaacagtccaccttcaattttgaatgtggctgttgtttttgaggctgtctagttgtttaccaataccccagtatctctgctagtttggcccgatcaacatctcttgatgtcagggtagcagaagtatacgccattgcatctgaaggatcctttgcctgagtccaagcatacttgacaggacttggggttgcgtcttgttcatcgcttgatgatgcgaacatgacgtcactttggtaaggagtatgatataagccaagcccatgaccaagttcatgcataataacggttgtccagtaattggttgttgaagcttgagaaatagcaggctgttcctgtacataagcatctttaactgcttggcgcagtgcagacacttgggagtcataattttgacgaattgctttgtcttggttttcataattcgtcgctaaatcacttatttgcttttggatggttgatttggttgaagcgctggaggaattgttatacttgctttccagtgttaaatattgtagttgataattaattcttaatttgttaagtagggtattggttaagtccaataagctggaagcttgatttgaaatgtcagttagttttgcttccaacgtcgatgaagttgctagattattatttgcataatttggatttgtaaaatttttcgagttaatttcaatgatatgaccactgaaaagaccatcccatttttctgttgaagcatcggtaagtttaacggtcagtgtatggttggacgaacttccgatcgaaaaaacatttttgcccaaagcagcattccaacgttcgatagctgtgttaacgtatgaatttaaccgattatctgcaacgtaaattttagcgtgattgtctttaaaaacaccagatgacgcaaactgtgccagattgtactgttggcttagtgtcgtcttatattttgaataaacgtcagtttcaaatccaaggatggttaagtttggatcaagatccggtgctgcgttgatatacgacatcagttgagattgcgaggacacggttgccccaataactgaattagaagaattgattttactgggaattcttttcaaatagtttcgccaaacccacccggaggctttctttccagaattacttttgacgtaatagtaaatccgatactgattattaacttttaatttttgatggtaataagcggtgaaggttttgtgactataatttgaaagtttaaaaacttttttacccaatttggccgagtaagcatacccattcttggctttagattgattaatcgtgtaaaaggagcgtgtcatcttttgacgccagacgacttttacagacgattttgcctgagcatttggttggttattcattaggaatcccgcagaaaaagcgaatgccgtgagtaacacacctgggaaaaatttcttacttaccttcattttcagattgcctccaaagtagttggttttattgtcttaaccaatcaacggaataggtgattggcttgttaaataataacaaaaaaatctcgaagtacaaacaattgtacacgcagtaattataacgcgagatagttaaggatgctaaagaatgcaagtcgttaatcatttacctgcttcatagtagtggttgctaatcgtttttaaatctgacacatccagttgtttaggatttatttttctaattgtagactggcgataagatgcttttaacaacatttttgcttttccgtgattagttgtgaaagctaatttaaaggtctgatttttttgatagtcggaattcttaatcgttttgagtaaatcgacggtggtgagtttgaaagaatcaatcgtatctttgtcattacggatgatgtttaaataattaccccgagttgaaatcgaaaaggatgtttaaataacaaagtagttgatttcaatttacttcttacccgaagcgtcgtgtttttataatggccgttggaaggctgctgagaggaagaggcggtttgctttttaacgcccctttggataacgccttttccttttggagagttaaaaaagagtgttccaaaaatcacaccagcaataaggaaacgagcgcatatctaccataagggtattttttcagctttttggcgatcttgctataagcaaatagtgccaaaaaatcaccatggtatatgacgatagttttgtaataacatcaagcaactgactaatcaagctgaattctccttacaaaatttgatatgaaacaagttaacgatgcattaacttttattgtataggagacgcttgttatttgctagatgcaaagtaacatctcgaggttaaataaaggccgactcaatacaaaaaacgtgtcgagtcggtctttatttcttgaagcagctccatcaaggctacaatcgaaattgaaattgtgcaaacctacaaaaataatcatgaaccaggtattgacttgatctgattttatttttagctgtttcaacgttattattcaaatgatagatcaattaaatatttatttctgtttgccagatgagatgttgtaatccacaagtcgtgataactgctatcttttacggcagttttatcatggaaataatcgagtagatcactgttcatggacacgaagtcgggagccatacggtttacttccaaacgctgggttggaaaatagatttctggatttcccaattttacatcatcatctaaatacatttcaacaacattgtcatatttatcagggcgaatggttgccttggcaggatgcgccttaatgtatgataaaacgtggtaaattgtatcggaattgcttgccaacagccaaatcctccaatcattaaaaactctcactcaagaacaattataccaaaaaaatggtgactggattgacaaaggtgacttatctaaaaagcaagcgcattcatgtcgaacaaatacaacgcttaattgcttcaaattacagttaacttagggctataattgattgaatgagttattatttttttagaaaacatgcctagtgggggacaccatgcaaaaagaaataaaagttaattttatacttttccaggagttctacgaggagtgtgaaagcaattgttaaagttaatgaagagtagagtttcctatcttgctgtttttggggcagttgtttttttgctgcttcaagtttcgagtgacctttatttgccgaccgtaacctcaaacgtgattgataaggggattgctcaaaataacattggctatatttggagtgagggcttcaaaatgcttttcgtttcattctgtggtgttttggcagcaggcgggaatatcttttttgccgctacacaatcaatgaaaatgggtcaacacatcagagatgatatgtttcaaaagatcaccaggttttctcaagaggacatggatcattttggtgcggcttcattggacacaagaacgacaaatgatgttgttcaaattcaaaatgtcatggtacagattctgcggatgatgctaatggcaccgctgatgctgcttggtgcatcagtcatgtcatatgtgaagagtcccgatctaaccacgatttttatcatctgtttgccattggttgctctgatagtcggaggattgatgtattatgtcgttcctctctttaaaacgatgcaaaagaaaacggatcgcattaatttaatctttggcgaagcgttgggcggtgtccgtacgattcgttcttttaaccgtgatgattatgaaaatcagcgctttgatgccgctaataaagactttgcaaaaactggtattaaggcctttacaattgtgtcatttattattccaatcattacgatcatcttcagctttattaatgtagcaatcgtttggttcggtgccgacatgatttccaatcggacgttggcggttggaaacctggttgcttttatgacatattccggtcaaatcctctttagttttatgatgctttcaatgatttttgtctttttgccaagagcatcggcatcagctgccagaattatcgaagttttggaagtgaaagatacgattacagatcccgatacgccacaaccgcttagtcatcatgaagctgaaccgtcgttagaatttgacaacgtttattttcggtattcatctgctgaacaacaaacgttacaaaatgtcagttttaaagttcatggtggtcaaacattagctattattggtggtaccggatcggggaaatcaacgctgatcaatctgattccaaggctcattgaacctgagaaaggaatggtcaaggtcaatgggtttgaaattgataaactaacacaacatgatttgcattcactcatttcgattaatcagcaaaaagcggttctcttctctggaacggttcgtgaaaacatgttatatgggaagcaggatgcaactgatgatgacatctggcacgctctggaagtggcacaggcgactgaattcattacacaagataatggcggccttgatgcccacgttgatcagaatggtgataactattcgggtggtcaaaaacaacgtcttgcaattgcccggacaattttaaaaccggcggatatttatatctttgatgattcattttctgctttggattttgaaacagatgcaaaattacggatggcactaagaacggacaagcagattcaaagggccattacagttattgtggcacagcggatctctacagtcgcggatgcagacctaattctgattttggataattgtcaagttgtcggagagggatcccacaaacaattagcggcttcgaattcggtttatcaagacatcttgagatctcaaattggagagcaggggggaattaacaatgcgaacaccaccagttagaggacccgtcaccaagccacacgacttttggcatacgaccagacggctgatcagctatacaagacggtggattccagggattgttttagcaattctaatggcaattggcggcgtcattatggacattgtttctccgaaggttcttggaagtgcaacgacggttgtttttgatggtgttattgccggtatgcgaaaagtaaatgctggtatgaccgttcgttcatttccaatcgattttaaaaagattgtgtcaatcttaatgatcgtagtctttctctatgtcttatccggtatttttcaacttgttcagcaggttgtgatgactcgaatttctcaaagcattgtttatcaaatgagaaaggatctcaaagctaaaattaccagactgcctgtatcattttacgatgggcattcaaagggtgatatcctttcaagagctgttaatgatatggataatattaatacaatgcttcaatccagtttgacacaattaattaccagtttctttatgttctttggcgttttgtttatgatgttgaccatttcatggaagttgacgcttgtggctttgctgactttgccgctcagcatactggtcgtgagcttctttgcgccaaaatcacaaacctttttcagagcgcagcaacatgaattgggcgttttaaatggccaagtagaagagtcgtataatgggcacaacgtcattaagacatttaatcgggaagaggatgcgattaaagaatttaaagaaaaaaatggtcgttactttcaagcctcgtggaaggcacagtttgtttcaagtttcatgtttccgatgatgaacctgattaaaaatttggattacgtctttgttgcggttatcggtggtattcaagtcacacaaggggcagtgacgctaggaaatgttcaagcatttttgcagtatacaaatatgttttcacagcccattacccgcttagcaaacctgaccaatacgattcaatcaacaatcgcgtcggcagaacggatttttgagatctttgacgaacctgaaatggattttgaaccaggacattttccgattgttaaaagtgataagaacgaagtgacttttgataaggtcgatttctcatatgttcctgatcaatccttgattcaaaactttaatttgaacgtcgttcctggacaaaagattgctatcgtaggaccaaccggtgctggaaaaagtacgattattaatctcttggaacgtttttacgaggtcaacgatgggtcaattcggatgaaaggtgaagatattcgaaacaagccacgttccgaaattagaaaacgcatggcaatggttcttcaggagtcttggctttttaacggtacgatttttgataatattaaatatggccgattttcagcaacaaaagatgaagtcattgaagctgcaaaggccgcgcacgcagacttatttattcgggaattgccggatggctatgataccattttaaatgaggatgcgacaaacatttcccaaggtcaacgacaattactcaccattgcgcgtgttttcttagccgatccggaaattattattttagatgaagcaacatcttcagtggacacccgaaccgagaagctcatccaagcagcaatggacaaactggctgaacagcggacaagttttgtggttgcacacaggctttcaacaattaaaaatgctgataaaatagtggtaatgaatcaaggccaaattgttgaaaccggcaatcatgaacaattaatggctaaaaatggcttctatgcaaacctgtacaatgctcaattcatcgggaatacattattgagtcattaattttagagagaaaagggtattgataaatgaaatatgccgatactattaaagaaatgcaccaatttgtagacaataatgttgtgcctggcgttacttatggcattattgatcagtcagccattatgagcgattattttggcgatcaggaattggtacctcaaaagctgtcacttaaacctcaggaattttatgatttggcatcattaactaaagtgatcggaacgacgaatctaattttaaaactgttggcggccaatcaattatctctggatgattcgatcagccaatatttaccagagtggcagtcgccacaggttacaattcggcatcttctgactcatacttctgatattgttggttatattccgaatcgaaatagcttacctaaggatcaactcattcctgcattattaagtttaaaaagtggtccggatcttggaaaggtcgttcattatcaggattataattttatttttcttggctggatcgcctcacagattctcggtaagcctgtccaacaactcatctctgaagatgtattaaaacctttggaaatgaccaacgccacttttcatcctaagcatattgaagatgttgtgcccacagctgaattacctaacggtgggctcctaagaggaacggtccatgatcctaaaaccagaattttaggagccgattgtggagcagcaggcttattttcaccgcttcaggatctgcttcacttttctaggtggcttctgggtcaaatctcatacccggattttttgccgaatgagtggctcgatcaattattcgttgatcaaacgccaggccatttaaaaaatcgttcttttgggtggatcttaagaagttatcaaaaccatccctatattttgcatacgggttacacagggacactagtcgtgattgatcggatttcccaacaggcactggtctttttaacgaatcgagttcatcctgatgcttcaaataaacaatttttgccgtatcgaagcaatttaattcgaaccttcataagggaagccaatcaatagaaagaaaattgcagattctaaaagaaatccgactaaatctgatgattaaatcagtatttagccgggtttcttttgattgtgctagtttgatttacttaatgattagaaggtactgccgacctttacctgttcggcttgccccaaatttgcgtctggatatttacgctttaaggcatttatcaagacgtgtttggcgatatcgttatttctagctaaaattggaccgtgaaaataggtgcagtaaacgtttttgtaaatggcgccttctgttttatcttggccgttgtttccatgaccctccaaaacttttccaagaggtcgttcacttttgccaaggaacgtaatcccctgatggttttcaaagccgtggtacttctcaccggtttcttcattttcgataacgacattaccaatgaagcgatgatctttttgcttatcagtatagtgatccaatgcgccgatacccatcaatttttcaccgttggcaccaatatagtaatggcctaatagttggtaaccaccacaaattgcgacgacggaaccaccatcttcaatgaagtctgtcagatcttttttcttagattgaatatcctttgaaatgattgattgttcaaaatcctgcccgccgccaaagacgacaatgtcaaatttatcagcatcaaatttttgatccaagctgataacttcggaggttaactgaacgcccattttgtttgctaaatattttaaaacaaggatattgccaagatccccataggtattcattaagtcaccataaagatgacagacatttagtgaataagccattagcccattcctccttcaataaatcctttagttgcaaatgtttttcttaaacttaacattgcagtgtaagttgctaatatataaaccttcctggttggtgcattcggaatcatttcaacgactttatccaaatccggttcgacaagatgcttactgggatcgacaccggcaacctgaaggcgataggtgatatctttataacgctgtccgcccgtaatgtattgtttgatgttcatctttggcagacgttcaaaatcaccatcccagatccagctggtatcaattccgtcagcgtagttggcatttaacaaaccaataaaggtaaatggatccttatcagttgaaatcatatcgatgacctggtttaagccaaccgggtttttgactaaaataagtgtgaccaatttaccgtcaacgttgatttcttcctgtcggccgaaaatccgtttgtctttttcaaatgcttgtttggcctgtgcggggctcacacccatgaaccggccaacggtgtatgcagctaatgcattataaatgttgtagacgccgcctatgtcaattttaatgggttcaccatcaatttcaaagctggacgacttgggagttaattcggtaattttattaagggcaaaattgagtttgggacgctgataaccacaatttggacagaaatacttacccagatttgaataactaataaaccggtaatgcagaatgtgctggcattggggacataaaaccccatccgtgtttggagttgctttaatatctccctgctcttgattatcaaatccgtaataaataattggattgggtagttgtttggaatgaaaaattggtgcgtcgccatttgcaataatggttgcattgggtgctaaagcaacaccgttgagaatcttttgataggttgtatagatttcaccatagcgatccatttggtcccggaagatatttgtaaaaacgaatgcttttggcttgatatattgtgtgaccttaataacgtttgcttcatcaacttccagaattgccaaagggcgttttcccttgggcctggaggcgtgtagaaaagttgtgatgatcccttgctccatattggaaccggtagggtttgttaagatgttttcatatttttcttttagtacctgaacggttaaagcggttgtcaatgtcttaccattggtaccggtaattacgatgacatcataatttcgtccaagcgttgctaaaatatccgggtcgagcttttttgtgattttcccgggcaacgaacttccacccttaagaaaggtatgaaggaaccagtaagatgatttaccagctgccgttgcaattgaactttttaaagacataaacttttgctccttttgatgaagtctttcgaactctataaacaaactcttagtttatcatatagatgttaaatcgggttaaaatatgtaggatgtggtcaatttttaaggttcatatcgatattcggtcaaatttctgtataatagagaagaagctttcaaggaaaaaggtggaaaaattggctcaactcttttatcgctacggcacaatgaatagtggcaaaaccattgagattattaaggttgctcataactatgaggagcaaaacaaaagtgttattattatgactagtgcgcttgatacccgtgaaaaacagggaatgatcgagtcgagaatcggattggaaagaaaggcaattcccatatatgatgaaacaaatgtatttaaaaaggtctttgagattgacccacatgcaagctgtgttttagttgatgaagctcagtttttaaagaaaaagcacgttttcgaattggctcaaattgtggatgaactgcatatcccggtaattgcattcggtctcaagaacgactttcaaaaccatttgtttgaaggatccgaatatttattgttatacgcagataaaatagaagaaatgaagacgatttgctggttctgtggaaaaaaagcaacaatgaacctgcgcttgcacaatggaaaacccgtttatgagggtgaacagattaaaatgggtgggaacgaatcctattatccagtttgtcgcagacattattacaatccaccgattaagtaacaaagcgaggaattattaatggacgaaatatttgataaattacaggcagttgttgaccgttacgatgaattaaatgagttaatcagtgatccggaagtgattgcagatacccagagattcatgaagctttcaaaagaagagggcgagttgcgggatacggttgcagcttataataagtataaagaagtttcaaaacaacttgatgatgatgaagaaatgttacgtgaaaaaattgatgatgccgatttggaatcaatggtcaaggatgaaatttcagattttaaggatcaaaaagccaagctggaagatcagcttaaagtgatgcttttgccaaaagatcccaatgatgaaaaaaatattattatggaaattcatggtgctgccggaggagacgaaggaagcttatttgcggctgatttgttcagtatgtattctaaatatgccgaacgacaaggctggaaagtcgaagtcattgataaaagtgaaactgaagtgggtggctttaaagaaattgtgttgatgattaccggtgataaggtttactcaaagctgaagtatgaaaatggcgcacaccgtgttcagagggtacccgtgactgaatccgccggtcgagttcatacgtcgaccgcaacggttggcgtgatgcccgaggaagaggatgttgatattgatatcgatcctaaagatatccgggtagatgtttatcgttcgtccggtgccggtggacagcatatcaacaaaacatcgtctgctgttcgaatgacgcatttaccaaccggaattgttgttgccatgcaagatgaacgatcacaacagcaaaaccgggcaaaagccatgaaaatcttgaaggccagagtgtacgactattatgcgcagcaagaacaggatcagtacaacgctgaacggaagtccgcaattgggacaggagaccgttcggaacgtatccgaacttataattacccgcaaaatcgggtgaccgatcatcgaatcgggttgacgttaaacaaattggataaaattatgaatggcgaacttgatgatatcgttgatgcattaattttgtctgaccaggctaagaaacttgagaatttaactcatgaatagtccagaaaagccaacttattttgaagcccggagatgggcttcttttcgtattcagaatttttcacagattgatatgtatgatatcgattttttgattcaaaaacggtttggtttttcaacgacagacatgctgattcattatcatgacagaatgtcatccggacaatggctgcagtttcaaaatgatgtcaaaaggctgatttccggcgaacccgttcaatatattgttggccaggcagatttttatggactgactttaaatgttgattcaaatgttctgattccccgagtagagaccgaggaattagttgattggattttggatcaaaccactgtttatacaaaccgccctttaaaggtgctggatattggtacgggaagcggcgcgattgcaattgcgttaaaagccaatcgaccggagtggcaggtgaatgccagtgacatttcagattcggctttgaaagttgcgcaacagaatgctcagttacatcacgtggcaatcaattttattttaagcgatatatttgcccatattaatgaagcatttgatttgattgtgtctaatccaccatatatttccgcctcggaagtgggtgacatggatagcagtgttaagaataatgaacccaagattgctttgtttgcagcagatgatggccttgccatttataaatcattagccaagggtgttgatgctcatttgaacgcgggtgggcagttatttgttgaaatcgggtttcatcaggaagcttctgtccgaaaaatatttcaagaagcgcttcctaacgccattgttacggctaaacacgatgtttccggccatcaacggatggttcaattaagaaagaatggagaataattgtgatgaaaacgttaatcttaaaaaaagaccagattgaacaagcagcaaattttattaaggagggggagctggtttcttttccgactgaaacagtttatgggcttggagcggatgcaaccaatgaaactgccgttaaaaaggtttatgcagccaagggacgtccaagtgataatcctttgatcgtgactgtgtcgtcagttgaaatggtaacaaaatatgttgatcacattagtgacgatgcccagaagctaattaaagcattttggccgggatcgttaacaatgatttttaagctcaagccaaatgttttatcaaaggctgtaacaggtggtcttaacactgcagctttccgatttccccaaaatcagttaacactcgatttaattacaaaagcgggtgttccgattgttggcccttctgccaacacatcggggaagccaagcccaacaactgcccaacatgtctaccatgatttaaatggtaaaattgcagcaatcctagatgatggtccaaccaccgttggcgtcgaatccaccgttttggatatgtctgttaaaacaccgtctattcttcgtccgggtgctgttaccaaagatgatattgaggctgttatccatcaaaacgtgattgacgaattgcatcacgttggcaccgatcagacacccaaggcaccggggatgaaatataaacattatgcgccaaatgctcaagtctatattgtcgatcctgaagacagttggcttgatgtggctaaatggattgaaagccatccgcaaccagttggggtgatggcttttgataacgtgatttcatcaattgattggccaatgaatgctcaaatcgtgaccttaggcagcaattcccgaacggcaagtcgtgatttgtttgcagaccttcgggaattcgacaaccatcctgaaataaaaataatttttactcaaggccttaagccatctgggattgccgaggcttatatgaatcgacttaataaatcggctgggcaaatgcatttcaagcagttataatcaacatataccaaataaaaaattaatgaggtgttgcagttgaattacgattacaagcaacaggatcccgaactatgggatgcaattgcgaatgaggaaaaccgtcaggagcataatattgaattgatcgcttctgagaacattgtttcgaatgctgttcgggctgctcaaggatccgttttgactaacaagtatgccgaaggctatcctggacgccgttattatggtggttgtgaatttattgatgttgttgaacagcttgccattgatcgtgccaaagaattatttggtgcggaatacgctaatgttcaaccgcattcaggttcacaagctaatcaggcagtttatgctgccctgctaaaacccggagataaaatattgggaatgggacttgatgccggtggtcatttaagccatggtgccaaagttagcttttctggcaagctatatgattcatattcatatggccttgatcccaaaacacaattaattgattacgatcaagttgcaaagattgcagaagatgtgcaacccaaattaattattgccggtgcttcggcttacagtagaattattgattgggataaattccgtgaaattgctgattctgttggtgcatacttaatggttgatatggctcatattgcaggcttggttgctgccggacttcatcctaatccagttcctgtcgctgatgtcgtgacaacaacaacacataaaacacttaggggccctcgtggtggactgattctggctaaacaaaagtatgccaaaaagctcaactcggctgtatttcctggcagtcagggtggcccattggagcacgtgattgcgggaaaagcggctgctttctacgaagacctccaaccatcatttaaagattatgctgctcgaattatcaaaaatgctcaagcaatggcagccgtttttgaagcttctgataacgtgtcggttctcactggtggcactgataaccatttaatgacattgaatttaaccgaatgtgagttaaacggaaaagatcttcaaaatattttggactcggttcacattacgactaacaaagaatcaattccaaatgacccgttgccaccttcgaaaacaagtgggcttcgtttgggtacacctgcaattacaactcgtggatttgatgaagacgatgcccgccaggttgcgacactcattctccaagttattgaagatccagaaaatgatgctaatctcaaagatgtcgccgccaaagttgaacaactaaccgaaaagcatccacttgattaacaaagcattgtttgtttaatcagattgccgagtaaagtattcagctgttagtatcggctattagcaactaaccggattttaggtctatttaaaaccacaaactgctttaagttcgaaactaattaatgtttcgaactttttttatgaaattgcttctcgtatatgtgatacaattgtctagaaataaaaaaaggagtgggaataatgggtaagtttcaagtcatggatcatccgttaattcagcataaattaacaattatcagggataaaaactgtgggaccaaagaatttcgggaaattgttaatgaaattgctaatttaatggcgtttgaagttactcgcgatatgcctttggaagacgttgacgttcaaaccccagaaggtattgcacatgcaaaacaaatttctggaaaaaaggttgccattgtgccgatcctacgtgctggtatcgggatggtagacggtattttggatttgattccagcagccaaagtaggtcacattgggatgtatcgtgatgaaaagactttggagccacatgagtattttgtaaaattgccgtctgacattgatcaacggcaaatttttgtggttgatccaatgttggcaactggtggttcgtcaattatggccatcgatgcattaaaaaaacgcggtgcttcaaatattaagtttgtgtgtttggttgctgcacccgagggtgttaaagcgcttcaggaagctcatcctgatgtagatatttatacagccgcattagatcaaaaattaaatgacaaaggttacattgttcctggattgggtgatgcaggcgacagactctttggaacaaagtaattgaagattgattgcaactaacttgctgcaatcttttttcatactattgttaagttattgaaaaccaacaataaaaagcctttacgactttactagcagtcagtttgctgtaaagcaacgattggcaatattttggccctttcattttgttttcatgttttcatgtgacaaggccctgtaagttggctgatttcctaatttgacgggatgtatagcatgtcaatattgttttgaattttgtaatgaatggtggtatagtttcaattgtatttggatgctgagatgtattcattaccatcgcaaagttcactttggtattaatgtcttcccgaccgaataaccagattgattagcttgcgtagattatgtcgtagaaagaggtgagattttaatgtccattggagggtctaatcatacttttacattcttaggactgacgtttaacgcaggtaacatgatttcgattttgctcgcttgtttgatcgttttagctctagtctatgcgctttccaggcacattactatgaaacctggaaaggcacagaatattctggaatatgccgttgattttaccaatggtattgtgggtggttcagtttccggagaagctagtaaaatgttaggcttatggggcttttcattgtttttgttcttgttggttgccaacaacatgggactgtttttgcacattgacgtctcaggcattacgtatgtaaaaagcccgacttctgatccggttgtgacgatgaccttatctcttatgaccctgacacttgcccagttcttggggattcgtactttgggttataagaaacactttgagaattatctcaaaccgtttaagatatttatagttgttaatctttttgaggaattcaccaatttcttaacgttgggattgcgactattcggtaatattctttcaggagaaatgcttctgactatgattaccggaatggcgacaggtggaggaccggtcatgtggataggaatgctaccacttgaactgatctggcaaggcttctcagtctttatttcatgtattcaggcatatgtttttgtaacgttgtcgtcggtatacatttctcaaaagattgaggtagaagaagtataacaagatatttttaaggaggattattaattatgggagcaatcgctgcaggtatcgctatggcaggcgccgcaatcggtggtgctattggtgatggtattttaatcgctaagatgttggaaggtatggcacgtcagccagaattatccggtcaacttcgtggtaacatgttcatcggtgttggtttggttgaagctatgcctatcatcgccttcgttgttgctttgctagttatgaacaagtagtctgctagtattgctaaaataacaaagaaggaggtgccaattaatgttttcatattcggtagttggagctcaactttataccggagacatgatttttgttatgatcagtttcttgattttgatgtatctgatcaaactcattgcatggaatccgattactaagatgatgcaaaaccgttcagataagatcgctaatgatattgattctgctaagaactcacgtgataaagccgctgaacttgctcaacaacgtcaagcacaattagataagactcgtgaagatgcaaataatctcattaacactgctaaagagaatgggcaaagacaacgtgaacagatcgttgaagatgcgagaaatgaagcatctaatcttaagagttctgctgaaaaggatattgaacaacagcgacaagaagctttggctaattctcgtaaagatgtggcaagcctttcaattgaaattgcaactaagattatttcaaaagaattgaatgaacaagatcaaaaagggctggtcgattcttatattgaagggttgggtaagcagaaatgaaatcaactaacataacagcagctaagaaatatgccaaggcaatgtttgaagttctaacagatgctaagggccttgaagatggctacgctgatttaattgaacttcgtaaaatttttgttgccaatcccaagttgattgatattcttgatgatatgagggtttctgatgaccaaaaaacgtcattgctagctcctatcactaaaaatgcatctgactttatcaataattttctcaaagtcgtagcaagttaccgtcgttttcctgacattatcacgatcattgatcaattccagcaattatacgaggatgataagaagatcgttcgcgcggaggttgtgtccgcaactgaacttgatagtgatcagcaggagcgcttggcaaaagcctttgagaaacgggttggtgccgctaaagtcatttttgatacaaaggttgacaagtcacttattggtggtattgttatcaaatcttctgatgtcattattgatggtagtgtcaaaactcgaattaataaagtaaaagaattattgttgaactaacgatatctatttaaagaggtgaaacttatgagcattaaagctgaggaaatcagtgctcttatcaagcaacaattgcaaggttaccaaaacgagcttgatgttaaagaaacaggtatcgttacatatgttggtgatggtatcgctcgtgcgcatggtcttgaaaatgcgttgtctggggagttgctcgacttcggccacggtgttttcggaatggttcaaaaccttgaagccaatgatgttggtattatggttttgggtgatgatacaaatatccgtgaaggagattctgtaaaacgtactggtcgaattatggaagtccctgttggggacgatatgattggacgagttgttaattcactcggtcaaccgattgatggtaaaggacctattaaggccgatgatcataaggcaattgaacacaaagcaccaggtgttatggatcggaaatctgtttttgaaccattgcaaactggtattaaatcaattgattctttgattccaattggtcgtggtcagcgtgagttgattatcggagatcgtaaaaccggtaagacttcgattgccattgatactattttgaatcaaaaagatcagaacatgaagtgtatttatgttgctattgggcaaaaggaatctactgtccgggcatctgtaagcacgctggaaaaatttggtgcaatggattatacaactgttatttctgcgggtccttctgaacctgcttcactgttgtatattgcgccttatgccggtgcaacgatgggtgaatacttcatgcataaaggccaacatgttttgatcatttatgatgatttgtcaaagcaagctaacgcatatcgtgaactttccttgattcttcgtcgaccacctggtcgtgaagcttatcctggtgatattttctatactcattcacgtctattggaacgagctgccaagttgagcgataaattgggcggtgggtcaatgactgctttgccaattgttgaaactcaggctggagatgtttcagcttatatcccaaccaacgttatttcaattactgatggtcagatcttcttggatgctgatagcttctattcaggtgttcgtcctgccgtagatgccggtacatcagtttctcgtgttggtggtgatgcgcaggttaaagcaatgaagaaagttgccggtaccttgcgtcttgatttagcttcatatcatgaattggaatcatttgcacaatttggttctgatcttgacgaagccactcaagctaagttaaatcgtggtgctcgaaccgttgaagttttgaaacaaccacttcattctccaattccagttgaaaaacaagttcttattctctattgcttgacacatggatttttggataaaattgaaattgatgacattcttcgttatcaaaatgagatttttgacttctttgatcgttcacataaggatctgttggacagtatcgctaaaaccggtaatctgcctgatacatctaaaatggatgctgcaattaaagaatttgatcaaacattccaaccaagtaagcaagatgaaggacaaacaactgcctcaaacgatgatcaaaagtcaactgcaacaaatgactagtttttaaggagggtgagattacatgcctgcttcgcttaacgatgttaaacatcggattacttctacaaagaagacgcgtcagattacgaatgcaatggagatggtttctcaagctaaattaaaccaaattcaaaagcatacctcaagctacgcggaatatgcaagccaagtaaaatctgtagttatgcatttagctcaatcccatattctggatgggctaaaatcctcaggtcattcggcagataatgatcagtctaaagctaagagaactgcctatttggttatcacctccgatcgaggaatggtgggtagctataatgccaatgtcattagagattctaatgaatttatcagtaaacactctggtgtgtcgggtgattatactattattgctgtcggcggtaatggttccgatttctacaagaagcgcggtcaaaatgtttcttatgagtaccggggtgtgagtgatgtaccaacgtttaatgaagttcgtcagatcgttaaaatgattacatcaatgtatgataagggcgaatttgatgaattatatgtttgttatgaacattttgttaaccgattggtttctcgctttagagccgagaagatgcttcctgttgatagtgaagcaattcaaggtgaggcgagtcaggaaattcaaactaaagaattaactgctgaatatgatgttgagccatccgaaaaagaggttttgaatgttgtgttgccgcaatattccgagagcttggtatatggtgcaattcttgacgcaaaaacgtcagaacatgcttcaagtgcaactgcaatgaaatcagcctcagacaatgctgacgatttgatttcatcattggagttacaatataaccgggctcgtcaggctgcgattacgactgaaattactgaaatcactggtggtcaggaagctcttaagtcagataacaattagatggaggaattaactaacatgagtactggtaaagttttacaagttatcggaccagttgttgacgttgaattctccttggacgacaaattaccagaaattaacactgccttaaatgttcatgtaagtgacgataaaacacttgttgttgaagtcgcgcttgatttaggtgatggtgttgtacgaacgatcgcgatggatggaaccgatggtcttcgtcgtggaatggaagttgaaaatactgaatcctccattagtgttcctgttggtaatgacacacttggtcgtgtgtttaatgttcttggagaaccaattgatggcggtccagaatttggcccagacgcagaacgttggccaattcaccgtgaggccccgaagtatgatgaattaaacccatcaactgaaattctggaaaccggaattaaggttattgatttattggaaccatatattcgtggtggtaaagttggattgttcggtggtgccggtgttggtaaaaccgttttgattcaggaattaattcataacatcgctcaaggacacaatggtatttcagtgtttaccggtgttggtgaacgaacccgtgaaggtaacgatatgtattacgaaatgaaaggatcaggagttcttgccaagaccgccatggtttatggtcaaatgaacgagcctcctggtgcgcgtatgcgtgttgccttaacaggattaacgattgccgagtacttccgtgatgaagctggacaagatgttctgttatttattgataacattttccgatttactcaagctggttcagaagtttctgctttgcttggccgtattccatcagctgttggttatcaaccaacgttggctactgaaatgggtcaattacaagagcggattacttccactaaaaagggtgcgattacatcaattcaagcggtttatgtgcctgccgatgattataccgaccctgcaccagcgacgactttcgcccatttggatgccacaaccaacttggaacgttcattaactcaacaaggtatttatccagctgttgatccgttggcttcaacatcatcagctttggatccacaaattgttggccaagaacattatgatgtggctactgaagttcaacacgttttgcaacgttaccgtgaactgcaagatatcatttcaattcttggtatggatgaattgtccgacgaggaaaaaacaattgttaaccgtgcccgaagaattcaattcttcctttcacaaagtttctcagttgctgaacagtttacgggtcttcccggtaaatatgtttcagttactgatacagttaaaggatttaaagacattcttgacggtaaatacgatgacattccagaagatgcgttccgtaactgtggaccaatcgaagatgttattgctaatgctaagaagttacaaggtaactcaactgcagacacaagtgatgaaaagcaaagtgcagcaaactaaggagggagtttaattggctgatagttcagttattaacattagtattgttactcccgatggaaaagtttacgagcattccgctgctgacatgatagttgtttcaacacaatcgggacaactaggaatcatggcaaatcacgtgccaatcattgcaactcttgatgtcgatgaaacaagagttaagtatggtaatgaggaagatgaaattgctgtaaatggtggtttcatcgaattctcaaacaatatggcaacgattgtagctgatagtgccgagaatcagagtgacattgatgttgctcgggctgaaagtgctagacaacgtgcacagagattgatcaccgaagctcgtcagaagaatgacgaggctgcattggatcgtgctcaagttgcgttgcgtagagctgttaaccgaattaatgttgctaaaaagtaatacaaattagattttaagggatcaaagcaaaacttcaatgttgctttgatccttttttgtctgttagtatataagaatcaaattagtttcccggccatcgcaaacaatgtttggtgttgagcaaatgtaagcactgacatggttgtttacgagattccttagcaattggggcttttagaaagtgaaccaattatgaggaaacgcacactttttcttaaaaaacgcgaaaatatgagacaagtttgcgcctttatgatatagttgtcagtgaattgggggaatttagatgaaaatgattggcatccaagccatcgtaacgcttgttacgtattttctatttattgcaatggcgtttaggagtgttcaagaaatccacatcgaacgttatctccctcttcgtgcgttgcccgggaaattgttgatcgtgttattatccattgcaattggatatgcatgtgcacaatttttcctttcggtaatcactaatattcaaaatttaatttatttaataaaataatgtaggaggcgttcttgtggaaaaaattattgtacatggtggaaacccactaaagggaagagtacatattgacggggcgaagaatgctgtattgccaattcaagctgctactattctggccagtgaaggtcaaacatctatttcaaacgtaccgctattgtctgatgtgtacacaatgaacaatgtgttacggtttttaaatgtaaaggttgattttgatgagttacataatgaaatcacttttgatgcatcatcagaaatatctagtgaagcaccatttgaatatgtttcaaaaatgcgggcttcaattgttgtgatgggtccattattggctcgcttaggtcgggcgaaggttgctttgccaggtggttgtgctattgggtccagaccaatcgatctacatttaaaagggtttgaggctttaggagccacaattgagcagcatgacggttatgttgaagcaacggctccaaatgggttggttggaactgacatctatcttgattttccaagtgttggtgcaactcaaaatatcatgatggccgcaaccttggcaactggcaagacggttattcaaaatgcagcccgtgagcctgaaatagttgatttagccaacgtgttaaataaaatgggcgctaaggttgttggtgccggcactgagcagattcggattcagggtgtttctgaacttcatgggactgaccattcagttgtccaagatcgtattgaagcagggacctttatgattgccgctgcagttaccaggggcgatgttttaattgaagatgcaattgctgagcataataagccgttgattttaaaaatgcgtgaaatgggtgtatcagtcaccgaatcagatgccggaatccgtgtgattggaccggatcatttgaaacctgtagatgttaagacgttgcctcatcccggatttccaacggatatgcagcctcaaatgactattttgcaattagcagcagatggaaacagttcaatgaccgagacggtttttgaaaatcgctttatgcatatggaagaacttcgtcggatgaatgctaagtacacaatttccggacgaacggttattatgaatggtccaacagacttcaatggtgccgaggttgcagcaactgatttacgagccgcagcagcattagtcattgcgggccttgttgcaaagggttatacacaggtcagcaatttacagtatttggatcgtggctactatgatttccataagaaattggctagcctgggcgctgaaattaaacgtgtcaatgtcgaagatgattcaatcattgttaatcaatcttcatcagttaaacatctaaataagtaaagctgagggccggagcgaaaccatttgtgttttgtaccggtctttttgcggttgaggtctagttgagacgatgagattaaatcttttctaaactaggccatgtttattgagaatacttaagaactgttagaaacttgcaatagatgtgatataattaatttttgagattaaagtttttcaggaggaagttcacagatggcaaaagacataggaattgacttaggaactgccaacgtattgatctacgttgccggaaaggggatagtattaaatgagccctcagttgtggcgattgatactcgaaccggtaaagcattggcagtcggaacagaagcatatcggatggttggccgaacacccagtaatattcgggcaatccgtccattaaaagacggcgttatttctgattttgatattaccgaggaaatgcttacctatttcattaataaattagatgttaagggattcatgtccaagccaaagatcatgatctgtgcgccaacaaacgtaacagaaattgaaaggaatgcaattgtccaggcagctgaaaaagctggtggcggccaagtatatcttgaagaagaaccaaaagttgctgccgttggagcaggaatggatattttccagccacgcggcaacatggttattgatatgggtggtggtaccagtgacattgcagttatttcgttaggcgatattgttgccagcaaatcgattcggattgccggagataaaatgaatactgaaattgtcacttatatcaaacaaaagcatggtttgattattggtgagcacactgctgaaaaaattaagattgaaattggcactgcgaaaaaagatgacaaagatgttaagaaattagaggttcgtggtcgagatgctgtttcaggaatgccacgggcaattacaattgatagtaacgaagttgccgacgcaattgctgatactgttcagttaattgttgatggtgcaaaagaagttttggaaattattccaccagaattggcttcggatattgttgatcgcggcattatgctaactggtggtggcgcgcttcttcgtaacattgatcaagtgattgccgatgctttgacggtacctgtgattatttccgaaaatcctttggacaatgttgcaaagggtgcaggtgttcttttggaacaatatattaaaaacccgaaacttaagacgaaataggataaaaagcgggagttttagtgaaaaaaattctgatgttgatggttcgtggctatcagcgctttatatcgcccctctttccgccaacgtgtcgttattatccaacgtgcagtcattatatgctgatcgcattgaagaagcatggtgcgcttaagggggctgttatgggaatagctcgaattttaagatgtcatccatttgtccgtggcgggtatgatccggttccggatcattttactatttttagaaataaatccgctcgggatcaatatcgcaaatcgatgcacttaaaataggattaacaggagagattgaatgagtaaggctattaaaagtatcaatgttgaaattaaagattccaaggaccaaaatggtaaccaggtttccgatttgatgatcggtcgcaaacggattggttcgattacgaaagtgaatgacgacaaattccaagccgttaacactcatcaggaaagctatcacgtcaaaacttttgatgaaggcgtccagttattaattaaagactttcatctacatcattaataagttattgcgcgatgaggaggtttaaatttggataccaaacgcggtacggacaaagaaaaagaatccagaattgactgggggattattttctgcgttttgatgcttgcgttgattggcttagcgtcaatttacgttgctgcaactcatgattccagtgcgaccagtgttttaagacaagttgtttcgcagcttgtttggtatgtcatcggaattgttgcagttattatcatcatgcagtttgattcggagcaattgtggaaagtggcaccaattgcttactggctgggaatactgctactagcaagtgttttggtgctttatagtcgaacgtattatgttaataccggtgctaaaagctggttttctttagcagggttgacatttcaaccatctgaagtgatgaaaccagcgtatattttaatgttgggcagggttattgttgagcataatgacagacatccgctaaaaacggctaaaagtgattggctattaattggtaaaatgatcttatggacggtaccaattgcagtcctgttaaaattacaaaatgattttggaacgatgcttgttttctttgccattttaggtggtatgatcattgtttccggcattacctggaagattattttaccatccgtcattacaatttttggtattgccggaacggctcttgcactggttattccagaagcaggtcggaaaatattggaaaagattggttttcaagcctatcaatttaatcgggttgatacgtggcttcatccttctgccgatacctctaatcaagggtaccagttgtggcaaagcatgaaagcaatcggttcaggcggtatatttggaacaggttttaatcagtcgcacgtctacgtaccggttcgagaatcagatatgattttttctgttattggtgaaaatttcggtttcattggcagttgtgtattaattttcctttatttcctgttgatttatcaaatgataaaggttacctttgaaacaaggaatgttttttatgcttatatctccactggcgttattatgatgattctctttcatgtatttgagaatgttggcatgagtatcggcttattgccattaactggtattcctttgccttttgtaagtgccgggggttcagctttaatcggaaatatgattggtattggtcttattatgtcaatgcaatatcataataaaagttatatgtttggtgaagataaagaattttcttaaaagggtggattgatcatggatacaaagtattattggactgatgaagataatggtgttgttactgttggactaactgccgatggtcaaaatgaacttggaaatattacatttgcatcgttaccaaaggtaggcgcttctttgactaccaaggacacgttgttaaatgttgaagctgacaaagctgtttcagatattccaagcccggttgccggtaaagttattgcaattaatgataaagctgcaaacgatccctcagttctaaataagaaggataaagcagattcatggattgcgaaaatccagaagtaacaattcttgacgttagcattggttgtagtaaactaacatatagttaaatgacaaaaaaagtgacaagataagtaaatagataaagttgaatcagagaactctggtagctgagaaagagtctactgaatctattgaagatggtcttgattttttcaagtgttgatgaggttaaagcaaatcaacaatggttaacgcccattattccgttgagtatagattgcactatgctctttgaggttgttattgaaaaataataacgaataaaggtggtaccacgaaaaaagcttttcgtccttcagacaatgattagttgtttgttgaaggatgaaaagctttttttagtatcttgacaagttaggagtggattaaattgattcggtttaaagatgtgtcgaaagactacagcaccaaggatggtgaattaactgccgtttcagatgtcaatattgaaatcaatgatggcgaaattttcggcatagtcggttattccggagcgggtaagagtactttggtccgaatgttggatggtttggaagcaccaacaaaaggtgaaattgatattaacggtacgaatattgccaaactgtatggtcatagattgcgcgtacaacgacaaaaaatcggaatgatctttcagcatttcaatctgttatggtcccggacagttattgacaatattgcactgcctctggaaatcgcaaaagttccaaagaaaaaacgtcaggctcgtgccgaagaactggttaaattggttggcttggagggacgtgagcactcttatccttctgaactctccggtggtcaaaagcaacgtgttggaattgcaagagcgttggcaaatgaaccgacgattttaatttcagatgaagcaaccagtgcattggaccctgatacgactaatgaggtgttggatctcctgcttaagattaataaagaaatgaatttgactattttattaatcactcatgaaatgcatgctatcgcaaaaatttgtgaaagggtagctgtaatggattcaggacgtgtagtggagagtggatccgtttttgatgtattccggcatcccaaagaagaagttaccaaaaagtttgttagcgaggaattttcaccacagcaagaagagtcgaccattacactggatgaattaattaaaaagtatcctgatgggcagatcattagattggtttttcatggaccacaagctgaactgccaattgtttcagaagttgttaagcgatactcagagctgcaaatcagtattttggcaggggcaattcgacaaactcaagaaggcgccttagggtcacttgatttacaatttatcggtgatgaaaaacaaattactgatgcgttggattaccttaaaaaaatgcgtgttgaaacggaggtgattcaccatgagtaacgcaaccggattgaaatcgtattttatttttaaaaatgttgattggccgtcaatgtggtctgctacttgggagactgtttggatgacgttaatatcaatgattgcagtagtagtttttggtattattttggggttgattttatatgaaaccaggactcataatgggcctttgtttaaagtcttaaattggattgttggactctttgttgatatatttcgttcaattccatttattattttgattgtgcttttattgcctgttaccaaagaaatgattgggacaattattggcccgagagctgcgctaccatctttggtcatttcagcttctccattttatgcaagaatggttgagtcctattttcgggaagtcgactctggtgttattgaagctgctgaatcaatgggagctacgacttgggggattattaccaaggtacttttgcctgaaagcaaacctgctttaattgctggcgctacagtaacgaccatttcattaatttcttatactgcgatggctggtgcaattggtgctgggggccttggaaatcttgcctatctggatggctttcagtccagtaataacaccgttacacttgttgcgacggttattatttgtttatttgttttcttagttcaatatattggcgacttgcttgttaaagtgactgataagcgaacattataatattttatttggagggtttcacatgaagaagaaattattaggtttatttgcagtcgtattcacggctttcttgttagttgggtgctcttcctcaagtacaagcaagaaaaccactacgcttaagattggtgcatcaaatgtaccacacgcccagattttaaggcatgttgcaccacaactgaaaaaagaaggcgttaacttgaaaattaccgtctttcaagattatgtaatgcccaacaaagcattggctgacaaggaattggatgctaattatttccagcatattcctttcttaaaacaatggaataaagaaaaccacggcactttagtagatgcgggtggcgttcatattgaacccattgctgttttttctaagaaagtcaaaaaccttaaagatttgaagaagggtgctactgttcttgtaagtaacaacaccccagactatggtcgaattcttcagttgtttaagaacgccggattgatcactttgaagaagggcgttaatattgaatcggctactttcgatgacattgcatctaatccccgccatctgaaattcaagcacagttatgaaccgaaattaatgccgcaaatctacaagaacggtgagggtgatgccgttgttatcaatgcaaattatgctgttcaagccggtttggatcctcgtaaacaatcaattgcgattgaaggtcgtgacaccccttacgtcaacattattgctactcgtaaaggagatcagaacaaaccagctattaagaaactggtgaaggcactacaatcaacaagtactcagaaatggatttataacaaatacaagggtgcagttctaccagtcaagaatgttaagtaaatagtgttatttaaatggcttccgctttatacttaggatagtaaatcgattacttttcttagtggtaaagggggagtttttttgaaagagaagaatgtattccatgttaatggctacattggtctggtggttgccttggtgttgcttgcttttggcggttaccttttatggattggtagtcaagatacttcggttagctccattgtatttggcacgttaattattattttggatctactttttgccagttctctgacaatcattcaaccaaacgaagcgaaggtattaaccttttttggcaattatattggcactattcgaacaccgggcttgttcatgacggttcccttaaccagcaagcaaaccatttcgctgcgagttcgaaattttaacagtcaaattattaaggtgaacgattcaaagggtaatcccgtggaaattgcagccgttattgtctataaagttgttgactctgctaaagcaatttttaatgttgaagactatgaacaatttgttgaaatccaaagtgagtcggcaattcgtcatattgcaagtcaatacccgtatgacagttttgatgaagaaaaggatattttaaccttacgaggtaattccacagaggtttctgaggccctaaagggagaacttcaggagcgattggaagtggcaggattgacgatcatggaaacaagattgactcatttggcctatgcaactgagattgcgagtgcaatgcttcaacgtcaacaagcaacggccattctttctgcaagaaaaattattgttcaaggagctgtggaaatctctcaagaggcggtaaaacagcttcaaaagaatatcagcattgatattccagatgagaaaaagattcaaatgatcaacaacgtactggtttcaattattacggaacgtggtacccaaaatgtgattaatacagataatgtcagttagtttgattaattttattcaacttaatataagtcggaaagtttggaattaaatgctaaactttccgatttttttgttgacatatttgcacttggcatatatagttagttacacaagtaatgaactaatacaggaggacaatatgactcgggaaattgttaaaactcaaaatttacacaaggtatacgatcagaattccgaaagaccatatgaagcgttaaaagggattagctttacagttgatgaaggtgactttgtaggcattatgggcgcctcgggttccgggaaaacaacgctattaaacattctagcaacgttggataaaccaacaagtgggagtgttcagatagatggcaacgatataacgcaactaacatcaaatgaaatgtctgattttcgctcacaaaaattgggattcatctttcaagattttaacttacttgaaacgttaacagtgtttgagaatatagcattaccgctatcactgcaaaatataaagggacggcttactaatcaaaaggttcgagaatcggccgcaaaattgggaattgaagagttgttggcaaaatatccaactcaattatccggtggtcaaaagcagcgggtagccgctgcaagagcgctggtttctaatccatccatcatatttggtgatgagccaaccggtgcacttgattcaaccaacgctcgggaattattggatacgttgaaaaatattaatcgacagggtgtttctgttcttcttgtcacacatgatccattctcagcaagtttctgcaaacgaattctgtttattaaggatggtaaaatcggggatgaaattcaagctggtaatcgcgatcggacacagttttatcaagaaattctggaaaagttagggacgtttgaacagtaattggaggaaaagtcatgttattaaagatttcactttctggggtaaagtcgcgttggaaagactattgcgtgcttttttccggaatcattatggcgtcagctattttttacatgtttgaggcaatcgcactaaataaaaagtttgtgtcatcaacaacggttggtcaaaatgccagggcggtttttatccttggatccgtactgttaatcgttattaccttggtatatgttttttatgcaaataattttttaatgagtatgagaaaacatgattatgggttatttatgatgttaggtgctaagcgttctaaaattagtaaattaattagttttgaaactctaatcgttggtgctgcttcgacgttattgggcattgttgccggaataggcctaacaaaaatcgtcagtagttttttaattacttcattggaaattccaattaaatattttcaggcgatatatgttccagcgatttggacgacacttattttattcatgattttatttgcaattgcaggtatgattaatgcaggtgttttttccagaacagcagcacttaaactgctaaagtctgaaaatcaaactgattggaaacaaccaaaagctaaaagacttgtcgtacaggcgattcttggtgttttacttcttagtggtggttattatgcaatgtatgatattcgccaattacaagtcggttcaatctggattggccttattacaattgttgcagggacttatcttatttttaactccttttttgtgatgttgcttgaaagaatccaacaatcatcacttaatagtaaggggattaataattttacaattgcacagctaaaatttcgaattcgtgattatacaaaaattttatcggttgtttcactgttgtttgctttagcgcttggtgcaattacggtcggaattggatttcaaagcgatattccagaaattgctaatggcaataatgcatatgccatttctgccactaacccatccgcaaaaatgtcttcattaatagcaaaggttgagggtaaaacaacaagtcattatcagcaaaaggtgactgataaagttgtttattatcgttctagtgattttaataaaagtccactgaaatattcagcgttcgttcttaagggaaatcaggctggtctttcgcagattaagaccagtacactaaagcaattaaaagatcctcagtcaccagcgtatcaacaactctcctcactgcaagatccaagcctaaaatcccgtcgaatcagattcatttctgatacaacatttgatcaactgaggggtcggacaaatgagttacaattaattagagttaaagatattaacagtcaatatcggtctctaaaatctgttatggatctgcaaaagacagaatttggttctcaaactgtacaattaatgggggaatctattgtcttatattcaatgctcaaaagcatgttttcaagtatggaattcatgggagtctttcttggaattgcgtttttggcaatgctggccagttgcttaatgtttaaaattttaagtggtgcgcaaagcgataaagttcgatttgaaatgttaaataaaattggtactcgtaaaaaggttctacagcactcaatcatgcttcaaattttaggattgtttgggcttcctgcagtccttgggttattggatgtggcctttggattgcaaatgtttgtaaaagcaaatctcttgtaccatgcttatcgtacatttgcttattcttcaattggctttcttgtgttatatttgatctattatggtgtgacagtgttaatctaccagaagatagtgataccaaagaccagaagtgaaaaataatgatagaaatggtggcatggtactcaatgcaatttcaatttaatagttctgagccaatttaccgccaagttgccgaacaaatagaagatgcaattgctgctggcggatttgaagaaggacaacaaattccgtcaacaacagaaatctccaaggagttccacattaaccccgcgaccgttttaaagggaatgaacattgttgttgcgaaaaacctgattgagaagcgacgtggtttgggaatgtttgtaactgatggtgcccatcaacgaattgtttctgaaaaaaagaatcttttttttgaaaatttcgttgttagtttggtgaaagaggctcgtagtttagatatttccgaatctgagttacttgaattaataaagcgaggttatgataaatgagtgtgttggaggtcagtcacgtttcgaaatcgtttggatcaaaaaacgtgcttcaggatgttagtttgacgtttgaagagaataaaatttatggtttgctagggcgaaatggtgccgggaaaagtactttattgaacattatgacaaatcgtatttttgctgataccggtgaagttaaaatcgattctgaaagaattaatgataatgacgcaaagcttggcttaatatttttaatgagtgaagtcaatctgtatccaaatggcaatacgctcaatcaaatagtcgccgataccgaactgatatatggtagttttaatcatcagcttgctgaaagactagcaaaagaatttgatttggacctgacctctaagtttggtaaattatcaactggttacaattcaatattcaaattaatattggcactgtgtgttcctgttaagtttgttttacttgatgaaccggtccttgggctggatgctaatcatcgggaaatgttttattctgaattaattcaaacctacacggataatcccagaacttttattatttcaacccatttaattgaagaagttgctaacttaattagtgatgtgattgtattggatgagggtcgaattatgcttgatcaaccggttgaggatgttcttgccaaaacacattcagtggtggggccacaaaaagatgttgatgcttatacaaaagggcttaacgttatcggtcatgataatatggggaccatccgggttaattatgtttatggtgatttagatgatcgtcggttacccgatacggttcaattgtccaattttgatcttcaaaaattgtttattttccttacaaatcaatttgaggggagtcgacattatgaaaactagccagattaccaagtatttatttaaaagacaaattgttatcttgggcgaaatgtatttagtcacctttgccgcaatttatattcttcctttactactttcattaattactgggacactacatgattattcatttgtccggattttgaaaacctctccgattaccggcttctttagtttctttatgtttgtgattgcgaccttgtcttatgagaactttaagtttttaattcaaaacggtatttcaagaaaaaccttttttgaagcccaaattacagtttatgggttatttattctgattggtaatacggttaatcttgtatataattaccttatttatacgccaatgacaaatagagatacctttaatatatttatgacagcctacgctaaattttttagcaacggtattataactgtgatttttaactttatatttagtgctttaaccttagtaatcatgacgttgattggtatgacgattggtagcttcctgtcactcttttcaaagacctggcagcggatacttttggtggcaacgccaattattggtggcgttacgatgatttatatcattaatgcgttggaaacatcatctctaaaaatgacgtgggttgagcattttgccgaattgatactggggtatcaccgaagtggtatttacaatccattcccaatgatggcatttatgcttcttatttctgtaatcatgttggcaattgttagatacttgttctcaaagaagcagttgaaaagagaatgattttttaaaaattccgattagtaacaacttaatttaacaggttaagtcaattccgatttttttaaaatacaagatatctctgatgtgttatttctattttcctttctaagaaacccattagaacgcgacaaaaatatttattaaccgaatttttaatggtatacttaggtttctgaaatatatacgaataggatgggaaatcatggaaaataataagaaacttcatgttggcctgatttttggtggaaactcttctgaacacgacgtttcgaagcgttctgctcacaacatttacgatgcaatggacaaggacaaatatgacgtcagtctctttctgatgaccaagaacggctatttcttaggaacaaaagcttcaaccagggtttttaacggtgaacccgaggatgatgttgcgcgccaagaaattgcaaagctggataaaagtaatccacttgccccaattttgaatttaagtgaagattcaaatattgatgtctttttcccgatcatccatggaaacctgggtgaagatggtacaatccaaggcctgttacgattattgaataagccatatgtaggcagtggtgttttaggatctgcaatgtcatttgataaagacattaccaaaaagattttaaaattagctggtgtagcaacaactcgatatgagttattaacgccacttacggtggaaaagtatagttatgactcattgagcgcagaattaggcaagattttatttgtaaagcctgctaatcaaggatcttcggttggtattcataaagtggaaacttctgacgattatgacgaagcgattcgagacgctttccgttatgataataaagtacttgtcgaagaagcgattgaggggcccgaagagttggaaatttcagttcttggtaatcatcatcccatcgcttctaaagttggttcaattaaagtacctgcggacgatgctttctatacttacgataataagtttgtcgatgccagccaggtgaaattcgatgtgcctgttgatattcccgaagcgttatctaaggaactaaccaaaatggcacttgattcttaccgggcacttggacttaaaggaatggcacgaattgactttttggtttctcaagacagtgaaccatatgtcagtgaagtaaacacacttcccggatttaccaatattagtttatatccgcagttgtttgcagcttcaggtatttcatacagggagttaattgatcgactgattcagcttgcaaacgaagaatacgaaagacaatccaaaattctttatgatttcaaaccactaccaccacgagatcaggatgttaagtagtgtggtttgatctttaatatagtatggtgatgttgttaaaaagctgagcaatcctattttttaggaaatggctctgcttttttctttagggtggtaatcatggtcgaaagacaatttcaaaaattgaatttttatctacttggttttgccattgtaatggcattgttaaagttttggatgatggtgactgtagatagtaagattgttgtgatttgtgcgtttttgtctttgctattactggggagcacaattaatgttggtattgggaatttagtaccgaatcatgtgaagaaaaaaatctgtttcagaattgatttttggctagcagttttaacgttatggttcacgatgcttccttttggattgtttggattaagcgccttttttaaaacttcttttccattaactggttatcaatttacttggataacaattaatcgttactggctattaggctgtttgattactgcctatgttgtgttgttaatggttgtgttatatttgagacgctttatttactacttggctactagttataataaaagtttccttcaaattttgaccctatctcgtcatactgcttcattgaaagacgttggtaggagcttattattaatagctattagaataggctgggtaatgtgtctcattttatttctgtcgtttattaattacttggtaggacaacaatttgtctttgtgttatctcttggcattatcaatttatgtgtaccattaattgaaattaagcttctttttagattgttggcaatacctgtaaatagtcatatcaaattgaccggcatctccgtatttgggctgtttggagcgctgatttttgtttcggtgttgggggttacatatagtagtcaccgtatactgaaaccggctcagcaagaaattatcgttcatcgtggtgttattgataatgatggcgcaccaaacacaatcagtgcattaaaaaagaatagtcgctatcggttttcatacgttgaaatggatattcaagagactaaagatcatcattttatttgtgcccataatgacacgctttttattcctggaaagggacaacgagaaattaaccttttaaaattaaaaacaattcaaaggtatcatcatgtggacttgtttcgtgaatacttgcatatagcaaacaatctcgaacagccactaatcgtggaactgaaagtgacaaatcattctgataaagaaatgggtaaaaggttcgctgagcaattcggtcaacagatgttaaaacaatcaaatatggtccattctgtaggatacaattatctccgtcagattaaagcaaggtatccaaaaataagagttggattagttacgatgcttaatttctctaaccttgccaagtataaagtagatttttatacgcttcagcatataacattaacgccatttttgttacggtcgataccttctaagcggccagtctatgcatggaccgatgatcagtcactaacgatgaagcgtctaagcatgatgggtgttgatggacaggtaaccgatcaagccataacattgaaagatctgacatttaatcagaaacagaattattggttattaattttaaattcgatcgtaacatatctctgattttttcgtatatcattcttagaggtgaaaataatgacaactaggtgttcatgggcgacaaaaagtccggaattaatgatctatcatgatacaaggtggggaaagcctacccgagaggttcaagatttatttcatgcaatgtgtttggagatcatgcaggctggattggcatttcaggtcgtgttaaagcatgaagaagggatgagggaagttctccaagacttttctattaattatatggcccatttatctaaatcggacattgaaaatctgtgtcaagatacaagaatgatcagaaaccgggcaaaaattgaagcactcatagaaaatgcaaaagttgtttccaatgacccggggaaattggtagatctaacttgggccccagtacactatgttcaactggatcatatgttaaccgaaccggcaaaaccggccgattatcaagaattcatcagaccatttgttgctgcattcaaaacttggggtttaaaacggatgggaccagtcacaacttatagttatttacaagctgtcggcgtagtaaatgatcatgcattgacatgttgttttcgatgagaatctaacaaaataatagtaatgtaattgttaacaacatcagcttgactacattcattatgcgtaataaaattaataccatcagtttaactagagagagaaagggaatatttctaatggctactaaaattacgggatcagcaattcgaaaggcccgaaaagagaaaggtttgtctcaaaagcaattagcggatggcatatgtactcaagcaaccatcagtttgatagaaaacagaaatgtttgtccaaatatcaatattcttaatcagatttgccaacgtttggcaattaatatgactgatgtttcttttaatcccaggtatggtgaaaaattattttcttatattgaaagtgacatgcgacgccattgctatttacaagcccgtgaaagaatgggtagagtcagctttgataaattagaatccaaacttgctgagggaaagtattattgctatcaaggattcgcagaactttacattgatgatgatattgaagaggcaatttatcatttcaattggatgttgacaaaatatccttatgaaaacctgagcttttatcaagcatggtcgaatcttggattgggattggcctatcaaaagcttgggaaaacggcccgtgcaccgaagtttatcgaagaaagtattcggatacttgaaaagattcaaagtcacaaaaatcgttatacaaatgatgatatttgcgcagtcacagatctatacattgatattattgcaacgtacgttgagcttgaaaagtttgatcgggcgttaaaattgtgtgcagttgttttaaaacgtttaacttcgacaaattcaatttacaagattgatgttgttgaggagctggcttctcggtgcttatatgcaaatggacaaattgttgaggcgacaatgcgacaatttaccgctatgtttattgctgacttacgcgggaatcatcaattgtttgaaaaaatcatgacaaagaatcaaaaacatcttattgaacttgttaaaaaagagttaagcaagaatgatggtcatgagacactgattgtttagattatatttatttgtggacatcatggacgaaaaaagagattcaaaaacaaatttatgtttgtttttgaatctcttttttcgtattaatattgtgatcaatcactggtatagtgagggttaaccaactcgcttactaggattcttggccggtttattatccaaatcagttctaacaactaaaacatcacagacagcagtccgagtaacatattcagtaactgagccgattaataatcgttcaacagcatttagaccggttgcgccaatcatgattaagtcaatattcaaatttcgtggaatatctctagcaatcactgttttaggagcaccgtactcaattgaataatctacatcgtttaaaccagctttttttgcttcatcgatgtatttatcaagagtttgtttagcagtatcggtaacttgttcaaccatcgatgtatcaaagcttgaaatattctgaaatgctcgagtatctacgacgtgtagcaagtgaagagacgcatggttcctaattgcaactgcgacaccttttttgaatgccaattcggcttcatatgatccatcaacgggaaccagaatttgattgtattgttgtatcattgtgcccacccctcatttcatctttatagtttaattgtacgttatttttgtataaatacaaagaattaaatacgactatttattatcgatgattgataatattcataatcaccatttcaagaattgtccctgcaaacgttgttgcaagaagaacaattagaatgaaaatatcgttttggataatcattgaaagaattccaagaacgcctaaaaggataaatgtgataccgccggttcttgctgctcctgacaatctaggattcttttgcacattgatttcaaacaatgtcttgtttaagtgggaaagtaggtaataaccgataaagaatgcaattattacggcaatcccaacaaggatatttatgatcattttttcactccatctattatattagcggccaaaagattgacgcagtcttaaatattgttcttttaaagctgtttcgattttaccattgttttttgggtggtaatactgggcatttttaatcttatctggtaaatattgttgtttaacccaatcatttggaaaatcatgtgggtattcgtattctacaccgcgtccaagcttcttggctcccttgtagtgcgcatcttttaatcgaagggggatctcaccatagtttcctgttttaacgtcattaagcgcctgatcaatggcagacatggctgaattggatttagggcttagacataactcgataataacattcgcaagtggaatgcggccttctggtaggccgagttgttttgcggcctcaactgcactcacggttctttcacaagctgctggatttgccaagccgacatcctcataggcaataacgatgagcctcctgattaaagaaactaagtcgcccgattcaataagtctgctggcatagtgaagcgccgcgtctacatcagatccccgaattgatttttgaaatgcagatatgacatcataatgagcatcaccatttttatcagcactcaatgacttgcgttgcagacactcttctatgacggaaaggtcaatatcgatcattttatcgtcattctctggggttgatttaacggcaagttccaaaccgtttaaggcacttctcagatcaccatttgtagtcgttgtaaggaattccatcgctggatcggataagtttacatgaaattgtcccaaaccgttcttaacatcttttaaggctcttaggacggcttgctttatatcttttggagaaaggggatggacttcaaaaatttgagttcgacttcgaatagctggattaatattaatataaggattttcggttgtggcgccaattagaataatggctcccttttcgagcaagggtaataaaaagtcctgtttggttttatctaagcgatggatttcgtctaaaagtaaaacaacggtgccactcatttttgcctcttcggccacaacttgtaaatctttttttgtatcggttgctgcgttcaaaactcgaaaagcgtatttagttgaacctgcaattgcactggcgatactcgtttttcccgtaccgggaggcccgtataaaatcatcgaagaaagcatttttgccttgaccatccgactgatgattttgccgggaccgacaagatcttgctgaccaacgatttcttcgatttttgtaggtcgcattctgtaggcgagtggttgttgcatggcatgtcctcctttattagagataaattgtcttttgtatagaaaaagacgttccgctttcgcaaaacgtcttttcgttgtcgtgaattaacctaatttgttgtagtattcaacaataagtgattcatcaatatcagcatcaagttcttcacgttgtggaaggcgaaccaatgatccttcaagcttgtctgcgtcaaaactaacgtattgtggacgacccacaacggcttcaacagcatctttaactacttgaagatccttggacttttcacggacagaaacaacttgaccaggtttaacttcgtatgatggaatatcaacgcgtttgccatcaacagtaatgtgtccatgatttactaattgacgtgcttggcgacgagttgttgccaaacctaagcggtaaacgatgttgtccaaacgtctttcaagtaagatcataaagttaacaccatgcttaccttcacggattttaccggcacgaacaaacaaattagaaaattgacgttcagtcaatccgtacatataacggagcttttgcttttcctttaattgcaagccatattcagaaagcttttgacgacgaccttgaccatgatcacctggtgcgtaaggacgacgtgaaagttccttaccagtacctgaaagtgagatacctaaacgacgtgaaattctccaacttggacctgtatatctagacataaaaaatcctccaattattttttggagtaaaataagccattgcaggtttagtattcgtgcatgttgctttgctctttcgctcaagcagccgaattgagttacttgcagaacctggattcaggcaacaacatgttgacgagcttaccacctactgctgcattattttacacgaattacattctatcgagtatttagcaattagtcaacatgtttgataaagatattgacaaagtcattcaataaggcttcatcttttgccgaaaaacgctctaacacaggggagtcaatatccagtacgccaagcggttgtccatctttaaaaatcggaataacaatttccgacttggaatcgccgtcacaagcaatatggccggcaaattggtgaacgtctgcaacccgcagcgaatgcttctgtgtaagggccgttccacacacacctacaccattcttgatgtgcatgcaagcaacttttccctgaaaagggccaagaattaattcatcgttttcaggaatgtatctataaaaaccgacccagttaatctgatctaaactttgatttaaaagcgctgatgcgttggccatattggaaaccaaatcggtttcttcatataataatgcgtcaagttgctgattgactaattctgttacgttttgcataaagtttttcctcacttaaaaataatatggtgaaacttacctactatgatataattcagtttagggcactttttatcaattattaatacataatagaatgttttggcatttttttctacaattaatgtttttttgttgtttcaatatctttatttttgaaggatgggatcgaatgtttactttgctgatagtaattatagtggtagtaggggcatgctacttgggatttgtcttttaccaacgacggacaataaaaatggcaacaagcgtttatgagagcaaaaaggacttgaacaaaattcctttggatgatgaatttgcacttgctaaaaagatgaatttaactggtgaatcaaaaaagaaatatggtcaacttcataataagtaccaacattaccgaaaccaaatattgccaagtatcgacgaactgattaaaacggttaaggaagatggtaagggaattaactttatcaagacaagaaatgattggcgcactgccaatcaaacaattcaggatgcagacgctgcacttaaagagattcaagcgggattggcccaactatatgatttaaataagcaacatcagctggctgtttcagaactcgaaaaaaaatataaacagttacgagaggatattctaaatcaaaatgcgtcatttggaccgagtattgatggacttgagaaaatgttagccaatattgaaggcacatttgatgaatttaccaaattgaccaaaagtggtgatcccagtagcgccgatgaggtgttgacagatctaaacacagccaccggcaagctggaagattatatgaaacggattccaaaactctttctttctttagataaggagttcaatgagcaacttgacgaaattcaaacaggttacacagagttaaggtctaagggttacaatttccctaatgataattttgaaacgagtgtcaacaatatccgtgatcagattcgtcacaaccttgattcactggcaaagctcaaagtcgaagatgtttctgccgttaacgcaaaaattgaagatgcaatcgatcaattatatagtgcaattgataaggagttaaaagcacgtccaagtgttgaaaagaacacaagtatcattggcgaatatgttgatcacgtgcgtaggcaaaacgaggatctcacaaaaaggcttcaggttttgaatgaaagctatgtgttaaatcaccaagagatcgaagataatcatcagtttgacagacaaattaccgggcttgaaagagaatttgatcgtgaaacgaaaagtatcgatgaaggaaaagcagtttattcagaaatcaatcacacacagcaaaaaatgctctcaagtttaaaagagttggagaattcacaaaaagaattatttgattcaattattgatttaccggaaaaagagagggacgcgcaaaatgcgctgtcaaagtttgatttggagatgcgtaacaaaaaaagacggattgacaatcaaaacctgccgggattatccgattcttatcagaacaactttgctgccgttattcgtgaaattaaccacttggatgaagaccttggcaaagcacatgtcaatattgacgatgttagcaagcaggtcattattattcagtcagacatggatactttggaagatcaaacaacaaaaatgttggatgatgctaatttagcggaacaaacaattcaatacgcaaatagatacattagttctaatccagaaatcgcctctgcaagtgtgaaagctcagaattactttgaaaagcaatatgattactcaaaaagcctgagtacgatatctgaagcattagaaaatcagtcatccggcattttctcgaagataaagaatgactactttaatgcccaaaaaccaaaacaagcatctgatactgattcaaaagacgaggatcagtagatccaattcaataaaaactgctaatcaaaattttatttatccaaaaattttgattagcagtttttgtctgcggtaagaacggtcctacttgttacaaagcccttttgggtgtatcatcgtggaagttatatttgttggagtcgaaccaataaataaagagaagaaggtttcaaatgatttattttgataatagcgcaacgacacaagcgctaccggaagtagttgacacgtatgataaagtcagcaagagtatttgggggaacccatcaagtcttcataactttggtgaacaggcatttaatttactggaacaatccaggaaacaaattgccgatttactgcatgtacatgctgatgaaatttactttacaagtggcggaaccgaaggcgataattgggttgttaagggaacggcaattcaaaagcgagagtatggtaaacatttgattacgactgcagttgaacatcctgctattcataattcaatggaacaacttaagcaactcggctacgaggtcacttatttaccagttgatgatgagggacgaatctcgattgatgatcttaaaaaggcaattcgtccagatacaacattagtttcaattatggcagtaaacaacgagattggcacaattcaacccattgaggaagcagctgagttattaaaaaagtatccaaagattcactttcatattgatgcggttcaaggaattggtaaaggaattcaagagaaaatatttaatgagcgagttgactttgtaaccatttccggccataaatttcatgcacctcgtggcattggctttatttatggtcgtcgtggtcgacggattgcgcaactgatgaatggtggcggtcaggaaaaaaatcaacgttccgggactgaaaatctgccagcagttgcagctatggcaaaagcgttgcgactattacttgaaaaggaacctaaagctaatgaaacagaacatcaaatcaagcaactgattagcgaccacatcagtaaatttgataaaataacgatcttctctaagaatacagatcaatttgcaccacacatcctgtgttttgcgattaaaggcgttaggggcgaaacaattgtccatgcgtttgaaaagtatggcatttatatttctactacaagtgcttgttcctcaaaaaaacacgttgcttcaagcacactaacggctatgcatgttccagaagatgtttctacaagtgccgtcagaatttctctgggcgaccagaacacacttgacgaggccaaagaattcatcaaagtatttgatcagttgtatgaagaatttgacaaattaagttaggagtatgttatgcactacactgaaattatggttcgttatggcgaactttctactaaaggaaaaaacaaaagggactttatccgtcaacttggtagaaatgtccgcgcagttcttcaccagtttccaacagttgaggtcaaagcacagcgagacaggcttcatgttgatttaaatggtgaagatgatcaaaaggtcatttcaacacttcaaggggtctttggcattgaaacgttgtatccttcgattaaggtagagaaggatatggatgttatcaaggaaaccgcattgcaaatggcccaggaacaatatcgctccggtaatacattcaaaataaatacgcgtcgacaagacaagcattttgagtatcacactaatcaaatcaataatatgctgggggattacgttttagaaaacattgatggtatctcagttgacgttaaaaaccctgatattgcaattcgggtagaagttcgtatgaacggggcctatctgtcttctgaaacgattcacggggccggtggtcttcctgttggaaccggtggtcgtgcaacaatgatgctgtctggcggtattgattcgccagttgcaacatacttggcaatgaagcgtggcgttaagattgatatgattcatttctatagtcccccatataccagtgagcaggctttaaacaaggctaaacaattaacctcgatacttgccaagtattcaggtaacattcaatttattcaagttccctttacagaagttcaggaaacaattaaagagaaagtacctgagggctatttgatgaccattcagcggcgaatgatgttgagaattgcggctgagattaccaagagtcgtcattgtggtggtgtctttacaggggaatctttgggacaggttgcttcacaaacacttgaaagtatgcttgcaattaacgatgtgacaagtatgccggtattgaggccacttgtatcaatggataaaacagaaattattaaaatatcaaaacaaattggaacttacgatttgtccattttaccgtacgaggattgctgcaccatttttacaccgcctgcacccaagacaaagccaaacctgcaacgttctcgggaatttgaaaattatattgatgttgaggggcttatgaagaaggccgttgataatatccaaattacggatatcaaaccgggcgaagagtttttgaatcaagatgccgatgtttttgctgaattgctataaattcatcggattgcttgcttaaacttgcagaatgggctacattatttgtaaacttaacttactcaagacacaccaagggagtgtttgtatgcaagtcacaatcaatggcaaagatgaaaaattgtttggtaatcctccggaagttggcgaacagcttccaaaatttaaattagaaaacgctgaaggaaataaagtaaagacggctgatattattggccgaattactttaatttcatccgttccagatattgatacaccggtttgttcattggaaacaagaaaattcaaccaggaagccgataaatatccggatgcgcgctttttaacgatttcaaacaatacgcttgagcagcaaaaggattggtgtgctgctcaaggagttcgtagtttgcaattgttatcagatgagagtctgtcttttgggtacgcaatgaaattgtatatgccaaattttggtgcactggccagaacaatttttattgttgataaaacaggtaaaattgtttatcgacaaattgtaccagaaataacggatgaacctgactatcaagatgccttgtcagctttggaaaaattggcaaagcgtattgacgattagcagattgttgagtaagattagaattaaattaaagcattgatcaagagagtaaccaaccgttgcgtttcagaaagagaattgataatggaaaattcttacgcattgttgggtgaaagtaacttgtgagctactcgttcgaaaatttgagagcgggtcggtactatctgaccgttatcaggatactgagtggggttgaaatatacccaatttaggtggtaccgcgaagcacttcgtcctaatcgtatttattgggatgaagtgtttttattttacatacaagaagggagaaacatcatgtcagaaaaagacacaaaagcgtcaacacaaagcaccgaaatgtcgacgaaatatgatccaacggccattgaaaacggcagatataatgaatggcttcaagaaggcgtatttagaccaagtggggataagaaggcaaaacctttttcaattgttttaccgcctccaaatgtcactggtaagcttcatttaggccacgcttgggatacaacactccaagatatgatcattcgtaagaagcgtatggagggatatgacacgctttggctgcccggaatggatcatgccgggattgcaacccaggcaaaagttgaagctaaacttcgtgaacaggggatctcccgttatgatttgggacgagagaagtttgtcgaaaaagtttgggaatggaaagatacatttgctgccactattaaagaacagtgggcaaagcttggtctttcgctggattatgaacgtgaacgttttacgctggacaaaggattgtcaaaagctgttcgtcgagtattcgttgatctttacaacaagggtctgatttatcgtggagaatatattatcaattgggatcctcaagcccgaacggcgctttctgatattgaggttatccataaggatgataagggtgccttttatcacgttaaatacccgtttacagatgggacaaagtttaatggaaacaattatatcgagattgcaacgacacgtcctgaaacgatgatgggggatactgcagttgctgttaatcctagtgatgaacgttataaggcaattgtaggcaaaaaggttcttgtaccacttgttaatcgggaagttccaattattgctgatcagtacgttgatcctgaagaaggtactggtatggtaaaaattacacctgcccatgatccaaatgactttaaagttggaaatcggcacaaccttgagcggattaatacgatgaatccggatgcaacgatgaatgaaaaagctggcaagtatcaaggcatggatcgctttgaagctagaaaagcaatggtgaaggatttacaggatcaaggcttgattttaagtattgaacccattgtccactctgttggtcattccgaaagaaccggcgttcaagtagaagcacggttatcaacacaatggtttgttaaaatgaagccattggctgaacaagctgtgaaaaatcaagatacagatgataaagttagcttctttccaccccgttttgaagaaacatttacccagtggatggataatgttcacgattgggttatttcccgtcagctttggtggggacatcagattccagcatggtataacaaagacaccggtgaaacttatgttggaatggaagccccgaaagatgccgaaaattgggaacaagatcccgatgtgcttgacacatggttctcttcagcgctatggccgttttcaacgatgggctggccggatgatactgatgacatgaagcgatacttcccaacggataccttggtaaccggctatgatatcattttcttctgggtatcacgtatgattttccagagtctcgagtttacacatcgccgaccttttaaagatgtcctacttcatggtctgattcgtgattcacaaggacgtaaaatgtccaagtcgttggggaatgggatcgatccaatggatgttattgataaatatggtgctgatgccctcagatggttcttgtcagttggtggaacacctggtcaagatttaaaattcagttatgataaaatggattctgcttggaattttattaacaaaatttggaatgccagtcgttacgttattatgaatttagatggcattgagaagccgaaattacctgataaatttgagtggcagttatctgataagtggattttaagccgattaaacacgacgatttctgaagtatctgaacttttcgataagtataattttggagaagcagaccgaaaactgtacgacttcatttggaacgacttctgtgattggtatatcgaaatgagtaaggaagccttgactggtgataatgagaagctgaagaaaaacactcaaaatgttttagcttatgttttggataaaatcttaagattactacagccaattatgccatttgtaacagagtatctttggcagaagatgcctcatgaaggaaagtcacttgtaacagcagaatatccggtttcgaatcaacaatttgacaatccgactgctgaacatgaaatgcaatcgttgattgatttgattaaggctgtcagaaacattagaaatgaggcaaatgcacccctttcatcaccgattgatatgttggttcaaactgagaatccaacattgaaacaaatttttgaaacaaatcgtgattatattgatcgattctgtcacacgcaggaattaacaataggcgacaaagttaacgcacctaaattatcaatgtctgctgttatcacggacgctaccatttatgttcctttggccgaactggttgatttaaatgaagaaaaagatcgggttcaaaaggatattgataaatttgaagctgaagtggttcgttctaccaaaaaactagctaatacaagatttgttgacaatgcgccagaagcggttgtcaatgaggaacgacagaaaaaagacgattatcagtcaaaacttgatgctgctaaggatcgacttcaacaggtgactagtgagttataaggataaataattaagtacatgattttgaggggaccagagcattttattactttgctcgtggttccctcgttttgtgaggagcaattgataatgacgattgaaacgtatgatcaagctttggcatttattcatggcaggactaaatttaaaaagatcccgacactcaaaaggatgcgtcggtttttggatgaactcggatcaccggacaaaaggataaaagccattcatatcgctggtacaaatgggaagggatcaacgattgcttttttgagaaacattttgcaggaagacggtctaaaagtcggcagttttacatcaccctttttaatccgatttaatgaacggattagtgttaacggtaagccaatttccgataatgacattttacggctaactaacattgtttatccagtcgttgctaaattggatgatgctttacttgagggtggtcctacagaatttgaaattatcactgccatgatgtttgaatatttttcagaaggccatgcggatattgtccttgtggaagttgggctcggcggtttgttggattcaaccaatgtgatgacccctgaattatctgttattacgacaattggttgggatcatatgcatattctaggggatacgttgcccaagattgcctatcaaaaagcagggattattaagcccaaggttcctgtagttgttggtaaaatacccgaggcgccgctaaaagtaattgaacatacagcctccgggaagaaaagcccaatgacgattttaggaaaacagtttacagtgaacaacttgggaatgattgattgggaacaacacttttcttttaagtcggatcatgacgagtttaatgatctttcaaccgggttgattggtgattatcaaactgataatgcagcactagccattcaggcctatctgaattattgccaactaagcagcagaccagttaatcataacagtgttattgcaggtattaagcaaacgaagtggggcggtcgttttgaaagaattagcgatcatcctacaattgtcattgatggtgctcacaacatttcagccgtagacgaaattgtagatctattggaatcaaatttttctaaaggaaaagtatatgtgttaatgggcattttagctgataagcaagctgataaaatggttgaaaagatggcaacggttaaaaatgtttcaatcattttgacaagctttaatggaccgggtaagcgtaacgcggccgatccgcaagtacttgaagagcaagtggattcaaaagaaaacaagaaaaccgtaacggatgttattgatgattggcaagcggcgattgatacgattcaaaaaaaacttatgacagatgatatgctgttaattactggatcactgtattttatttcggatgttcgcaagtatttattggcgtctttgaactaaatttcaaataatatcttaaatcattctttcattccttggatttagttcatttttacgtccgttatgatatacttatttcgttaaacaataattaatttataaaataacatcaaaagcgaaatcaacatgataaagcgatgaagggatggataacgtgttcggacttggggaaaaaaacataggaattgaccttggaacagctaacacaattgtttacgttgaaggaaaaggtattgtccttcgtgaaccgtcggttgttgccaagagtactaaaaacggtgatattattgccgtgggtgaagaagcccgtgccatgattggccggacccctgccagcattaatgctgtcagaccaatgaaggacggcgtaattgcagactatgatacaactgttgcaatgatgaagtatttcattgaaaaagcattgggacattcatcgggcaaaccatatgttatggtttgcgttccaacgggaattaccgctgttgaaaagcgcgcggtaatcgatgcaacccgtgttgcgggtgctcgtgacgcttacgttatagaagaaccatttgctgctgcaattggagccggtttaccggttatggatcccacagggagcatggttgttgacattggtggtggtactactgatgttgcaacaatctcacttggtggtattgtttcaagccgttctgtcagaatggctggtgataagctcaacgaatcaatcgctcagtatgtccgtcaaaaatataacttattgattggggaaagaaccgctgaacaactgaagattgacattggatcggcttctccgaaagctgctaaggatattgaggctgttcctgttcgagggcgtgatcttgttacaggcctgccaacaacggttcaagtgactgggtctgatgttaacgaggctatcaatgaatccgttgctgagatcattgcaacaattaaagaaacattggaagaaacatctcctgaaattgctgccgatgtcattgatcatggaattgtactcacaggtggcggtgcgttacttcgaaacattacagatgtgattgccgaagccactcaggtgccagtttcaattgccgccgatccacttgactgtgtagcaattggtacaggagaatcactgaaaagtatcaatgttatgaagaaaaaacaataaacaataaacaattttacctgaatcacttaaagatttaggtaatttatgaaacggatggaggcaattatgcaaaaatttttctccagtcgaaaacttgtcattgttattgtatgtttgatcattagctttggcttaatgtcagtttcagttgcatttagaaacaatcgaaatacaccaccgcttgttcaacagtttggtaacgacattgttggatttgccgaccgggttgttgccgttccaatgaatggcatccaccatggatttatttcgattaacaatcttttgaatacgtatcaggaaaatcaaaagcttaagtcaaaggttgatcaacttgcacaaacacaggttaaagatcaagttttagagcgagaaaacaaacaactgaagcgtcagcttaatgttggaagcacattaacaggttacgaaaaaatcaatgcggctgttattactagaacgccttcatcttgggcaagccaaattattattaataaaggtcaagctgccggtgttaagaaaaacatgccggttattgccggacctggtttgattggaactgttgctgaggttaataagaccaacagtaaggttgtcttaatttctaataccgcagaaaattcgaaccggtttgctatccagattgttggcgaagggtcaaggatagttaatggtattatcacctcatatgattctcaaagtaatcgtatcatcatgggtaacatcacctcgaaagccaaactttccaaaggtgaccgagtcacaaccagtgggctgggcggcatcattcctaagggtatttatgttggaaccgtgtcaaaaatctcagaagatgattatggattggccaaaaaagtttacatcaagccggcagctaacttgaacgacatcgaagtcgtttcggttgctgttcgaaattgatagggggctgttctgttgagacgaagaattcctatcacaattatttttgttgtcggtcaatttattgctttcttcctagacgggtcaataagtcagatcttgtcgggaacgttatataagtatcctaattctttagttcctgcattgacattgctatggttagtactagcagtcttctttggtgatcgtaagaaactgcatttagggatctgggctgctgtaatcggctttatctttgatatgtactacacaggtttattaggagtctatgtattcatttttccactggtaatttatctttgccaaagtgtttaccaaatgttaccgccaaactttatgagcggttttttggtttattttttggggattacagtatggaccactcttgggtttattgcgaatgcgtttatcgggcagacatcttcatctgtcgcccaatacttggtcaacacgttagcaccgactctggcaattaaccttgtattcatggcactagcctattttccagtggcctcattgtataggagtcataggcggtaaaaaggggagtcgtatatgcaagatgcagctgtattgaaaggtacaaatgatggttacgagataattttagatgatgaggctgatttaggtgatatttatacgtcactaagaagtttgctcgagaagcttagaactcagactgcttctactcatcctcaaccaatttcctttgatatccaaactggcctgagacttttgtcagctggtaatcgttccgaaattgaaaagattttttctgactttcagcttttttcagtccacaaaattacgtcagatgtgatgactaaagaagagtcaaatcgaattctagatcaggaaacggttcacgtagttgatcgcatcattcgaaacggacaagaggttcacgttcagggagatgtggtgtttctcggcattattcatgagggcggtaagctttttgtaggcggaaatatttacgttcttggcgatgttcatggcgtcattcaagcgggattccctgatttggaagataaaatgattattggggatgtacataacgcgcaacaagtccggattggtgaacaatacgagattcttgacgataccaaccaaaagattacagaaaactcggttgtatatgtgaatgatttgcacgtcttagactatggaaaagttgaagatcttaaacaaattaacccaaagttctttaatcagataggaggagtcatcaatgggtaaagcatacgtcattacttcaggaaaaggtggagttggaaaaacgacttcttcagctaatattggtactgccctcgccatgcttggaaaaaaagtttgcttgatggatttagatattggtctacgaaatttggatgttgttcttggactggataatcgaattatgtatgatattgttgatgttgcatcaggaagggccagtcttgggcaggcactggttaaggacaaacggtttgatgatttattataccttcttcctgctgcccagaatactgataagacggcgttaactcaagatcaggttgttcagattgttaacgagataaagccggattttgattatgttctgattgattgtcctgctggcatcgaacagggatttatgaacgccattgcgggcgctgatagtgccattattgtcacaactcccgaaatttctgcagtaagggatgctgatcgagtggttggattgcttgagcaacatccgcttcaagaagaaccacatttgattattaatcgaatcaggactcatatgatgaaagacggttctgtgatggacgttgatgagattacccatcatttaggcgtagaattactaggcattgtatttgatgatgatgctgttattacaacgtcaaatcaaggtgaaccagtggttcttcaagctgataatccggctggtcaagggtatcgggatattgccagacgtcttgaaggtgaatcggttcccctaatgcagatgacagatgaagttcatccctcattttggaaaaaaattggtaattggttcaaaaaggggtaaatactgcttgacggatgacgattttccgattatcattgttaccataaattaaaggaatataaaagactatgatcagaatagtaaaccatattaaatttcagaaagctcatgatgatgggaaatgggtatttgaatggtttgcgtcacatctgggagtcattttcctgaatgaagtagggaaaagcggtgagcacgttattgctgaagtttagttttctaaactcgttgagacttttcatatgaatggaaagtgaagctgaggtggaaccgcgattaataatcgtcctcttaagtcattagacttaagaggcttttttgtatagaaaattaaacttcatgaggtagtaaatgtgaatttactacaaattggggtggaaccgcgaaaactatcgtcctcttgagtctattaataactcaaggggatttttttatggagggatgtcaaaatgattcaatatatcgagcaaattttaccggcactgttgtcaggaacaaaaatgaccttatcaattttcttttggacgttaatttgttcaattccgttaggagcggttttagccttaggattagtcagtaaatttaagccattagtttggttgttaaatctgtatgattggttaatgcgaggcacaccactgctactacaattaatttttgtgttttatggattacctgttattggtattatatttgaacgttatgacgcggctttatttgcattcattttaaactatacagcatattttgcagagatttttagagggggatttcaatcagtaccccgagggcaatttgagagtgcccgtgtgttacggttatcctatggtcaaacgatccgaaaaattattattcctcaagtgtttaaaatcgttttaccgtcaattggcaatgaggtcattaatttggttaaggattcatcattggtttacgttatcgggttgggagatcttttaagagccggaaatgtagcaactgccagagatgttacattgctgccacttgtacttgttggcattatttatctggcattaaccgctatttgtacgatcgtgctaaaggtgattgaaaaacgttcaagtgtttggagataagggggtattgacatgttggagataaggaacctaacgaaaaaatttggtagtaaaacagttatcaataacctgtctatgacggttaacgataacgaaattatggcgattgtcggcccctctggtgctgggaagacaactttacttagatgtattacgggccttgaaagagttaatagtggtgctttttattgggatggtaaacaatttgatcctgcaaatccggataaaggtgacacgattatcggtgttgtttttcaagattatcaattgtttccaaatttaacggtgatgggaaatattacattagcaccaacaatggttaaaaaagaatcaaagagtcaagtaactgaaaatgcaatgacacttttaaagcgtttgggtttggaaggaaaagagacattatatccgtatcaactttctggtggtcaaaagcaacgagttgccattgtccgcgcacttgcaatgaatccaaaaattctttgttatgatgaaccgacttcggcccttgacccggcacttcgagatgaagtggctcagattattttggatctgaaaaaacaagaaatgacacaaatagtggttactcatgatatggaatttgcgaagcatgtagcagatgatattaagcgagtcgaacaaatccaatagagagaaggattaacatgcaaaaagttgtaaaaaaatgcccgttagtcatcgttacccttctgctaatgtttgtattatccggctgtcgctttgaatcaaggcaaaaaatggaaacaaatccagatacctggtcaattgtttccaaacaaaagaaaattgttatcggtttagacgatagttttgttccaatgggttttgaaactaaaagtggcaaaatcgttggttacgatgttgatttggctaaggcggtttttaagcaatacggcattaaagtagatttccaaccaattgattggtcaatgaatgtgactgaactgcggaatggaacaattgatttaatttggaatgggttttctatgaatcctcaaagggcaaagaaggtcaccttcagcgaaccctatttggttaataaacaggtattgatttctaagaaaaaaaatcatattaatagttttgcggatatgaaaaatagagttgcaggtgttcaagctggatctgccggggcaatggatattgattcacagccaaagctattaaaggatcgaattaaaaatcacacacctattctttatgattcatttacagaagcatttattgacttaaattcagatcgaattcaaggattattaatcgatagtatttatgcggggtactatattgggcaccaaagaaatcgggcaacatatcaaagcgttccaagtcaatttcctaaagagtattatggtgttggaatgagaaagggagatactaaacttaagcagaaaattgatgctggtttaaatcgactggctaaagatggtcaacttgcaaagattaataagaaatggtttggaactaatgcttacagtcccttgatgaaaaaataatgacagcaatggctatttttgagtttgaacaatcggaatttgttcaaactctttttagttatatattgagatttcgatgattttacattaagatgaaaattgtgactaattgaggaggaaaactattgaatattcagattgcacaaggtgttgatttaaaagtaattcagaccagtcaatttaaaaataatacgatcgtatttaattttagcataccatccaattataaaaattttgctaaattagcattgttagcggatcttttagaaaatgcatcgttaaaatttcccagtgagatgctcgtttcacgtaaattatctgagatgtttggcgctagttatggcgttacggttcttcgttatggaaatcagcatacgctaagaatcaggttaacttttcccaataaccattatttacctcacaaggaggatttactaaatgacgcgatggcttttcttcgggaaatgattgaacggccctttgcaaaaaacgatcaatttgacgcccattattttaaaatacatcaaacaaatttaatgagctatctggactcgatttcagataacaaggaattctattcaactcttcaacttcaaaaattgtattatgcaaatgaccttaatcaagggacctatttactcggcaatattgacagcattcgagagcttaatgcaagtgatctatacaacttctatcgggcgtttattcagcaggctactgttactgttattgtagccgggcagatagatcaggcacaggtggtctctcgattaaaatctttttcaacattaagtgatcgaaatgatttaggacttaagctatttattgaacctgagcttccaaaagttcctcgtgaaaaaacgactgtctttccgggatcccaatccctgctcaacattggttatcgcttgcctatctactttggcgatgattcatattttgctgcgaacgtattcaaccagatctttggagcgtcaaccagatccttgctatttacaaatgtccgtgagaaggctagtttagcctatgatattcatagtagttataattcgttttcaggaatgctgagcgttcaagctggaattgaatttaaaaatcttagccaagtcattcaaacgacggatgatcaattgactgcaactgcagatatggcttatcctgagagtctgctggctggtgtcaaaaaatcaatgatcaatcaacatcgatctcagtcggattatttatcaactttggctgagcgacaatatgtgcgtcaaatctcaggcgtagcgtttggtgatagccaatgggaacaattagtcaatgacgttacaaagaaggatgttgccgaggttgcaaaacgggtccagtatcaggcacgatatattcttcaaagccagggggacaatgatgaaaacaattgattatgcttcgtttaatgaacaactttttgttgaaaaactggagaatggactaaccgtttatttacaaccaaaaaaaggatttgaaaaatcaattgccatattgggtgtcaattatggatcagttgatacggattttagtattaacgggacaccggtcagtcaacccgccggtattgcacattttatcgagcacaaaatgtttgataaaaaggattatgatgtttttgaattattcaataagaccggtgcttctgccaacgcttatacaagttttacgaagacaaactatttgttctcaactactgaagacttaagggataatttgcttatcctgcttgattttgttcaaaagccatattttacgactgagaaaattgagcgtgaaaagggcattattgatcaagaaattaatatgtatttaaatgatcctgataatcgaatctatttccagacaattcaagatctttatcctcaatcaccattatccgaagacattgccgggacagttgatagcgtttctaaaattactttggctgatgttcaaagggcatatgaaacgttttatcgtccggataatatgtcattgtttatcaccggtagggttaatccagaagagacgctttcatggatcaaagagaatcaacgtcaaaagtcgtggtcggttccagcagtcattgagcggaaccttgtttttccaacggttgctaatgataagataaataaatatcaaatggcgatctctcgacccaaagcgtccattggcattagagggaatgattcggttccccgcggtcgagagggattggcatatgaaattgccatttccctagtattagatttattttttagtgaaactgccgaagattatacgcaactgtatcaggacggtgttcttgacgattcattttcttgggaatttgaaaatgagcgtggctttcactttgccattctgaatggtgatacaaataaaccacaagattttatagataaattgttaaaaatcattcgacaaatcccaaagaaattgtctggtatgtcgagtgaatttgaactacaaaaaaaggaattgttgggaaattatattgaaatgatggattcagaagaggcaatcagtgggcaatttgatggatttttaagtgaaccactgacaatttatgatgaagttggtattttggattccttaacgctggaacagacggttgcgtttgccaagcaatattttgattcggcatctattctatctgaaattattcaagcaaacgactaacttatactttctttaaaataacttggctgattcatatgatatactgaaaacagatgatcaattaattttaatggagaaatgagaatgaacgacgaaaaagataatttaacgattggtaagaagttacatgatgcccgagttgcaaagggctatacactagatgatctacaaaaaaatacgaaaattcagaaacgttatctgattgcgatcgaagataatgactttgattcgcttcccggtgaattttatgtccgtgcatttgttaaacagtatgcggattctgttgggttgaatggcaatgaactattgtctcaatttgatactaaattaccagacacagaagatccggaatatgtgaaccgagttaacagtgataatcccaaaactcgatcggcacaacgtcaggtagatcaacggaatgaaaaaatcagaagatatattccggtagcttcagtgtcagtggtggttctggtaattttaattgcaatctgggtcgctgctgctcacagtacacgagatacatctaaaactcagattgagacaagtaaagtttccgtatcaggcaacaagagctcaaaagccagttcttccagttcaagttcagcagcaaaaaagaatactaagaaaaaggccgcaacaaagaagttagtattcaaaaagctgactgaatccggcagcaacgttacttatcaagtaaccggggcttcaagtaaacccaaaataaaaatcgcgacaaccgggtccggtagcgcttggacttccgttagtgctaatgggtcaacgctttggcaagcagctcaagccggtgggaagtcgcacactgttacgttaccaagcagtgtttcaacagcaaccattaatactggtaacgcacctcaaactgttatttatgtttcaggaaaacggcttaagctttccgatccaagtgatggcagctcaaatcaagtgcgtgttgtgacgcttcaatttggaaaatcaggttcgaccaccagtacatcaagttcttcaacaactgatagcagcacaactggtacaaccggttcgtcaactaccggttccacagaagggacatcgtcaactaccggaactaccggaactacaggaactaatgatacgactggtaatacaactaccggtacaacaacggggtcaactactggctactagttttaatctgttggagggaatttgatgaatttacctaataaacttacgatttttcgaattattttaattccgttttttattttaatattggctgttccaattctttcagggagtacggttgttgctggcacggttatcagctatacacgctggttggcagcattaatttttattgttgcttctgcaacagattttcttgatggtcaaatagctcgaagacggcatttggtcactaattttggaaaatttgccgatccgatggctgataaaatgttagtgatgacagcatttatctttttggttgaattgaacgaagcaccggcatgggttattacaataattgtttgccgtgaattggcagttacgggactaagattaatcattgttgagaatgatggtaaggttgttgcagctgcatggccggggaaaattaaaacgactactcaaatgctggcaattatttttttgctgttgaataatattttctttgatgcaattaattttccgtttgctcaagtcatgctatacatttgcctgttctttacaatttattcagggattgactattttgttcaaaatcggtcggtgtttgcagattcattttaaaaatgtcaaaataaaggggttgggacaaaaagcttatttttgcccaacctctcttttacgatggttttaactttgacttaaaatctgtattagttggtcgtccatgattatttaatcaaattaaccaattactcacactaaatcgaccaaataacctgacttagtcgtcattactctttttgtactaatgatcaataatgttgaaataagatcatttgtttttcgtatataattattgaaaggggtaggtaaaattgtcacttgaacaaaaactggttgagcaattattgaagaagcatattacaattactgctgcagaaagtctaactgctgggctgtttcagagcacattggggaatgtctccggtgtttcaaaggtttttgaagggggatttgtcacgtattctgataaagttaaggaacagttgctacatgttcctcacgatgttattgctgaaaacagtgttgtcagtgaaccgacggctatctggatggcagatcaagcaagacgaatcatggataaagacttagcggtttccttcacgggggttgccggtccagatgccttggaaggtaatcctgtcggaacggtttggatcggaattgcgtttggggcacaaattagttatgctaaaaagttccagtttgaaggattacgtaatcaaattcgtgaagctgccgttgaggctggattaaaaatggcattatccgctattacgagtgacaaataaattagaacttttgttcgcttttttgttgctttttcgaccaaatgtttgtatagtaagtgagtaatcttttcaatttagaaaagtgggaggaatttcatggctgaccaaagaaaagttgccttggataaggcgctaaaaagtattgaaaaagaattcggtaagggttcaattatgcgtatgggtgataaggccgatacacaaatttcaacaattccaactggttccctggctttggatgaagcacttggggttggtggctatccgcgtggccgaatcgttgaggtttacggcccggaaagttcgggtaaaacaaccgttgctttacacgcggttgcagaagttcaaaaacgtggtggaacggccgcttatattgatgccgaaaatgcacttgatccagtttatgcaactcatcttggtgttaatattgatgatctgttattatcacaaccggatactggcgaacagggtctccaaattaccgatgccttggtcaccagtggtgcaattgatattgttgtaattgattcagttgctgcgttggttccacgtgcggaaatcgaaggtgaaatgggtgatacccacgttggccttcaagctcgtttgatgtcccaagcgttaagaaaattatcgggtacgattagtaaaacaaagacaatcgcaatttttattaatcagattcgtgaaaaagtcggtgtcatgtttggaaatcccgaaacaacacctggcggtcgtgcactaaaattttacgcgacaattaggctcgaaattcgacgagctgaacaaattaaaaatggcactaatattattggtaatcgtgttcggattaaagttgtcaagaacaaggttgcaccgccatttaaacgtgcagaagtcgatatcatgtatggtaaaggtatttcccagtccggtgagttggttgatatggctgttgataaagatattattgataagtccggctcttggtattcatatggtgaggaacgaattggccaggggcgtgaaaatgctaagggctatttggaagaacaccaagatatgtacaaagaggtcgagagaaaagtccgtgatgcttatggcataccagacgatgcggatactggcaactcgactaaagatagttcaaatgatgataagggtacaaataaaaaaacaagcgacaaaaagactgaaaaacctgtcaaaactgccgattccaactcaaaatcagtcgataatattgatttaaatattggaaaataaaattataaacaattttttgaagattggattccttccctgcaagagaagcgtacccaatcttcttttttcttaaaccgttggtaatacaggcattattacgactcatgtatttgatttaaccgctttggttattctaattaatcggttaataatttgttgtatatagcaatcaattattagcctgcaataagatgattgacactgccctcaacaaacattaaaattaaggttgtgtcaataatcaaataacatcttataattggtttagaaaaaaatcatttttatgatgatttggaggtgaagccatgagtatggctggaataatcctcgcaatcatcgctattattgttgttggttttgttggtattctaagttttctaatcgggaagtctgcacagaaaaagatccaaaaagcgaagctggaggatgcaaagggttctgttaaatcaattttggctgatgcaaataagcaagctgaaactgttattaaggaagctactttgtctgctcaggaaaagaatcaccgctaccgttcaaagatcgaaaaagaattaaagcaacggcgtgcggaaattcaaaagcaagaggatcggctgctgcaacgagaggaagctcttgatcgaaaggatagcactttcgagcgacgcgaaaatagtctaaatcgcaaagagcagaagattaaccatgaacaacagaatttagttacacaacaagaaaaagcaaactcacttattgaagcacgtcagacagaagttgaacgggttgcagggcttactcaagatgaggctcgcaatgtcatcttaaaggaaaccagtgatcaattggctgaagaaaaagccagaatggtcaaggagagttattatcaagctcaatcggaagctgataaaaacgcaaaggacttaattgttgaagcgattcagcaaagttctgctgatgtcgtttctgaaacgacagtttcggtcgtcagtcttccaaacgaagacatgaaaggtcgaattatcggacgggaaggtcgaaatatccgcacatttgagacgcttacaggaattgatctaatcattgatgatacacctgaagctgttgtattaagcggtttcgatccgattcgtcgcgaagtcgccaagatgacgcttgaaaaattaatcaaggatggccgaattcatccagctcgcattgaagagatggttgataagagtcgaaaggaacttgatgaacgtattcaagaaatcggcgaagaaacactttttgatctgggcattcattcaatgagtcccgaaatgattaaaatggtcggcagaatgaactttaagatctatcaaggtcagaatctactggcccattcaacagaagttgcaaagctttctggggcgtttgcttcagaattaggtgaggatgttactttagctaaacgcgcaggattattacacgatatcggaaaggctgttaataatggcgttgttcaaggctcacacgttcaagtgggcgttgacctcgctaaaaagtatcatgaaagtccagttgtaattgacacaattcaaggttatgaggatgagcatcagccgaaatacattatttcggaattggtagcagttgctgaaaaaattgcaatttctcgtcctggtgcacatagcgaatcacttgagagctttgttcaccgtttggatagtcttgaaaaaattacggacggctttgacgatgtacaaaagagttacgcaattcaagcaggaagagaaatccgtgtcattgccaaacccgacaatatcactgacacgcaggcgatagtgcttgctagaaggattaaacaaaagattgaaactgagatgaaataccctggtcacattaaagtgacagttatcagagaaattcgttcagtcgaatatgcaaagtaaaagatcaggctatctggtcttttttcttttataatagataatgttagaattgtttaaatacaaatattagaaagtgtaggatgatctaatgcgagttctttttattggggatgtagttggggacaaaggcgtttcgatgattgaaacctatttgcctaaaattaagcaagatgtaaaaccacaagtaacggttgtgaatggagaaaatgcaacgcctgtcggccgtggcattagtcaaagtatttataaacgtttaatgagttacggtgttgacgttgtgacgttaggcaaccatgcctggagtaatagtgaaatcctagactttattgacgatacaaatcggttaatcagaccgtataatttcccgaagaatgttacacccggaaagggatatacattgattaacgtaaatggcaaacaactagctgttctaaattttcaaggtcgcgtttttatggataatttggacgatcctttttccttagcaaacgatttagtaaacaaacttaataaaacaacaaattgtatttttatggattttcatgcggaagctactagtgaaaaattggcaatggccagatatcttgatggaaaagtgtcggctgttgtcggcactcatacacatgttcaaacgaatgatgctcgaattttgccacaaaaaacagcatttttaacagatgtaggtatgactggaccagccgatggcatgctgggcatgaagccggatagtgtcatttcaagatttttaaatcaacgtccagccagatttcaagtattggaaacaggccgtggcattctttccggttgtgtgattgatattgatgataaaagtggtcacgcaacgtcaatcaaaacgattctttatacggatgatcaggtgattggctaaagaagctgcttttattagcgaataaacaaaacatagtataaaatgaaatttatttcatggtctttaaggggcgttacaattggcaaaaacacaaacacaaacaacaccaatgatggtgcaatatcaaaaaattaaagatcaatatcctgatgcattcttattttatcgattaggagatttttatgaactgtttaatgatgatgcaatcaagggatcacagttattggaattgacattaactaatcgttctcggaatgctgaaaatccggttccaatgtgtggcgttccacataaagcagctcaaaactatattgatattttggtggatcagggatataaagttgctatttgcgaacagatggaagatccaaggttaaccaaaggaatggtcaagcgagcggttatccagcttgtgacgcctggaacgcaggttgatgtcggcagtcaaaatgcaaagagtaataattatttaacggcggtcacttatgatcaagataatcgagtgtttgggttttcttatgcagatctttcaacaggtgagctgaaagttgctaaattggatacacaggctgaattgattaatgagctcgtgtcacttcaaactaaggaaacggttgttggtagccgttttccaaaaacaattcttgaaactattcaaaaattaggaattttgatttctcaccaagaagcgttaccgattaatgcgtctgtcagttacctaagtcaagacgttgataaggagcctctgaagcaagttgttaagatgctgctggattatattcaaacaactcagaaacgcagcctacagcatttaaaacgtgctgtcgtgtacgagccgtcggacttccttgaactggaccacaactcacaatataatttggaattgacacgaaatatcaggaccggcaaaaagggcggtacacttctttggctgcttgatcaaactaaaacggcaatgggcggtagaaagttaaagcaatggatagaaagaccattggtaaacaaatcaaaaatttccgaacgacaggatgctgttggcgttttacttgaccattattatgaacgcagtcagcttcaagatgaattaattaaggtttatgatctggaacggttagctggacgaattgcatttggcagtgttaatggccgcgacttaattcaattaaaaacgtcacttcagcaagttccaaaaattaaatacattcttgaacagattgctgataatagttttaaagatatgctgaaagacttgataccactggatgacattgtagatgaaatctctcgatcaattattgaacaacctccaatatcagtgaccgatggcggtgttattaaagatggattcgatgatcagcttgataagtatcgtgatgcttcaaacaatggtcaaaaatggcttgcagagcttgaggcaaaagaacgtcaagttacgggcattaataatttaaaagttggttttaaccatgtcttcggatattatatcgaggtaacgaaggtcaatttaaataagattcctgaaaatcgttaccaacgtaaacaaacgttggcgaatgccgaacggttttcaactcccgagttaaaggaaaaagaagcattaattcttgaggctcaagagcaaagcaagacgttggaatataaactatttgtccggattcgtgatgatatcaaaaaatcgattaaacgaattcaagcattggccgatgctgttgcttcaattgatgttcttcaaagttttgccaatgttagtgaagaataccggtttatcaggccaacattgactaatgatcatcgggttaaagtaattgatggtcggcatccagtcgttgaaaaggtgcttggtcatcaacaatacgtacctaataatgttgacatgggagaagacaccagtgtgttacttatcaccggaccaaacatgtctgggaagagtacgtatatgcgtcagatggcactttgtgtcattatgaatcaaatggggtgctttgtacctgccaaaaaggcgactctaccggtttttgataaaatatttacacgaattggtgcggctgatgatcttatttccggtcaaagcacgttcatggttgagatgaaagaagccaatgatgctattgaaaatgccacaccaaacagtttgattttattcgatgaaattggtcgaggaacagctacttatgacggaatggcacttgcccaggcaattattgagtatgttcataataatatcggtgccaaaacactattttcaactcattatcatgaactaaccagtttggatgaatctttaaaacaacttcagaacgtacatgttggtgcaactgaatcaaatggggaacttgtctttctccataaaattcaaccgggaccagcggataaatcatatggtattcatgttgccaagttggccggcttaccaaatggattattaaaacgtgccaatcacattttaactgacttggaaaagaaagatgaccaacccgataagatcaatgcaacaccatctaagcaaaaccatgacgaacgtgttaaaactaaacaagcgggagaagaagagcagatctcattatttcctatggagcaggtagatgataaccaggaagaggttgttgcccaactcaagaacctggatttaatgtcaaaaacaccaatgcaaataatgaatcaggtttataaatggcagcagaagataaacagagagtaaggtggtcgatttgaaacaaattcatgaattaccagccatacttgcaaaccaaatttcggcaggagaagtggtcgaacggccagcttctgttgttaaggaattagttgaaaatgcgattgatgctcacagtaccgaaatagatataacagttgaggattccggactaaaggtcattaaggttgtggatgatggtgatgggattgatagttctcaggttcaaactgcttttttgcgtcatgcaaccagcaaaattacagaacagcgggatctttttcgagtacggacacttggattccgtggtgaggcactgcccagcattagttcggtatcgaatgttgagctgaaaacgtcaaccgggtctgttggaacagaagttgtcttcaagggtggcaaatttatttcacagcaggcttctgaatcaagaaaagggactactgtgattgtcagttctttgttctataacacacccgccaggctaaaatatttaagttctcccaatacggagctttccaaaatttctgatattgtgaatcgactggctttaagccatcccgaagtttcgttttcatttatcagtaatggccgtgaacttcttcgaacatccggcaggggagacctgcttcaggttttaggcgcgatttatggcgtaaaaaccgtttcgaaaatgcagcccattaaatcaaagacccctgatatttcgattgatggttatgtcagtttacctgagttgacccgttcaagtcgaaattacatttcattgattttaaacggtcgctatgttcgaaattttccactgactaagtctgttatcaacggatatggatccaaactgatgattgggcgttttccaattgcggttgttaatattagtgcagatcctgcattaatagacgtaaatgttcatccaaccaagcaagaggttcgaattagtgaagaaccaaaaataggcggtatgctttccaatgctattagggaaatgctggcagataaacaattgattcctgatgcaacaagggatttcaaaaagtcatttgcacccagtgatcagtcgatcaactattcgaaatcagtcattcaatcgataccggaagaacaacctttgtttgctgtgaattcaaaacctgttgtttcaacaaagcagcaaaatgaagttgatccaattgtgatcaagaaccgcgacgatttgcaaagcccaagggtagctaaattggattcattgttgtcctctgaagcttcatcggtaccagtgtttgatgagagcggctttggggtaactgctaaagtccaaccaaagaaccctgttcaggtaaccaaaccggaacaggaggaactggtggttgaaaccggttttccagatcttcagtatattggtcagattcacggcacctatttagtcgctgaaacgcctagtaatatgtatttaattgatcaacatgcagcacaagaacgaatcaattatgaatattatagaaaggcaattggcgaggtaggtcgtgcgcagcaaaaactgttggttccgatcgttttggactattcaacttctgatttcttattagtgaatgaaaagattcccctgcttaatgagctcggcattcatcttgaacaatttgggcaaaacagttttattatccgtgaacatccaatgtggttcaaggccggtcaggaagaatcaaccattaaagaaatgatcgattggatcttgtctgatcatcgattgtcagttgcagctttcagggaaaaaaccgctattatgatgagttgtaaacgggccatcaaggcaaatcatcatcttgacgaacggcaggccaaggcacttctagcaaagttacctgaatgcgaaaacccttataattgcccacatggacgtccaacgttggttaaatttacaaatgaagatattgaaaaaatgttcaaacgaattcaggatcctcaccatactgatgaagaaatattataatttagtgtcgagtctggtgccaacttatgatacaatttattagcaaacatacgttttaatgaagaggaaaagtaaatgtacgaatttatggatggacaaattgtcgatattacgccggcatatatcgtgttacttgtaaatggtattgggtatttaatatatactgctgatccgtacagattcaatgttgatcagaataaaacgattcgagtatacgtttatcagtcggttagtgattcagccattttactttatggtttttatgaagcagatgataaaaagctttttgaaaagctgattgctgtttccggaattgggcctaaaagtgctttggcaattttagccggcaacgaccgtagtggtttagtttcggccattagcaataaagatgtcaaatttttaacaaaatttccgggagtcggcaaaaaaacggctcagcaaattattttggaccttcaagggaaggttggggatttatcgcagattgtgcaagcacgttctggtcagagtgcttcagagcagtctgatgagcttcgggatgcaatttctgcgttggaagccttagggtattctgccaaacagatcgatgcaatcaggttagaactgggtaaggataaagcactaacgaccgatgaatatctaagtcttggacttaagttattgatgcattaggaggtgtaactggttggataaagatgaccgaattgtttcaccggaaaatgtgaatggcgatgagaacaacattgaaaaaacattacgtccacaaaccttgggtgactatattggccaaacagatgtaaaaaatgaattaaaagtctacatcaaggcggctaagcaacgcgaggaatcattagaccatgttttgctatacgggccacccggtcttgggaaaacaacgcttgcaatggttattgcgaatgaaatgggtgtcaatattcggacaacgaccggtccagcaattgataaaccgggtgatttattatcactgttaaatgaattaaatcctggcgatgttctatttattgatgaaattcatcgacttccaaaggtagtcgaggaaatgctatattcagcgatggaagatttttttgtggatatcattgtcggtcaaggatcgggtgcacatccggttcactttccactacctccgtttacgctaattggcgcaacaacgcgagcaggtatgctctcagcacctttacgcgatcggtttggaattgtagaacatatgaactattacgaagtgtcggatctggaagagattgttcagagaactgccggtatttttcaaattcccattttaaaatccggtgcgcatgaaattgcacttagatcacgagggacacctcgagtagctaatcgtttgctaaagcgtattcgtgactttgcacaagtttttgacaaagacagtattgatcttgaaattgttcgatatgccttggaaaagttaaaggttgatgacttggggctcgacgcaactgatattaaattattacgaacaatgattgattattatgatggcggtccggttgggttaaaaacattggctgcaaacattggcgaagaaacagatacaatcgcagaaatgtatgagccttatctgcttcaaattggtttaatcaaacgaacagcacgtggtagaagagttacgccaaaaggctatgaacatttgcattacccaaataatcctgataacttggtatgaaaggaattggaaccttgaaaacaacttacactttagaagattttgattataaactacctcacgaacttattgcacaaaccccgattaaagatcgtgacgaatcgcgcttgttggttttgaacaaagaaacgggtgatatgcaggatcgtcgtttttacaatattattgattatttgaatcctggggatgctttggttatgaatgactccaaagtcatgcctgccagaatttatggtgtcaaaaaggacaccggtgcccacattgaagtccttttacttcataacattgatggggatcgctgggaaacattgatgaaaccggccaagcgtgccaaggtggggacggttattgactttggtgagggtcaattacaagcagttgtaacaaaagaactggatcatggtggtcgagaaattgaattcaagtatgaaggaattttcattgaaattcttgaaagacttggtgaaacacctttacccccatatattaaagagaagttggacgatcctaatcgttaccagaccgtttatgccaaggaaatggggtccgctgcggcaccaacagccggtctacattggactaaggaactgcttcaaaaagtagccgataagggtgttcatttagtttatttaacacttcacgttggcttagggacattccggccggttgaagaggacaatattgaggatcataaaatgcatagtgagttctaccgtctttcggaggaagcctcaaaaacgttaaacgacgtccggaaaaacggtggtaaaattgttgccactgggacaacttcaattcgaacgcttgaaacggtaggcactaaatttaacggtgaaatccggcctgattcaggttggactgatatttttatcaaacccggatatcaatggcaagtagttgattcctttattaccaattttcatcttccaaaatcgacacttgttatgttagtggcatcttttaccggccgtgaaaacattttgaacgcctatcaacatgctatttctgaaaaataccgattctttagtttcggcgacgcaatgtatattcattaggaattctaggaggatttgtatgcaaccagcgatcagttatcgcttgattaaaaaagagaaacacacgggtgctcgactgggtgaaattacgacaccgcatgggacatttagaacgcctatctttatgccggtcggaactcaagcaactgttaaaacacttgcgcctgaagaattgaatgacatgggagccactattatattagccaacacctatcatctttggttacgcccgggtgaggatattgttaaagaggctggtggtcttcataaatttatgaattgggaccatggtattttaaccgattcaggtggatttcaggttttttcattagctaaaaatcgtgatatcactgaaaaaggtgtcacttttaaaaatgaaattaatggtgacaggatgtttttatcacctgagaaggcaattcaaatcgaaaatgatcttggccctgatattatgatgagcttagatgagtgtccgcccttttttgagacatatgattatgttaaaaaatcagttgaacggaccagtcgatgggcggaacgcggattaaaagcacatcgaaatcctgatactcaaggactttttggaattgttcaaggagccggttttgaagatttacgaaaacagtcagcccaagatttggttagtcttgattttcccggttattcgattggtggactctcggtcggagaatcaaaagcagagatgaatcgtattttggaaacgacaacaccgcttctacctgaaacaaaacctcgctatttaatgggagtcggcgcgacggattctttaattgatggtgtgatacgtggcattgatatgtttgattgtgttttgccaaccagaattgcaagaaacgggactgtcatgacctctcatggacgattagttgtaaaaaacgcgcaatatgctcgcgactttcgaccattggatgatcagtgcaattgttacacttgtcgaaattattctcgtgcttatattcgccatttgattaagtccggtgaaacatttggcttacgtttagccagttatcataatttatattatttgattcacttgatgaagcgcgttcaacaagccattatgaatgacaatcttttggacctacgagcagaagtttttgaacaatatggttataataaagcaaatgctaaaaacttttaactatggacggttgactagttatttggtaaagtattcttatggaaagtgtgggtgaaaaatattgaacagttctgtttactcaatcttaatgattgttgttttatttgcgttgatgtattttttaatgattcgtccgcagaaaaagcagcaacaaaagcgtcgggatcaattatcaaagattaaacctggtgatcaagttgtgacaattggtcggcttcatggggtaatcgatgagattaatgaggcagataagaccgttactcttgactgtgatggtatctaccttgtgtttgatctgagtgctattgcccaggttaagcaaccagcagttactgcaccagccgcttcagcaactgcgactgaatcagctaatgcctctggaaaccagtctgacgataagactaatgaatcaaattcagatcaaactgatcaaaagccggatagttcagctgatgattctaagactgaagacaagtaaagtaaaagggttggtggcagaacaatgttttgtgccagccgtttttttcggagtgtcaagaacatacgtttgacagctgtggggagagggttgaaccgatggggacaatttttcgaaaaattattcatgttgatatggacgctttttatgcgtccattgaagaacgcaaagatcctagacttaaactaaaacctttaattgttgccaaggatccaaagttaacaggcggacggggagttgtatctactgctaactatgttgcgcggaaatatggtgttcattctgcgatgagcgttcaaaaagcccttgagttatgtcccaaggcagtctttcgattttcggggttcgaactctacagggcagtttcagaacagattcaccagatttttcatgaatatacggatatggttgaatatgttgctcttgatgaggcctaccttgatgttacaaaaaataagcgtcatttagacgatccaattcaaattagtcgaatgatccaatctgaaattctacgtcgaacaaaattaacttgttcggttggtatttcttataacaaatttcttgccaaagaagcctctgactatgcgaaaccatttggactgacaattattcaacacaaggatgcccttgaatttttaaaacggttaccaattgaaaaatttcgtggtgtcggtaaaaagacgattcctaagatgcaccttttgaaaattaacaatggtgttgacttattgtcatggtcacaaatggatttaataaatgaatttggcaagttcggctatgttctttacgaacgtgcacgtgggattgatgatcgaccagttgaatatcagcggattcgtaaatcaatcggtaaggaaaggacgtttggcccggagattgataaccaaaatcaaatagatgatcatctcatgcgaattgcggaattggttgcttcagaaatgaagaaaaagaaaaagcacgggaaaacgctggttctcaaaattagatataaagacttttccacttttacaaaacgggtgaccttagataattatataaaaaacaatccggatgattatttttcgttagcgagtgatctgttagctgaaatgccggatattgcaaccggagtacgtctgctgggaattacgctcaccaacttagcagacctgaattatgaaaatattgttttagatttgttccactgagaaatgatgtttatatgtctagccatttagtgtatactgaagtgttcgagaaaaaataagttgataggatttgactgaagttagatgcaattttcaacgactttctagcttacttaattgatttttgtctaacatcgctcaatctaacttaaatataaggagtctaagtaatgtccgttcaagaacaaatattaaatcaaataaagcaatataaaacaattattattcaccgtcataaacgcccggatccagatgcaattgggtcacaaatgggactagcagagatcattcgagcttcttttcctgataagcaagtattttgtgctggtaaaaactttcccggttttaaatggttgggaacggctgacgaaatttccgatgatcaatataaagacgctttggtaattgttgtcgatacagccaatcagcctcgtatagatgatgaccgctacacaaaaggaaaagcgttaattaaaattgatcatcacccaaatgatgaccagtttggtgatccgatgtgggtggtaccggaagcttccagtacttcagagctcatatttgacttctttgatatgtttcgtccggaattaaaactctctgatgaaggtgctcggcttctttatgcaggcattgttggtgatacaggacggtttatgtatccctctacgtcgtcacacacacttgaagttgcttcaaaattgacgacttatcgcttttcagcaagtgatgttaatcaggcagaggatgaaatcgatatgccacttgcccgcttatctgcttatgtttatgagaatctgaaaatactcaaaagtggcgcagcttacctaattttatcaaatcaagttttgaaaccgtttggacttggtgatgaaagtacgtcttccatcgtgccgttgccgggtcgaattaaagaagtcttgtcatgggcaatttttgttcaacaaaaagaaggcgattatcgaattcgacttcgctcaaagggtccagaaattaacgagcttgctaagaaatatggtggcggtggtcatccacttgcaagcggtgcagtggttgataatgatgaccagattaaaccttttattcaagatctggatgacttggtcaaaaacagtaaataggagatcttatgacacaattttcagagtttcatttaaagccgtttattttaaatgcattagacgacttaaaattcactaagcctacacctgtccaagaaaaactgattccggttatcttgcagcatagagacgttgttggccaatccgcaaccggaagtggaaagacacatgcatttttgttgccaatttttaatgatattgaccccaaaattgatgaagttcaggcggttattacaacaccgagtcgtgaattggcatatcaaattcttgatgctgctaagcaacttgccaagtttagtccggatccaatttcaatcggcagttacgttggcggaactgataagaaacgacaagaggataaattaaaaaaagaacaaccccaactaattgttggcactcccgggagggtttgggatctgatcaaaaacggtggactagatgttcatactgcctccaaacttgtcattgacgaagctgatatgacgttggatatgggctttttggacgttgttgatcatattgccgccagttttggtaaacatgttcaaatgatggttttttcggcaactattcctcaaaaaataacggttttcctgaaaaagtatatggataatccggttattgaagaaattccagtttcctcaattattagtccaacgattgataattggttgatttcaactaagggacaggataaaaaccagttgatctatcatttattgacagttggtgagccgtacttggttttgatctttgcaaatactcgaaaacgtgttgaagagttgacggaatatttacggggacagggtctaaaagttgcaatggttcatggtggtgtgaagcctcgtgagcgaaagcaaattatgaaacgaattaaaaatttagactttcaattcgttgtagcaaccgatttggctgccagagggattgatattgaaggtgtttcacaagtgatcaatgatgatattccaactgaagatctggaattttttattcatcgcgttggtcgaactggacgtaatggtatgtctgggacttcaattaccttgtattctcccgatgaagaaaaagaagttgaggaacttgaaggcatgggcattcattttaaacccaaagcgctgaaaaatcatgaaattgttgacacttatgatcgaagacgtcgccaaactcatcgcaagaaacgggaaaaacttgatccaacaatgattgggttgattaagaaaaagaagaagaaaataaaacccggttataaacgtcaaattaagatgtcaatttcccgaaaggaagaaatggatagacgagtgtcaaaacgtgaggaatctcgggcaaaacgtaaacaacgtaagcaaagttccaagcgatataagtaaaattcgattgacatcaatttcacaaaaaagtatacttttaatgtcttaagaatatgccaagtatgattgattttcagaaacgttttggttgatgagaaaaacgatttgatcaatttggtgctctcttaattcacttacaattaaacacaaactctatttttagagataaagtggttacgatcaaacatcgttgcaatcagagtggtaccgcgtcaatcggcgtctctgttagcaacggtgttttattttgtttaaaggagatattgggatgaaaaccttaagcagtagtcaaatcagacaaatgtttttagacttttttcaagaaaagggtcatactattgagcccagtgcatcactaattccggttgatgatccaacgttactttggattaactccggggttgctactatgaagaagtattttgatggttctgttgtgccaaagaaccctagaatgactagttcacagaaaagtatccgaactaatgatattgagaatgtcggaaagacacctcgtcatcatacattatttgaaatgttgggaaacttttcagttggtgactattttaaaaaagaagcaattgcttgggcgttcgagcttttaacgtcaccaaaatggtttggctgggataaggataaactttacatgactgtttatccaaaagatacggatgctaaaaaatactgggaagcagttggtgtttcgcctgaccacattattgaaatcgaagataatttttgggatatcggccagggtccttccggtccggattctgaaattttttatgatcgtggtgctgattttgatgaacttgctcctgacgatcctgaaaattaccctggtggtgaaaatgataggtggttggaagtttggaacattgttttctcacaatttaatcacacaccacaggatacgtacgaaccacttccacgtaagaacattgataccgggatggggcttgaacgtgttgtctcaatttttcagcatgccaagaccaattttgagaccgatttatttttgcccatgatcaagaagaccgaagcgtttagtgatcataaaaaatacggtgttaataaacaagatgatgttgcttttcgaatcattgccgatcatgccagagcaattacggttgcgattggtgatggtgcattaccttcaaatgtcggacgggggtatgttatccgtcgtttgattcgacgtgcaattgtgaatggacaacgtctgggaattaacgcctcttttctttacaaattggcaccagttgttggtgaaactctgaagtcatactatcctgaagttcttgagcaacgtgactacattgaaaaggttattagatcagaagaagaccgatttaacgaaaccttagcagatggattgaaattacttcatgacgtcattgccgataccaaggctgaatctaaaaatgaaattgatggcccaacagctttcaaactttatgacacttatggatttccatatgaattaaccaaggaggaagcttccgaagttggcttaggtgtcgacaaacaagggtttgaagttgagatgcacaagcaaaaggaacgcgcacgtaatgcacgcagcggtgccaaatcaatgggtgttcagcgagatctattagttaaggtgaaagacgacagtgagtatgtcggttatgacacacttgatgttaaagatgccaaattaatcgatatcgttgaaaatgaaaaattggtttctgaatcaaaagcggatacaattgaagtcattttcgacaagacaccgttttatgctgaaatgggcggtcaggttgctgatcgcggcgttattttagatgaaaacggtgataaggtcgcagacgtgattgacgttcaacatgcacctaatggtcaaaatattcatacgatcaaaactcaagagtcgcttgtaaagggacaacggtatcatttagtggttgataagttattccatagtcgagttgaaaaaaatcacacagcaacccatttactggatcagtcattaagaaatgtattaggtggccatacccagcaagctggttctttagttgaacctgggtatttacgtttcgatttcaatcattttggtcaagtaaccgatgaagacttacaaaaagttgaacaaatggtcaacaagcaaatctttaaagaaattgacgtcaagacagttgtgactgatcctaaaactggtaaaaaaatgggtgcaattgcattatttagtgaaaaatatggtgataaagttcgagttgtcagcattggtgatttttcggttgaattttgtgggggcacccacgttaaaaatactcgggatatcggtttattcaagatagtttctgaatccggtgttggtgccggtgttcgacgaattgaggctgtgacgtcaaaagatgcatttaaattgttaaacactcaagctagtgaattaaaacaaatttccgatagtttaaaagtgacgcaattaaaagacgtacctactcgagttgaacagttacaagatgaaattaaaaacctaaaggcaaagcaggattctcttgaagccaaacttgctggacaacaggctgaatcagttttcaaccataagcaagaagctggacaatctaccattatcacaggtattatcaaggatgcaggaatggaccagttgcgtcaattaacggatacttggagatccaaaaggttatcagatgttttagtacttggtaccggaagcggtcaaaaagcaaatctagttgttgccgtttcagataataagataaaagatggtattaaagcgggagatttaatcaaatcaatcgcttcaaacattaaaggtggcggtggtggccgccctaatatggcgcaggctggtggaaaggatccatcaggattggacaaggcgatgaaggccgcagtcgaatggctgggtaataagtaattattacatcaggattacatgtcggttacattcgttcacttgattgtagtttcatcaataatcagttaaaattaatacaaatgaccttacgtcatagaggtgaattgtatgagttcgttagataagaccatgttttttaatttcaatgaggatcagccaaaagatgttcgagatacgctcttgactgtttacaaagcgttggaagagaaaggttacaatccatataatcaaattgtcgggtatttgatctccggcgatcctgcctacattccacgtaacctggatgctcgaaatttgattagaagacatgaacgtgatgagattattgaagagttggttcggttctatcttgataaccatccaaacgattcaaaaaagggtgaacaatgagattaatgggattagatgttggctctaagacagttggagttgcagtcagtgattcattgggttggacttctcagggggttgagatcattccgattgacgaagaaaacggcgaatttgggctagaacgagttgcccagttggttgacaagtatgaagtcgatggatttgttgttggcttaccgaagaatatgaataattctttagggccaagggcagaagcttccgaacagtatggagaccgattagaaaaaaagttcaaacttcctgtagattttgaagacgaacgtttaacaacggttgaggcgcaacgaatgcttaccgaagaagcggatatttcacgtaggaagcgtaaaaaggtcattgataagttagctgcaggattaatcctacagaattatttagaccgcaaaggaaaattaactagaatatgaggtatgcaaaatatggcagaagatcctacacaacaacaaattacgttagttgatgacaacggcgaagaaacactctacgacgttttattcactttcaagtcagaagatttcgatcgttcgtacatcttgatttacccagcaggcaaaaaagatgatgatgaagttgaaatccaggcatacgctctacctgcaggtgatgatccaagtgatccacaaggtggggaacttcaacctatttcgactgacaaagaatgggatatgatcgaatctgttttgaatacttttttgggtaaagatggtgacgatcaagacagtgccgacgatagtgataatcagtaattaagtatttggaaatatcattgtgattgaaggattgagtacaaagattttggctcagtcctttttagttgagtatttttaggatgtgatttaatgtcgaaagacgaaaaacgacgatttaagacaacgattggcgggaaaaattatactttggttggtaagggttcggatgaacatttacaagccgtttcggatcttttaaatgagcaattgaaacagttgcgtcaattaatgccaaatatttctgatgaacagcgatcgatactggtagcatttaacgcaatttccaaacagttcgaattagaagaacaactggcaaagggacagtcccaaagcgctcaatctcaagaatcggagtgatcgttgagtgatactgaatatgattatattactaatcctagcgattggctttcttaccggctggagaaagggatttgttgttgaggtattaaatctgattggatttattgcttcaatgacagccggtgttttatttgcaggaccgattgcggcgtttgttaatcaattcatagatcgatcaggaggcagtaatagcgcacatttgatgattaaattattcatttttgttgtgctattttcgctcgtttggcaggtgataagaatacttcggcgggtattaaccccagttaccaagttaccgttaatcaatcaagcaaatgcaattttgggtggcggtattaatttgattacaaagtatctggtgatttttgtgatgttgaatgttttgattcttttaccaagtcagggaattcaaaatcaatatcaacaatctgccgtttcacaatggattgtcagacaaactcctgttttatcagaaaaattagccaatttttggacttcaaattcaaatgaggaaggtatatgaacgaaaaagttttagaaacactagaatataacaaaattaaggatcaactggccaattatttaacgaccgatcgtggccgtgaaattattgatcaacttcgtccaagctcaaaatttgaggaagttgatcatcgccttaaagaaacagaagatggggcaaatatcgttcgtttacaaggcgaaattccaattcccaaattaactgaaatctctccttatatgaaacgtttaagaattgaaaatgcttctttgagcggcacagaactgtcccacattacaaagcttttgagagctgttagaaccattaacgatttctttgataattttcaagatgaagatgttaatttaaccgttgtttctcaaattgtgtcgcaattgacgttaatgccggaaattaccaaacgaatggttcaatccattaatgacgatggcagtattttggatacagcatcttcggaactaagaacgattcgccgaacaattaatcgaacacaaaatgatattcggtcacggatgggaaaatatctcaaggggtcggattctaaatatttaactgaatccatcattacaatgcgagaagacaggttcgttttaccaattcgtgcagattataaacaacattttggcggaattgttcatgatcagagtgcttctggtcaaacgctctatgttgagcccagtaacgttgtcgagatgaataatcagttaagacgggatcagcttgccgaaagggcagaggaacgtcgaatattagctgaactaacagatcttattcggccatatcgatccgaattattaaacaatatgaatttggtcggtcaacttgattttgtaaacgcaaaagcaaagtttgctcatcaaatcggggcagtgcagccggaaatttcacgcgagaatgtggttaatttaaggcgggccagacacccattaattgctcgagataaagcagttgcaaatgatattcaaattggtgatgggtatcgtaccattatcattaccggccccaataccggcggtaaaacaattacgcttaagactgttgggttattacagttaatgggacaatcaggattatttattactgctaacgaagagagccaaattggcgtatttgatgacgtttttgcagatattggtgacgatcagtcaattgaggccaatctcagtacattttcttcgcatatggataacattatttcgattctaaatggcatgtcatcccaaagcctgattcttttagatgaactgggagccggcacagatcctaaagaaggagctgccttggcaatggcaattatcgatgccattcatcaaagtggctgtgaattgattgcaacaacccattatcctgaactaaaggcctatgcatataatcgctcgggaattatcaatgcctcgatggagtttgatattgaaacgttacgaccaacctatcgtttcttgatgggaattccgggacaaagtaacgcacttaacatagctagtaaattagggctttcaaaagaaataattgagaaagcgcgggcttttacagattctgaaaatcaagatattaataacatgattgatgaattgactgcacaaaccaagcgggcgcatgatgaagctgatcaacttgatgagcaattgactgattcaactaaactccatgatgaccttcaaaatcaatttacccaatatcagaatcaaaaggatcatttacttgaacaagcacgcgaacaagccaatcaagttgttgaaaaggcaaaaatcagtgctgataaaatcattgctgatcttcacaaaaagcaacagcaagttggtcaaagcgccattaaagagaatgaattaatcgatgccaaaggtgcactaaaccgacttgaagtgacccctaaccttaagaaaaacaaagttcttcgaaaagaaaaagctaagcatgattttcatcccggcgatgaagtattggttaagtcatatgggcaacaagggacattgattcgccaggaaaaaaatggcgcttgggaagttcaactcggaattttaaaaatgcaaattgatgaaaacgacttggaaaaagctgcacccgagaaaaaagctaagcagaagtatcaaacccaggtttcacggacgcgttccagtggtatgtcgccgacacttgatctaagaggccatcgttatgaggaagcaatgtacgagcttgacaggtatattgattcagctttgctagccggctacccatctgttacaattattcatgggaaaggcacaggcgcgcttagaaaaggtgtcaccgagtaccttaggagtaatgccagaataaaaagttttggttattcggctcctaatgctgggggagacggttcgaccgttgtgaagtttaaatagtgtgaaggatttttttaaaacgacatacaattggttgctttttactataaaattgttagtataagactattgaaagattggagtgtttggtatggtaaaagaaacaacagatcaaacttttgaaaatgatactgccaaaggtgttactttgactgatttttgggcaacttggtgcggtccttgccgtatgcagtcaccagttgttgaagagctggctgatgaattggacaacgttacttttaataagatggatgttgacaagaatccggataccccttctaaatttgggattatgagtattccaacactccttattaagaaggatggtcaggttgtcgataccgtcgttggctatcatccaaaagaacagttaaagaaagttttagctcagtatacagactaattttatcaaaagaaaaaggctggacaaatttgagaacccctaaagtaaagaactttgggtggtcatctcatttttgctccaaccttttttgtataccaactattcattggatgaatcttcagattcaggatgttttattttgaaaagactgttggcctcttgatcgtcaaccggtttgtcttttccaagaaatgtactaattagcacgattcccttggaaggattggtttttgtgatctctgcttccgctgtctgatctgcaatatactggcagctttgagcaataaacccggtttccaagtaaaaatccggatcgtcgaataaatctaatctttttttgacaatgtcaccacttaattgccagttaagttgaccgctgctcttcttgagtaaacttagatctcccagtttaaattgggtgaaaaatgcgatcaagtcatcgtaatttgctaaacgatggcttcgagataaatgtttaccagcccagtatgaaatttcatgattatctgatcctagaatgcttggtaataggtcatccctaattaatgcttgacccaacaaattagccatttgtgggtcctctacgattgtactgtacgtttcattatccattttttaatctccatcaatgcaaattgtcataaatttattatacaatatatttagcaaatctgttttgtttgtcaactatcgcaaaaaataattaaactgataattgataaaagggaagaaggaattgacgtggataatcggccaattggcgtaatggattctggggttggtggtctaaccgtacttagggaaattgtcaaaattctccccaatgaatcatatatatttgttggggatcaagctaatctgccatatggccaaaagagtcctgaaactgtcaggaaactgactaaaagaattgctgattatatgttgaaacagaacgtgaagatgtttgttatcgcctgcaacacttctactgctgcttcattggattatttaaaaaagatcttaccgattccggtcataggcgttatcgcaccaggtgcagagtcagctgttgcggcaacaaataataacaagatcggtgtcattgctacaaacggaacggttaactcgggcgtttatcaaagaattattaaaagccttgatccaaagagcgatgtttattcattaggatgtccagactttgtaacaatggttgagcatggtgatgccggtagtgagttagccagggaaaaagtaagtcatcaactagcttattttcatgataagcctattgatacacttgtgctcggctgtactcattttccggtattggaaaccgaaataaaagatgctgtcaattcagggattaatttgatagatcctggtatttcaaccgctaaaaatgttgctgactacctgcggtcacatcatcaaatgagggattcatctcaatccccgcaaataaaatcattctttaccacaggcaatcaaaatgaatttacaaaaattgccgatcaattgttaggcaaaagaatcacagccgatcaccttagtttgggaaaggaagatgttattagttgaaaaagccatcgataattgtcattgcatcaaaaaatgcgaataaagtaaaggaattcgacgaagcgtttaagggtaccgacatcaaaattgaatctttgaaaacttttagtaatgttccagatgttgaagaaacagggcaaacgttcgaagaaaatgcttttttaaaggcatctgcaataatggcgtttacaaaactgccggtaattgcagatgattccggtctcgttgtccacgctttaaatggccagccgggggttcattctgcacgttatgcaggagatcatgatgacgatgccaataatgcaaaacttcttaaagaaatgcaaaataagaccaatcgggatgcctattttgagtcagttctgatatatttaacaccagaaggagacaaagttatttcaaagggacgggtgaacggtcaaattttgcgagctcgtcgtgggtctaataattttggatatgatcctttgttttatgttccggaacaacagttaaccttagctgaaatgtcaacccatgataagaatgcgattagtcatcggggacgagccattcgtcagttaattggccaattaaatgagcggtgggatagttgaaaatacttgtagtcagtgataatcacggtgatcgtcaaattgtttgcgacttaatgacacactacgatggtgaagtcgatggctttttccattgtggtgattcagaatttgattcaaacgatcccttgatttctagaatgcatattgttagaggcaatatggaccatgctgcctttgctgaagatgaaataagtaaaattgatgggaaaacaattttgttgacccatggacatctacacggtgttaacagtgggctactgacattagaactttttgctaagagtaaagaggccaatattgttttgtttggccatactcatcagcttggtgtcactcaagatcaagggattttgtttgttaaccctggaagtatttccctgcctcgtggtcaatatgcttatataggcggcacttacgcaattatcagttcaaaaaacaataaacttgttgttcaatattacgatcgaaaattcaatgcggttgatgagttacggtttagcttctgatcagttgaaaggaaggtcattttttagatgattgacaagccaattgaaacggtgatgcgccaaagcaagcgagatattttaattcccgctgatctggttgcgaccgtcaatgaagataacaatttacagcatgcatttcttgtattaacaaaagtgaaatatgcaaagattccagtgcttgataatgataatcattttaaagggttgatttctttatcgatgattacagagcagatgctattggatactggaattacgactcgacctttggatagtatgaaaataaaagaaattatgcaaaaagatgttccgacgatttatgaacgggaaaatttagaagtgattttaagacatctggttaatgaaaatttcattccatacgttgatcatgacaataaatttttagggattattacacgccgagaactgtttaaagaaattaatttccttgcacataacttctcaaaacgttatgtggcattgccggtttaccatgaaaagactgtgagtcagtctgctgcgcagtaacgctacgttcagaaactacgattaacaaaatttaaaaacgagtccgaagcagttccgatctctgctcagactcgtttttatataaaactctccgaggagcgcttcgcttttcctcgtaaccatcaatgaaaagaaccgtcttcctttgtataatataggtgaaggcggtttcattgtacatcgttatctttttggtgctaataag
